United States Patent 9,441,224 (LONG NONCODING RNAS AND CELL REPROGRAMMING AND DIFFERENTIATION) - sequence listing, part 3

SEQ ID NO: 237 - DNA, 29767 bp, Mus musculus
cacagaaaccatgtgactcgtgtttattctataaagatcaggagatacacaaatccagcaaactcccaccgaccagcagaggaccactttcttgggatctgcttcctgtgtccgtccacatgagaacacacgctttgtctcaggtgagaaggggcgagccctgcctgcccagtgtctagcctctggccagctgtgcagctctgccaagccttagacacataacttacgtcggaccacattttgcacagattctgaggtagtcccagtgatgtctgcttggctcctctcctgctcactgcacgttagtgtcctcggttggtgtgaccccctgacctgctgtaactgacccgtacatgaagctggcctgtggaatgctctcccaagtaggaccctgaagggtgggcctacgttccccagcagaggcatactgaaaaggtgctcgccatggccagaccagagttgcttgaagccacatcatagaaatcttaatacacacaacacaaggaaggtggaaacttcctaagctgtgccaggcacactggacggcgcttgcaccacaggtaggtttaggctctcttaatgagagcctgtcctgccccccaagcaaggtagctgcagtgtctcagcagtctgctgaaatggcctctgacgaagggaacttgagtctgtgtccaggccaattcactattttaattaattaattaaattaattaaagacaaggtttctctgtgtagctctggctgtcctagaactccatctgtagaccaggctgaccttgtacttggagatctgcctgcctctgtctcacccagtttaggcctattcagtcttacccacttccattcaccaagtgccctgggtgtccatacaggcctagggggctcacctgttctgcctgctctccactcacagggccaaggagccatgagtatgtggaccacccttgtaaaaggcttgggagcactgtcagagggtaagggggtgggagggtgagtagtgccacaggcacgcccagatataaggtggagcatgggtccatatgagctgtggggcctgtgggtgctactctgagaactcactagtgtctaacacaggtctttcttgccacccaaccaagaggctcctgggctgggctgttctgcctccaggcgggaccatctgcttctctggtcacagcagggcagggaaaggcagtgagtaacctgggctgagagaggtcagagccacaagaagctgcggcttggctgaaggcaaacagttcgagaaacaaggtggctggcagagggccctgctgggaccaggatcccaaacagctgggaaggagtgctgaggccagagggaccgagcgacttagcaggcctctagtttcacactggtgcagcccttgcagatccccacaagagcaaccaccccaactctggcccctagctggggaccctgggcttgttccagggtcagcagggtggctgtcttgaagtgggaagtaaagccacagatggtcctcaggctatggaagccacagtccctaagtcattttatttgtcctcaccggcagctctagctcgccttccctaggtctcaaggctggctagttggccatgaaggtacaggatgggattcaagagctgccggcacctccggccacgtgtgagtcctctagatctcatggcacacactgtccttggtcagagctgtttgccaccttccagctgcatctggtgtgccagctgctgcccgatggccagcaggggactggctctgtaggttgggctggccagcagcttctgaaaccgggtcctttcttcttcactgaaagtgaggaaagcagaggtcagcatggggagaacagaaaccccaggatccatccacctaacactggagcagacagcagaggcccagagcacccacgagtgcagtaccagggcacacaggctgccgagcacacaccaaccacccgtggggtcgccctaccagtaggtctaagagggatttgctaggggctgctgccaaggcacaagctgatgatcagggagcagtggcagttgctttatgtaagaggtgcctttctcccaaatgagcccaaaatagatgtgcactagagctgtgagcaatggggcagctacggacacaggcagcttgggggcctctcagatacataagagcctaggctgtcaggtcctcttaccctttctctaactcagcatggctacttcagtagagcctaaagacacaatgagagtcagcagagaaggcaatgtctcacaggctcctagatttgaatttttggtcctcagttagtggaactatttgggaaggattaggaggtgtggccttgttggaataggtatgtcactgggggtgggtttgaggtttcaaaacccacacccggctcattctctttttctctacctgctgcctgactcagtcagagagagttcaagactaaactgagtaagaactacaagactagatttagtaagaacctatctcaaaaaagcaaaatcaagagccaggtggtaatgcacacctttaatcccagcactcaggaggcagaggcaagtggatctctgtgagtttgaggccagcctggtctatagagcaagttctaggacagtcatggctacacaaagaaaccctgtctcaaaaaacaaaaattaaaaacaaaaacctaaaaccaaacaaacacaggagacaggctatacctcagcagtagaacccagaatgaatgggggtctgggtagaattcccagtactgggaagacagtttaggctgtaaaattctatactgatttccaaaatcaaaagtaatcattaaaaagaccttactgaatctatacactattgacacagaacacaacactaaaaactaacagaggttgtatacaaacaaaataaccaccctgcacaggtgatatccaggctgcctcaggctcccccgaagacagcacagcattgaagctaagtcgacagaggcttaagagcagaggcaagaatctcatgcccaggctcacatctgagaagagtgtcaggcagtcaacagggcaacaccgctgatggacgaggggcagagctcccagccaccaccctggagactggggaaaggaagttctcacactagatagcatcacctctccatggaggaacttcagataggcgcccaaggcctaactacaggacagcaaagtttttggttcccaaaaaatgtctcccacctgtagtcagaagccaagctaagagagaggaggtgtagaagtgggagggggctggaggtcggggtgggagtgcagatcaggatatcaggaagaaggccctgtggggcagggctatactcacagaagctgctgcctctgtactgtggtcattcggctgagctccactggccggggcttgctggtcaccctgctgtggatacagagagtccaagtgagtctgatacatttcaccagagaatttattctgtggcccctagtgtctacagcatcaggagttcaagagtccacactgtacattggctgtggagactgaatctagatgagcggtgtcacctggctaccagatctagagttaataaccacagtatccaggatcttgtctcactccctaaggttcctgtgtgatatagaaaggtctatcacctcaggaaaacacatcacttttgtaccccgagtctgccacctgaccaagctgagtggagaacaagccctctaggcggcagcctgccctagaccctcaactccactgccagggcagaacctttttctaaaaccagacagcacttcctgacatctgtcctctcacttttgacaagagaagaggaagctacactactagcggtatgtggtacataccattccagtgcgaccctaggagccaggcaccaacccatgctgcctccagatgccaacgtgcaccaagggaccttctagggcaagagtgtggtgcccgctgaccaccagaggggagtgtcatgacagattctcagaccttccaagccactacactaggtatggctgagggtgggatggggggcagttagtctgagggcctaggactcagtgccaggcagcatctcctaaggtcatttctgatggctgcaggtcatgccaagaacattcctacagggctggtgagatggctcagtgggtaagagcacccgactgctcttccgaaggtccgaagttcaaatcccagcaaccacatggtggctcacaaccatccggaatgaaatctgactccctcttctggagtgtctgaagacagctacagtgtacttacatgtaataaaaataaataaatctttaaaaaaaaaaaaaaaaaaagaacattcctacaacatcctggggagcctggaccaatatctgaaagggagaggcagccccagccagcagcacgggacctggacagagaggaagaacccagagcccaccacctgacaagatgatttcagagatgtcatgctcaaagagaagcccagaacgggaggcagccagaggaagggccaaaagcccccactgtgtcctgggccaacacctaatttagactccagatctattcatgttccttttcaaatatgaatgagccgtgcttttgtgtcttctcagtgacttctcacaccctggcctcaggtccctgcctagggaaggactgccaggtttcgtgccaccctttcctgcccccaggctgttaggatagtaatctcaggcctgtttgctctgcccttccagggttccagaatccgcagagtaaagaagaagcacccacacggtagtagccagggcctccagcctgttcctcctgcagaggcccactgcctcaggtgacctagctagtgagcgctctcaggtccactggctgtacgatggggaaagtctctctaaatgcagttcagggctgctgagtatggtggcagtagcccaggtcttataggactctacgcatgggcacacagagatcctgaactcagacactggaagcaagaacacagcctgactctgtgaagttcttccacaagcagacggtgggacttcctagagcacaaaccccatgtggtgtttcataactgaaaaatttaaaaacggcagatttccaaacatacaacagccaaaaataaatccagaaccaaacgcaaaaccattcaggatgtcttcagagctcgtctgagctgcatcatgtacttttactgcagtcctggtcctgattttgcacagcatgcctgacacctcagctcagaggtgagagagttacatggaggaatggcagcgttctccctgcacaaagcttctggctcccagagaagcacaatggtgtcactgtggagacaaacgcttgtgatgtgttttatcgtccttcatgccaggatcaaggtgtctttgcactgtgggttttagaatccttgatttaaaaattgctgtttgaggggctggagagatggctcagcagttaagtgtgggaagccacatgtgctgttgcagagtggcactgactactgctggccaccacgcataagtttggacaaacaaccaatgtgtacatatgcagtaaagttttttgcaaagacactgcctggcccaggcatgataatgaggttctgtaaggtactgagagtataaccaatcagatgtgagacatgcaaatgaggtatgataatgaggttctgtaaggtactgagagtataaccaatcagatatgagacatgcaaatgaggtatgataatgaggttctgtaaggtactgagagagagtagccaatcagatgaggaacatgcaaatgaggcttagtgcataaccaatccgggtgtgagacacgcctctcctaggcctataaaagcagcaccagttctgggctcagggtcttttcgcctctacaatcaagctctcccaataaacgtgtgcagaaggatcctgttgcagcgtcgttcttcctggccagtcgagcgcgcgcaagagttaagagcactgactgctcttccgaaggccctgagttcaaaccccagcagccacatgatggctcaaaaccatttgtaatgaggtcagatgccctgtctgaaaacagctacggtatacttacatataaataaatctttttttttaattgctatttaatttgctgacttcagtttataaaaatgaatgaatgaatgaatgaatgaatgaaactgtgtttagaattagaaattagtttacagcagtttctgaaacagccctacccacacattttgccctctatactgtttaccatgagacccgccattctcagcacttactattgtaatataaaaatgcagattaactgaaaatagtaaagaagctttacagccttattaacacagccaggatttacaattttcttaagacttgttttttattttcacttatgtgtacatgtgtgtctgtgactgaatgccatgggtgcaggtgcccatacaggccagaagagggcatccgatccctggagctggagttacaggtaggttgtgagccactctgctgggaactgaaccacggacctctgcaaaagcagcaagaactcttaatcactgatccatctcttcagctcaagacttgattcttttatgttaaacaagcatgctcatttcatcagtatgcaaatatgctttaatctttgatgaggataaaattatcccacaggatttttaaagtaaatgtatttatgatttattctgtcagtgtttgatttgctcagctaccttgtaaacctctgtacttggggtcacataaaaccccctcaacagccaggcacagcatgcctttaatcccagcacttgggaacagaggcagacatgcctctctgtgagtttgagaccagcctggtctacatagtgagttccaggctaaccagggccagtgagaccctgtcttgaaaaaaacaaaaccaaaacaaacgaacaaaacaaacaaaaaaaccaaaaacccccttctcaggtgcaaaggggccatgagtagaaagcacaagccctgtcctggagaatttctttttggttttttttttaaaaagatttatttattattatacataagtgctcttcagatgcaccagaagagggcgtcagatctcattatggatggttgtgagccaccatgtggttgctgggatttgaactcaggaccttcggaagagcagtcggtgctcttaaccaatgagccatctctccagcccttggttttggttttgaagacaggggttctctgcgtagccctggatgtcctaaaacttgctctgtataccaagttggcttcgaactcatagttctgcctgtctctgcctccgagtgctggaatcaaaggcgtgtgtcaccacacctggcttgttgtagaaaattttctctctcataagtaagttagatggagacagacaacatggtctacctcagtctatgtcaggaattctgtagagcacgccccagcctagctcctgtgagtactgtgaatgccctcgggccatgcggtcattcagcaatgttaggccacaccatggacttacagcggaccaggtaatgagaaaggatcacaggactgtcccatatcatgtccctctaagcttaggacatgaacagggatgggcaaaaactagctgaaccctgtgcagccatctggatatagcaccttccttcccactttgaaaagcagtgcccaggacaaggccagtttaaaacagtaaagagatacctggggcctgaaccccaagggccagaacagcattaggtggccgagagggtggtaaagtgaaggtatgaagagacatctgaaggcagtccccggcatgaggaacatccccactgcagccctcagttctgggtgagcctcccatcctgtctccagcctccaagactccccatgctctgctgtgggtttcctttcctttcccatataaaccatgaccatgatgtaacagctgtctctgagaccaccgaatcctaggatcaccagagtagagtgagctgtctctggtgcatgcacacagatggcagagtgtcttctaactcccagtacgcacgcatgggtcagcacttggcccagagcacctgctctattagaagtaagactctggagtgcccaacactccagcctcagatcttgctgcctggcgtcattctccaaggcaaggagccaggttcctcagagaaacacccggtatcaggaccaggcagaagatgcccaaggtgagctttcagcatctgctgacatcagaaagtgagaaagtgctcagacacacccactccacagacggggcagatcagagccatctggaagctgctaaaagaaatgacagtggccactgctggaacaatttcagcaaaaaagtatcactggatgagagcccactgcataaagtagacgctcacgggccacgggaacctagcccaaggatgctttgtcactggatcacagtgacagaggtgtttcccaggattctcactgtgagaggcttcgtccccttccactctgtgcctctgggaagtggtcagtccacgcccagggtgaggagctccgctccctctcctcagaggcagggtctgcagttctgggggttctgctgaacaggagttttgactcttccccagttattgacctagcctatctcaaacaagacaaaaacaaaacaaaacaaaaaacccccaccccactcaccccaaaaaatgcttgtctcagtctgaaaagctcacagccagaaggagcctgaggaaacaggagaaccacacttaagtttcttcctgttaactatttcattttatgatgtgtgtttatgcaggtatgttctcattcatatatatatataaaatcaatctatctgtgtgtgcatgcacataggtgtatatgaaggccagaggtcaacctcaggggtctccctcaacccatctatctaccttattttacttggagctcatcaatttggctaggccggctggccaatgagcgccaggcatgttgctgcctccacccacaaggctctgggttacagataccatacccagctttttacatgggtgctgaagatccaaactcaggtgaagtgacacgcacagagggaacttcacagcctgagatgtctcctcagtcccctggccactgctttagatgcgagactacacacggctcgatcctggatcattgccaggatcaaatgacaaaccacgatgctaacttagatgttaactgtctttgctactcttgtgcaaatctaaactgctattggtattgcttcttattctgagtcagggtctcgtgctgtcttgcaggctagcctcacgtctgtagcaattttcctgccccaattactcaagggctgagattcaaggaacaggctgccatgcttagcttcaaaagctgttctgaagcagagggcagcaaagcacccggtcatgtgaggaagcagccagggctggggcaggatgggagctttctcccttcacagccgaagcaatcctgggaggctcacggccctagcacacccctctctgggctggtagagcaggctgcttgcgtggctctcccgggtctgggagccccaagagcatgtctcagaagagaagctgtaggaggaagggctccttgggatccttgaccagggtcacattttttgcttaagaacaggaatggactctgcattgctggctctgctcagctgcttagtcttgaccctgtgttggggccctgtctggcctgagcagaatgggtatcccatcttgggaactcagcccttggccatctggttctatagcaaggcacccacttgccccatgacaagggcgagggctcacagacaagtgcacggaacctttgctttatcctcagataaaaactcactgggagaaagatttttttcctaaaggcaaaataagaagtaataagccttgggtggtggcttacacctgcaatcccaacacttgggaggttgaggaggactgtattaagttcaaggttagtctgaggcacacaattaattacacgccagtgtgaatagtgagactttgtcaaccctcaccaccaccaccctccaaaacccaaaccccaaaccaaaacaacagaaaacagaaacgacaaagccaagagttttgagagcagagtcctaaagcccctccctccagctgccccccaccccacccccagggcagctctgcactgctgagcctcggggcctgcacccacgcctcatcctttcactgaacaaggacaggtgtgtctagggctgtgtgggctccagccctctccctgaggtctccatgcagtgggcccacatacagaggctcaccatcagtgggatcaggggagggaggaacccaggcagatgtcggtgaggttccctaagaaagggatgtcagagctgtctgaaaggggagcaggaaggtcaggtggattcacagcaaagaccacgaggcctcatgctgaccacgtgcatagtatggaaacaggccagccagagggaggaaggcatgagggagcacacactggtgggctaggcaggcttcccccaggggcaggcccggggctgcttccacaacactacattcaagggctcagggcaagggagaggctctctgagccacgtgtggcttgggcatcaactccctcacctttcggggatggaagacttcagagaccactgtcaacccttctctgaatccagggctatggtgatccaggccagctctgtaagagacatccggtgcccgacactcaccgtctggcttgctgccgctggcggccggcctccagttcctgcagctcaggtagggcatccctcagggggtgcaggtcgcctaccaccaccatggccttgcgctttcgttcctccctgagcttctgctctgccagctttatggcttcaatttctgaggggagagacggaagtatatggcaattcaaccccattccccggccccctcaggggccaccaatgccaaggcacccactaagctgtgtgtaccctgaggtctgctcgctcccacagagcacacgtgttctttgttaccctgctgtcacctgctttgtgcccctaaagagttggggggcgggccagctctgagttattttttctccttaatcacagaggcacactttaattacagggctgactatgagcttagagctgcagaagagagaggcctgacacctctataaggggtgcagtatggggcctgggcacacagacacatagggacagtgggtagatgcaggccctgggcttcactggtaacttactgagaagccacggtgtcctttatcctgggcaaaatagaaccgtgcagcacctccctgagacatcgatagggggagagtggtcccatagggtagaactatcagccattggggacggcagggagcagggtgggtggccaggtcgcatgcacagcatgaatgtaagagaaagttcactgtggggcacagtcttggaatttaatgttcttcaaaaggtggattcaattccaaactgctaatgtaacaagtacttaaccttgctgtctgcctgaatgtggctgtggggtgtatgcagttctgggagaaaaccccactctctctgggtacacagccacagaaggacctttattcagatacttcaaacatggggtgaccatagcagagggggtgaggtaaccagcagcttccccctcagcaagacacagccaactctgccaccctctacatcagggaagatgcctcacaggacaggtcagagaggccaccctgaccatcccaggcagggccaatacgtcagggttcatcacttcacactgaggcagagtcagccctccaaggcctctgcccagtgcagcctagcagactgtgatttataaggtgacaatttggtgggggttttcagtctaggtgaaacagagcaaacaattcacttagcgcctcatcaagaccagccgcagagcggagaggggcaaacttccctggcagaaagaagggctgaggggccgccccctcacacatacaggctgacagacccaaagaaaggacagcgaggctgagggagacatgcagcccaaactcacacaagcaaatccaaatcaaagatgcccaaacagggtgatccagggcgtgcaaggatagtttgggatctggaagctgttgtaacccaccatgactgggggtagcactggctaaaaggggaaaacttggtcactagatgtgccagaagagatgtggtaaaactcactatctacccatgataaagttacagtgaaaccataaacagatccaagataataaatagctcatttctactgagttcaacaagatagcactgaccgcatcctggcactccggtctggcagctcactgctaccagggaggcaaagacagcaagcagaagccagcaggggagtggacagggtcaagagatgtgcccagccccaatccctaacccacaatgcaacacaacttttaaccaagctgagaaatctaaatcctttcttaagcaaacaaaccagacaaaaccaaaaaccctcaaatattatagacaggaggataacaattcaaggtcatccagacagtccaggatcctgaagaccctgcctcaaaaccataaagatctcaatgtgaacaaaacattatttcaacagaatgagcaagagagcaagtctactaatactcgaacaacggagagagcctggggcagagtaccagacagagacgagaggtggccgcacttgtggttgcccctcactccctgctctggaagatgaactacttgagttagacactctaaataagtagagaaccacaaaaagccaaaacagtaaagccacacgacaccactggaatccaggaaaagaaaaccacagccgtgaaatgcaacttctaagttgcctccatcagtcgggtacatcaagcgtcagaaagcactttacgggagctgagctataggtgctgtagagcgaagtcctggaggacacctggtccacgcaaactctcaagggccttcatgctcagaacaccatgttccagggacggggagcacttcgctccagggacggggagcactttccgaggaatctgacactggggaggcaaagtggagcaagatggagaggggtcagggaaaggtatagcttgggacagttcctcacagtgacaacagggagagtgtggcaaacgatcaacagccacggaagagacacactgctgatggtactagagaatccagtatggctaccagacttgagatatatcctgggccagatcacaagacataggctgttactaaaaaaataagaaaatgacaattactggtacttttaaaaacttttagaagcaaatttgtccaaaacacaaaataccaacatacacacacacacacacacacacacacacacacacacatatatacacacacagagagagagagagagggagagagagagagagagagagagagaaattaagataacagttatttaaaaaacctgaccaatgatgagaggcccttgacgtgattcagtgtcggcagcccaccctcctgaagctgggctacggactcggtgccgccacaaccctaatccctctcaccctctcagcttctgttgtcgtctttaaggagaacgacatcagtgaaatcggatgatgtgctgagaaccaagaaagcccagagcgagctgggacgaaggagcagaggaggccttctgtgcctgtcccttgctgacaccagagcacaggcatggatggagggaagccatgtggctttcaaaaggacactccaaagaggaaaactatctgcaccagactgtggcaggaccacctcccaactcacagcagacaggatggaccacagcctaaggacaagccaggctgtgacactttcagaaggaaacagaaaaacatcttcatgacttgggattctgtgtgctctgtctgtctgtctgtctgtctgcctgagaccgcgtctattcgagccctggctgtcttggaactcactatgtacatagaccaggctgcctcggactcagagatcaacctaagcaccatcttcttaagacaagacacactgcaatcatatggggaaaatacgggtaagattgttaatcattaaactcccgtcgcttaaaaaaagaaagttaagaaaacgaataggcaagacagtctgcaaggaatacagcacacacagctgagcagggccagcaagtccccagcacacacacagagtccccaagctcagtaataaaaacgcagagcacctggagaagaatgaccctcactgaggatgagatgcagatgctctttcacagatcacggaccagcagcccgtgagagacagcagcccacgtcaccagatacacgactgaggacgtaccatcaccgtatgcacggctgcggggccaccacgactctcctgatgcagaagggggacacgtgaacctcggcttcagaagaatgcctggcagtgcttacaaaactaaacatacacctgccctatgacccaggattccattcctaagtatttacgtaagaggaataaaaaacatgtctgcagagacactagagcaaatgctggccagccttactgagcacagacaagatggaagggcagacatccatcaacaggagacagggcagcaaggatgaccgtgaacaaacatcgtggcgcctctcagccatggcactgctgctgctgctgtgtgcagggcagcctggcagggaggcactctcaggagacaaagtaccaatgcaaccacaggcccatcagacatggtaccttcgccataggcaggtgggtggcacaagcagctatcagaagtcactgctgatgccaggtaaacatcctcttcacaagagaacagagggggggctggagagatggctcagcggttaagagcactgactgttcttccggaggtcctgagttcaaatcccagcaaccacatggtggctcacaaacatctgtaatgagatctgatgccctcttctggtgtgtctgaagacagcgacagtgtacttacatataataaataaataaatcttaaaaagagagagagagagagagagagagaacagaggggatcacagacaagctcagcactagccagcctatctgccagcaggcatacgaatgcccgcaacttgcctcaaaatgcactaagaaagtgctgatgggtgggcaggaatgaaccaaggaatggctgtgacagaggagtcaacttagctcaagacacagctaacgttgtactcagaggctaacatggacacagtctaactacttaaccaaatctaaaagaaagccaggccaggtgggaatcggtggaagttaataatgcagaggagaagcaggcagaactagtgattagcatcctgggtttgtgcactaaatcaatgaagcttcttaagaaatctaatcagaaatggtggaacacagaaatgaccacatgctcagcagataacagtccttcccaaggactaggggtcagttctcagcacccacatggtggctcataaccggttataactccagtttcaggagatctgatgacttcctttgacctctgcaggcatgtgggccactcatacacacacacaaaagggatagaaatgagaaagcggggctggaaatgtaactcagttgtagagcgattgtctagcatacgaaaagaccctaggttcaatccccagtatcagaggcaggtgggggtgggggacaaaggcagggaagagacaacacacagccttttgctgataaagtctgagagctgatgaaatcaaactattttagaagaaaccttgaggcataaaaatcaactcacatcatccaccaggaacaaaaacttccacaccaaagcagcacacctcagatgcggccagggccacgccaaagcagcacacctcagatggggccagggccacaccaaagcctcagcacagagagcacaattccttttgctgggaattgtggaaaggtgaccagagcagccagccaacttcttaaaaaaaaaaaatccaaaacgcaacaaaatgtaaaactagtaattttgaggaaattgaccaatttctagaaatactgcttccaaaacacccctttatttaaagttttcaagaaaaaaatttcaagagaaattaccttattttcaagaaaaaaaaaaaaaggtaaaccacatttaaacatgtaagaacatatagatgaaactattccaaattaactcccagagttgggcctggagagatggcttagtggttaagagcactgactgctcttccaaaggtcctgagttcaaataccagcaaccttgtggtggctcacaaccatccataatgatatctgatgccctctcctggtgtgtttaaagacagctacagagtacttacataaaaataataaataaatatttaaacaaaaaaaacaaaactcccagagttggcagaaacacactaaaaagaaagataacggctaagagaaaaactacaaagcaatctttgtgattttcaagtaaacacagaaaatgcttggggacgtcgcacataatcagctttgtggaaaatgactgcctactccaggaagggagcgagggagagctgctccatctgctccaaacgctcggctggagaccgagaccagactcgaccccagccacccagggcgggcgggcgggcgagctgcattgctcctgccatgccacagctgcaggacagaggcccaaagatcaggagctcaaggtcagtcaggcttggctacccacagagctaggctggcctggaccatatgaactctatcatcaagtgacagttgccaagctcacacagacctgggaagaacagcagacaggcctcacctgtgcacgaggctctgaccccacaaatgtacaggttatccctgcagttaaagctttcatcacgaagccccagtcagaccacttttaccccaagggacagagaactttcaggatggctctgtacggaggaggaagcaagggggttgcaggaggctcacactggtctacacccactcagggacagatcgcctcatgctgccctgctgctgccgactccctcaagcagccactgatgctgcttctaacacttcctagtgagcgcctcctggatccatcccatcagggtctgagaggacaagcacatgagcaatctccacggggtgcaagtccatccaggcggcacaggcatcggaatgagacgggcagatgcagctaactcacaagataaggatgtgacttactctgtaaccatcgctcacggcgaagcttcagcttttccttcttaggcaaaatggcctttggctctgcacctgaggagagagcacaggagtaatgaggtcagtgtctgtgcggcccggggtctccccatccctgcagaggctaaggtcgatgacaagcctgtgagtccccaggtaacgaacggcctcaggctcatgcagcagtgggtccctgtgctggtcccagtgtatttggggaatgtgaggataccacagcgctactaacaccaggtcttgggcatgacaaacggtcaccttccatggcagcattagaaccaaagcatgaaaacaaagtgcctgtgactcctcctgtcctcaagatagctcccatccctgcaacgaagcctacagccccgcatctccaatcttctggtggtagcttcccctgcctggttctgtcttctcttccttgtgctccttggcctcaaataacctgctatggtgttctgattggcacatccctactgtaatggcaggcagccaggcacggaagctcacgcctttataatcctagcactctgaagctgagggaggagaacagccttaagttagaggccagcctgggctacacagtgagtttcaaaaggaaaagtaatatgactatctttggggctggtgagatggctcagtgggttagagcacccgactgctcttccgaaggtccagagttcaaatcccagcaaccatatggtggctcacaaccacccgtaacgagatctgatgccctcttctggtgtgtctgaagacagctatggtgtacttacatgtaataaataaataaatctttaaaaaaaaatatgactatctttggagacagggttgagttctggttgctgacttggcataatgggtatgttggctgataagggacattcttaattaggttgaggtcggaagacccaccctgaatatgggcagcaccgttgcaggagctaagctctggacgggagggatgcagagggcaagctcagcactaggatgctgatgttactccatcgctctctgctctgacggtggaaattatctgaccaactgcttcaagttcctgtggcctctatgtccctgaactgaagggactgtaacctgtggcctctatgtccctgaactgatgggactgtaacctggaactgtgagtcaaacaaaccccttctcccttacgttgcttttctcccttacgttgcttttctcccttacgttgcttttctcccttacgttgcttggccaggttgttttagcacagacacaggtcttggggccgaagaggtggctcagtggttaagagcacttgttctcacacagaacccgggtttagttcccagctactgcacagcagttcacaaccatatataacttgttttaggggaaccgagaccttcctctgacttccatgggcgctgcacacacagggtgcacttacatacttgcagacaaaatactaatataaatagaatgaaaatggaaaaatcaaaattttgaaggcatgggtccctatacaaaggtggtctaaatacagggaggtcccctttacagatgaaatgagaccatcaaggtggccctgactgacttttccttagatgaagaccaggagacaggtgtattcaaagggaagggggggggaaccatgtgctggccaaggaggaccaggacatccattccctctctgtcacaactgtgacaccgttcttcaaaaccacggcaacaatacacactgaagccactgggtctgtagtactgccatgtgagtcaagtccaccttcttagacaccggccaaggagaggccttgtatagactgccagactctgctggtcaccaccgcaggcagagggcttctcagcgtgcacaagtgagtgtgcacttgtctggggacattgaagaacacaagtggagatatatctgcaccaggagccagaggacacggtcccacttttcaaaggagaaaaccaaggctgaccactgcatactctgtggtaacatcagttggacctgtcccactgaccagaagttgactgactggggcatagacaactgggctatgtgagcagaaaggatagacagcactgatgggctggctctgaggggcctggacaatgctagctgggcttcctctctctaaggatggtctcagcccagtgtaaggcagctggaaccagctagggacactgcccagccagagcatcagccctgcccatgatgaataagaaggactaagtgtggaactgagaactgtgaggcagaaggaggagctcctactagttactgggcctcgggcacctgggttgtagcattttggtgggatggagggtggggatcgggtcactggaatctttccctgctgctactctgtcccagaacaacacaaggaaggcccatgcccttggccttaactgcctttcccagacctgacatggttttagccacagagaagagagaacatggttttagttcctaagaacatgtgtaggaaacacagtctcctgccatctcgtacatgtagacgttcctggattgtatgatggagaacctgcgtgtctaaggataaacgtggcagaagcaagtcctgtcaggagaagctggagaacctggtaagctacttcagcctctgttgagaggacggggacaaagcctgggctgttggtgactcagtttctccccacaactagggtcaaggtgctggggtctggtgcccatgcttccagcctaactctacctgttcattttccctagaagaaaggccgaggctgtgcgccttgggctgggctaagagggcccaggctcggtagctactcctccagctggcctgacagatggagcacccgatgcacttcactgcactccagtgcaccagacctaggcaggtgtcacatgactagaagcaaagtcaaaccacaagtgaggtgacaacaggcctaaatgtgggatgccaggctggggtgggacttggggttttctgaggtgtatggaaacttgtaaggaaaatgggcctggcacagccaagataccaccaacgggggtgggagctcacacagaagtgcccagtgggaagacatcccaggggacaggaagtaattctctctagatgattctttcaacttttggtaattgtgcaattactccaaagtaaaaataacaccgaggtcagtggagactggccctagcaatcacatgcctagcaccgcacacaaggaaggatgttggagcgggctactgagaacgctagctagaatgtgacctttttagccctccgtcgctccggagaaacagaaccgaacaggctgttcttgcagatgcaaagggtttggaatgctgaggtcatgcagaagctgaggcctgacacagccctaggatcctgctgcacttggcactgatggtcacgctcgcttcactggactctgcacaggctgacggttactccctgtgggcagaagacaggcccagaaacaggcagcaaccagacagacatgggtagcctccatgatgaggacagggatgtctgtgacgtcagcaggcctgtgctggctagaaaacatacacagaatgagctgtggctgctgcccaaacagagggggcttcacaggagccactgtgacagaacagcagctcagtcccagctgagctggggacaacagagcttggaggcctcttcctggctaccagctgtcatggcatcagctgcagcccttatcccgtgaaggaaggagacagagcccagcaagcatttctgagacttgacagtaccaactgctgtacaggggcagggcttctcagccccagcttccttaccagagacctggaacttggaacaggtaccaggaactggcccagggcaggccaggcccaaatgtgtaacactgactcccatctacagcttactcttaaggatgagcaaaatgtttaaaataaaatttgcaacaaagtgagacctaaaccaaccaccatggaccaggctgaaagcaagactactggacagacaggaagggtgagaacagcagtgacctcagtcctgcatcaggatttcccagtgccagagagagatggagatgtaaccagcagccctcccaggatgctcaatagtcacagcgcggagggagaggggcaagcattctgtgttggtcagctttctagtactgtgacaaaatagctcagataagcagcactggaaaagccgtgtgcacccgggtgagagaatgggtttcagaataaaaggcagtgggctggagagcttgggcagtattagtgctcaagcctgacagtgtttgaaccctgcaccagcagacagcaacagtcaactctctcacactgctgtgtgacctcgaaacacatgaggcttgctcttgtgcacatacacatatatgcactacacacacagactagtaataagacatgcagttaaactgtaaaaaggaggaagggctaggtatctgtgagggattgtctaatgaggctaaatgaggtgggaggaattaccctaaatacaggcagagccttccacccatggcctggagccctggactgcagaaaaggagagagtgagttgaacacagtatccattgctctctgcctcctgactgtggacaggggcagtggctcaggaaggcatctgggtaccaacgggccaggaaaaccgtacaatgtccctggggttgccaagaccctccccccccccaaaaaatggcacctccttgaagctacctatcgtcaggtgaggtggcctgggatacagcacagagacaattctctgagtacccaaaggctgaaggaccaggtgggtcctgaaatcaaatgggcatgcggctctgaacaatggagcatgcagtaggccccacgtgatgtcacacacaggacccacactagaccaggcttagcaggtcaccaaggcagggtcaggtgtccctgctgatgcttatcccttttcatacaactccaagtagaggcagggccctaatggtcaagcctctgctacagggctggctttgtacttacagagctaaggccaggcctctagcaggacacggagaaggagccgtatccaagtatcctcaagactcagcatgccaggaccccaagagccctatacaccaggtccaatctcctggggcctagagataatagtcccacaagagttctgggccggaccaccagcacagaagggcaattcctgctgggtagaggtgggcactcaacatggtccactcactgcagagcacaggaggcacacaggcagtgtggttggctggtgagcccacacacatattctactacatgttctgctactgcgtgtttaaactgtttatatggccttaaaacaggcagctttagcctgatgaaagtgtggcccgttctgctatttggaacatgtccctgtcccaattacagatgcagccttgtttccttactaacttaggccagctgttaagctcaagctctggaaagagaatctgataggtcatggcaccttatatactaaagctgcaggaaggacagaaccaggccccggctggctcccggctggcacatacaatcacttccgcatcacactccacaactaggtaactgaggacccaaggaatgtcactggaagggacacacagaaagagttactggaccgtgtttgtcaacatggtgtttggcatctctacaagatttgtccaccagtatgtcagcctagcaccccacagctcagcagccagcacacacacaacacggcagccaaggtcaactcatgctgtgacttgctcctagagcttgttcccgtgactccctgctctgtgcaaaggctaagcctgggagtggaatagagacggtgatgcacatcctactggctgccatagctctgacttcacagcagtcttctaaacaattcctaaagaaactcctcctctgagggttccacacacagaaggaagtcgcttgctgaggtcccctgccccaggacctaggaaggaaatgaggttctgctgccctctgctggccagagtcacagaggcctgctgctcataggagggggagcctgaaaacgcacattcacactctgctaagcacaggggaggtcagggtctgaaaagatacaaccaaccaatggggcaggagcctgtcatgatgcctgaggagaccatggagtgcactctgggtttcctggggccacctcaccctgcctagggctcttaatgacctctttcccccacgcctcccagtggcctttgccccatgatcgagagcgactggtggggtggtttccgtgcttctcacagcctcccccacctggctctgctctcctcctctgcaggacttgcctcagcctgcccacggctcggagctagagtccagatgataatctggaaaacggattggtttgttttctgcggtcttctagtgtgcgggcacagagaactggaaataaaatctaaatgtgtgcttgcagactttcttctctgaacagcacacggtcacgttctagcttcgtgcccaaggtcagcaaaggcggccccagacagcatactgtgaccatctgccaggcagcagcacgaccaggctcactgtaccagctcaagccttctgcacaccaggtaacacaccacgtgcaggatgggggtgggagaaagactgcttcatgctgtctgccacaactccttccacaccggccaaatgagcaggcaggggaaccacaggccacttcacgggaggattgcacaggcaagaccctctatcccataggacaaagctgagtttattggccggggacagggtatctccagaccagcctcactccttttcccagggcaagaggtgaggacacataagtcagaagccccacagcacagctgcagagcccagcacctcccaggcagagatcttgtctgccacaggaagataagctcagggaagcaggaagggggctggtccccaaggtaccaacagaaagatgagagctgccaccagcaaagcactcacagggacactggccatgccacctcctggggctacaagcctgtacatggtatggcagcccgtgtgtacataagacggtcatggcgatgtctagtctcttcaggaccattcattgcacttagagctacctcagttcctgggctaagtgtcgagttgtttctgagacaggggcaagaggcactgcagtgacccatacataaagcacccacaggcagtgcgtgcgcccctgaaaccagcaggtcactgagatgactatggagctgtgtacgaagtcctcagtaaatgtgtattgtccacatggtgggcatcggggaccccaaggcctcagacccacagaaacagcaaaggcttctggtccaagtacagtgcttaccactgatcagtgagtacagaaaccaccaactacaccttcagccttgcagatgactgcagcgtgagactgctgccctacagagagcccttggtctggctatttggtgcttgacacaagctagactcatcagaggagcctccaatgagaatatgcttccataagacaaggctgtaggcaatgctgtacaggactttcttaaacagtgatcaatgtgggagggcccagcccactgtgggtggtgccatccctgggcaggtggtcctaagatctataagaaagcaggctgagcaaaccatgggtaggtcatggtgtttcgtcacatcagtagaaaccctacgacaccctgagttcccagactgcctacgtgtcctccatcagagagaacacagcctgccagaggctttcttgtccgtgtgtctgtcctttcttctgcattgccccggtcaggtttgagcaccaagtcatgcccgatgcagcgagagactgaatcaaggactcagctccctttgtgaccactctgacacaagtcaggtgtccctccacctgcctggctcagagactaagctgaccacgaacagaagtagccagtaccaagaacacagaaggtaccaggcagccagaagaatcatgcggagaggggtctgagagagtggtctgagatgcggacccggaaccctgggagacgaaggctttgaccgtctcagccaagtcagagtatgataaaggactcgggttttccaaccgcaagtccctccctacacatggggctctccccaaaggatcttgcaggcattgttacgtccaacaagcagctgatcttttatgctagtgggcagaagaagaggcaggtctatcctacttcgtcaggacattctgtgaggtctaacagtcacctatgtctagcttaaagttaactgaggacagatatgtgggactcaaggttagaataacaactggagagacagccagtcagagggccaccaagaagttgagggctgattaggggataggtgatacatacaccaggaagagtccctggatgtctcaagaccacccctaagggactaaagttggctgtagactggacgagtcctacatcaggatcacctttctcctgcgacaccctgtgcccaaacacatgaggtatcacgggcatggagaaccagggctacgctctggccagagctatacatggtccaagccaaggagccattcccatgtcccccaaacccatctctgccacacactaagactgcagtccctaagaccctctcaaagacgcaggccgtgggaaatacatgccactaaggagatcaaaggccgctctataaaggttccctgaatcagatgtgatttgtcccttatttaaggttttatgcatatatatgggtatacaaatttttaaaacattttctgaaggattcaatcaggtacagttttcaagctctctctagataactgttacattaacccttttgaggaagcgttgctatcaagttggggcaggtcaaagggtgacaggtggctccaggatcatccaaacaaccgggcctgacagaggttctaacgggaaaaggacatgacagagttgagggaggcactgccatggtaaggccaagtccttcaggtccagttggcagtaagagggcccatagctgagatgaaacctaccaacatcttgctgtcccaaagaaggatatgcaaacccctctgcagatgtctggcctggtcatcttgctgagcccacctcacgaataaggagcaaggaaccagaatttgctgaatgcctggacctttctggataaggtaacctcagtctctatgaggtgagtctgtcaccattttatatacaccaagactgacagttaagaatgccaatggtgggctggagagatggcttagcagttaagagcactgactgctcttccagaggtgctgagttcaattcccagaaaccacatggtggctcacaaccatctgtaatggggtctgatgccctcttctggtgtgtctgaagacaatgacaatgtactcacacatataaaataaatcttaaaaaggaagaagaagaggaggaggaggaggaggaggaggaggcggtggcagcttcggaggtggcaatggtagtgctgggtgtggtagtacatacctttaatcccagcactcgggaagcagaagcaggcagatctctgtgagttcaagcccagcctggtctacaaagtgaattccagaacagtcaggactacataaagagaaccagtctcaaaaaaaaaaaaaaaaagaaagaaagaaagaaagagagagagagagagagagggagagagagagagagagagagaggggaagggagagagggagggagggagggagggagccactggtagccaggtgtgacagtgcatgcctttaaaaccagcacttgggaggcagaggcaggatagcctagtctacagagcaagttccaagacaggcaggtctacacagagaaaccctgacttgggaaaaaaaaaaaaaaaaaaaagaatgagtctggtcacaataccttcagcagcaattagaactgtcttgacggggcagggcgggaaggggggaaaaaaaactgtcttgactagatggcggccacaaggcctgcctgctttttgccgccttgacaacacaggcgcagcatcaatgttgcaggtaagttatctagtgtaagcacgctcagaatttatgaatggaatgccgggcagcctgatacctgcttcaaaaggactccttgtgtggtaccaagggtaggcactggcctgtggcactcctcagcgccagtctttctactttggtatactttacggttttgttctttttttatttttcctgtaaaagtaacatctcctttagtcttgctttgagacagggtctttccacacagccttgtttcttcctggaactagatgtgtagtccaggctggccttgaatgtagagactggcctgcctcagcctctcaagtgccgggatttaagctatgcaacacatgtcatgcctagtgtcatcttttaaagcacgggctagtccacaggcaacagtcaggctgccctctcgactctccaaaggcaggaactcacctctctttagggacaccacactcctctggtccagctccagcctctgcaccaacgcactagggtctatctgtgtcctggcaaagatgtcattgtgaacgaatgtccagtcctgcaatcccaacaggagaagagagaggacatcaagttgacttttggtttgagagtcacacatcgagaagatgctaaggcaaaaatcctctacttctcagccagggaggccccggaagagtatctacgtccttgttcccagatcaggcctgttccttcctgcccccatcagacttgggacaatcagagagtcttggggagtagagccacactagcacagggcctgagcacagcctccctgcaaacacatgcagatccaagagtagctgtgagataaggcatgactgctgcttacaactgtatgcatgggccctcccaggagtgagcagagggaatcctctaagtactggtccttgggcatctctgaggaacaaaaataggaacaccaaccacataaccttccagtgaggcaaagacgcggctgaccaaaggggcataaaaacaatctctgtcaacacaaggcttaaatttgagccaagttaccaaattaaaagaaaaatgggaaaaataagaatcaatggctgcacgaatcaatgactgcacagcacctcccgtgggtgtgggtgtgggagaaaacagaagctctcagtttggctacaacaacaaataaaagctgggcacagtgggctacagcctgggcacgagagtgacaagctgggggggggggctagggtgaaaccttgtctcaaaagaataaagaaagaatgagatgaggtaaaataaaaataaataagatcccaaaggccaaagcaacaagcaagcgccagggacacaagtgcatgccatgcctttaaccccagcatgtgggaggcaggggcaggtcaatctcttatgagttcgaggccagcctggtctacagcgtgagttccagaatagtcagggctacatagagagaccctgtctcaaacacacaccagagactgagacacagagatagacagaggcagacagacagcgccctgcgacatttccagagcgtagtgggatattttcccccagagatggaagcgcttctggagcctcacaccccaaccgagaaggcatgacggctaaaggtgggccgggtcaggaccctaaccagagtggcaggaacacacacagaagaggcgacacccaaccatccagggctcctgatctttggagatccggctcggcagagacctggcccgaccggcgccccacacctcaccttcgcccccgctccgcccgccggggattgtgggagcgccggctccacggcgcggggcacagggcccggtgcagaatccccgtcgggtctcacggccgcccggtgcacacgagcccgcagcgccctcactttccccatcttccctggaggtttccgcctgttagcaacgccgcctcactagtggaagagcctcccggaagtgctcccagacagccggaaatagagccgcggctgcgtagatcggcgttcggccggtccccggaagtgcctcccgtagcgcgtgcgcagttgcggtgcttacgtcgcgcgctcccgctagcgcgttagacgtgtggcgatgtggctgcagccaagagccagggaagtaaaactattgaagcctcgggtgcacgttacgccatgtttctatcgcgcgcgtctggggtagaatagggagaaaggttcacgtcggttttactcatgcgggtctctatgtgtgcagcttggcgtttcgtccttaaaacaggtcctggagttggggactttgcaattccacttaaatgggtaccagatggaccgaacggcctccgtcttcctgcacagtcggctccgtgtccaacagcccctgtgcacccagtgcagtattgcttaaggaaagcaaggacgaagggtaattccagctcttcacccaaatgacacctgtaaaatacaatacaaaaccaaagtgggctatagttggagccacaaaagaaagttgggcccaggcacagccagggtagaggccttctgccttcttcccttctagggtagagagcatcctggatgccgggacgtctctgctagggatcc

SEQ ID NO: 238 - DNA, 1146 bp, Mus musculus
tacttttaaaagtatagacttaattgtacttttttattatagtgtgttttgtttctgggaattaatgaatagttattagttttacacacagctgatggacctgggctctacctctaaaataggaataaaatctcagaaaggattacttttatttatgtctctgtgtgtatgtttatctgttgtgtgcaggaagagtgaagatcctcaaggaatccagatgtttcagattctctggagctggaactaaaataaaggtggtgagtcattcaagccatgccccagagtttattaatttaaagatgagtaaggaaaactcaagactggtaagatcatttcactatcggtctctgcaggtctctgtacaattccatcagggaacaagtgggtccagttattttgagaccctttaaagtctgccttttaaaacgattcccattctttaaacatccttatttttctctgtatgcatgtttcacctatatatatgtctgtgcaccaagtgtatcctggcgctcatggaaccaaagtcaagagtttgatctcgtgggagttagacagacaacctctctctcacctaaaacccttgtagaatgaatgttccaccacttcccgagtttgactgactctcctgatttgagcactttccttcacacgtttctctttgcaggctatttttgtttgttttacttacttctccattaaagactggctccattcaagtaaatattggatatccttctgggtcttgccatcaccccaggtgactttctagaaagtctttttccacattctgttttgctgacacccttgagcctgctgtacttgtgccatctttcatcactgactgctgcttcaggttctccactcctcttcaatttcatccttcgggcggactttgcactcgctgagcgggactccctaagccacaactttgggcgtccccatcattcctaagaagctctggttacgcggttgaaccacccactcaaattggctgcgggaagtgtctactagctctgtgcacggatcacgtgttttcggaggcgcacacccccaggctgaccccggaaggtgctttcacttttccatcctccgtctcccagcttcgtctgctgctgcagcgaggtccggacgcaggctccgccc

SEQ ID NO: 239 - DNA, 6877 bp, Mus musculus
atcttcaagaactgcttttggatcaagtattcgcttctccttgcttctttctcgcgttattcctcttgagttttgttacctttcggctggaaatggaccacttgccgctggtgtggcagtggttggagcatgaccatgttgatgatgagctgtcactggcccattccaagaggttttctggatagaaattccttttcagggagattagagggacggaaccttttgacgtattctttatgacaggagggtttcatgcctataatcccagcacttggaagacggagataaaagggtcgccgtgagtttgaggacagcctgcactacagagtgagttccagatctggccgtgggctagagtgagatcctgcttgaagaaggcggcgaacggggcgggtttagtgatggtggtggcagcagctgcgatggtagcggcggcggcggcggtggtgatgataggaatggaatccagagcacacaacacaaggactgtcgtttagctgttagttcccagtccaagaaattattttttaagatttattttttagccaggcgtggtggcacacgccttcaatcccagcacttgggaggcagaggcaggcggatttctgagctcgaggccagcctacaaagtgagttccaggacagccaggactacacaaagaaaccctgtctcgaaaaaccaaaaaaaaaaaaaattatttttaattatgtatatatgtgtatgagcatttgtgccagttggaaggccagaggcaatcccttagaactggagttactggcagttttgagctgcccaacatgggcaatttctctgcaagagtatgtgttcttaaccactgaaccatctcttcagcccgtaaatccaagaaagtcttagtgttggtatattttttcctttggagagtgggtgtgagtatagatgaagtaattggccatgagtgtggggtgctggttgggtgggaacttttaattgatggacatactaaccacttggagatcttgaaaagatgtggactctgattcagtaggtctgggtttggatgtaaaattctacatttgtaagcaattctcagttgatgatggtatctttggtcccaggaccacactcttgagtagcaaacattatgctgtactttttgtgtgttttgagacatggtctcattgtttagcctaaacttgtcttcagcttaaaatccctcagccttttgaagtctgggattacagagctatgatactacacccacccagtttcctgtacttcagaatacatctgaatttttctttttaatattttatttgtatttcatgtgcattcatgttttacctgcatgaatgtctgtgtgaaggtgtgggatcccttcaaactggagttacacacagttatgagctgccatgtgaatgctggaaattgatcccaggcccttgggaacagcagccagtgcattcaaccattcagccagccagccagccagcctccctccctccctccctccctccctcccttggctagttgaggcagggtcttgttatatagccttagcctcgaactcatgattctcctgtcctaaccacctaaattctgggatcacatgcatgtgttcccacactaaccttgacatttttcataactagaaatgtttacaccgagtaccgagtatggtaatgcccacttgtaaccccagcattgcagaggcgggggaaggatagttaccactattagctacataacaaggcccagtatcaaagaaaatggtgggagcttgatagagcttgctgtctaaaaccttatgcagctgaggcaggagaaccacaaattcaatgccacctgggctacctagcaaaaccctgcctcacaaacaaagcaaatgttttaatttaaaactttagcaacggtttaaaatgcaggctaataggtctatagaggcccaggaatggttaaagccaccaggtgctactcatgctaatagcttgcagaccactttttgaaaacagaaatacaacctttaaagctggacctcgagccgggcgtggtggcgcacgcctttaatcccagcactcggaggcagaggcaggcgggtttctgagttcgctgccagcctggcaatggctcagtggtaaaggcaagcataatgctcagctttggattcctagagcccacataagtcctgggtagcatgatggcgtgccggttatcttaaccttcgggaggcagaaccaatggctacctggaacaagccggctggttagactagccaaatttgtgagctctgggatcaagtgggagactttatgtcaatataccaggtgaagattaaggcacctgatctaatgcacaaacacacacgtgcacccatacgtgtaagccgagctacacagcacacaaatatgaaaaggaaacgaagctggacttggcctgctcctatgatctgagagcttgggaggctgatgtaaaattgccacagtttggaggctggttcatttcagaccactagtcagggctatggagaaggtcctgtctcaaaaaaaaaaaacaaaaaacaaaaaaaccaaaaaaaaccaaaaacaacaacaaaactccatagcctttatctgctctgaggttcttggcagttgccatggctggaaaatgtcgcatgttcagcctgtttgtttgttgatatcccttctatctgcagaaactacttccccagaacggaggtgtgtgaaatgtctttgtccccctaggaagtgtgggagtcaccactgagccttgtcaggccaggtaagttgggagacaaggctggggtttgaggcggtgtgagaggagtttcttatgctttgatggctactgtcgtactctttgaggcaccacatatgcttccctgtaggtgggaagctgagaccgatgaagtggtcctgcagcggtggcagaagcagatagattatggcaagtgcatacctgggtaccagagctttctgcagcaggtccccaggtgagtgcagttgtaggcagccacaaggatgccaaccaaatggctgtagctcattgtcaggtgctggaagataactggaaagtggatgcagatggactggttctcctgccgtctagtccccaatacgtttgagatttctctcaagtagaagcgtactttcccagaaggctttcaaggcttgccatgttccgccccctcccccccccccgcccgccccttctttttaatcatttaatgtgtgtgttgggtgagggcagatgtgcttgtggaagtcagagggatctttacttccaggacaggctcttctggggatcaaacttgctcatctggccctcctatcctacctagtggtttttaacctcctaaaccatcttgctgtcccccacattccttttcttattaattttctttgttactgtacaaaggaatggtttcattgggatgacttcattatatgaaagtatttcactattatttgttcatttaactttttaaagcttttattgtgcgtttatgttttccctgcatgtatgtctatacaccacatgaatgctgtggaggccagaagaggatatcagattccctgggactggaactgcagaaagttgtgagctatcatgtgggtgctgggaatcaaatccaggtcctctgagctgtctcagcccccctcttctattttccatatgttccaatattctcttattctctcctctctgctcccttcagacctcttacctcatgtctctctctctctctctctctctctctctctctctctctctctctctctctctctcccccctctctctctctctctcacacacaaacaaacaaaatgtatcaaaagttggatatcatctttactcaagggccagtgtaagtttctgtatcattacaattcccctcaaagtgagcattacaagtgaacattattccccaccctttccctccctctccctccgtgtctctcagacagtctcatgtagcctcagctggcctcaatctctctatgtagttaagaatgacattgaacttgcctccacctctgagggctaacatttcaggatgtgccaccaggcctggcttcactgaattcgctggattggagcatcatcctgtccttgggtaatcctgtctaggcttctgatttactgtgataagcaatgagcagtgtccctttcctttgacttcaatctgacccatatttgtcattgtcagggcacagcgacagccgggttttcaccctcaaacaccaaacaaaaacaggagatacagtcgcagatcctgagatgcccaaatcaggcaatggagaagagccctgcatacctgggaccccccaagccagcctctccatgacagacaggctgaggggtgtgttcactaatctggctcctatgagtggtgtggtttaagtcctactttgtccactgcaaagatttgggttgtataattgtgggggggggcggtatctgcatgagtgtatgttctctcattctgctgcccctctaggaaagcaacaaagaacttcctaaggacattgggttctactcctttagatgatctcctggtagctggccccagggctcagaatcctcagagaattgggacagaggtgagaaagaggcccaggtagtatcctctgctgaaaccactggctcaggaaaatagatggggtttgacctgtgagagcataaataaggtatagtccaaaggagacggggctagagctatacggcctccatgggtctgatctctcttcaccagagatgaaggaattgggcatggtggtgcaaaatcctgtgggctctgggaaggtgaaagtaagaggaacaggagttttatttatgttaagtaacataaataaagctgatttttataaaacattaaagcaagagtttattactgacattaacagtgggatcaggagtttaaagccaacaacatcagctccatgagatccacttgccaaacaaacacaagacctgcaaacaacaaacaaacaaacaaaaaagcaaagcaaaaacctccttgaaaatcaagagaggcataatatgggtagtgttatactatacagcaggccatctgagatggcacacacatgaagatcatactcacaggaaacagtgcagccttccaaatgagtcctcacacatgacttgcagtggttttctttggcagtagtgagctctatcagttccttgcccttgttttcatctccctccttcccttccttccttcctccatcttgctctacttttcttttttccttttttattttttattttattatttcttttggtggtggcagtaaaagatagcactttactctgtagcccaggctggcctagaatgcagtgtagcctagggtagccctgagttcatggcaaccctccttcagagtctcaagtgttgaacccttgattcaaagtgtgattataactttgaaccaaaaagcctgactccgttcctctcaacgttttgcaaataagccagtgcccacttaactttcacacaaccatttaactttagtaagcatggttagtaataaaaatggagcaaggtagtccatgcccataatctcagcactggggaggcagagccaggagctcagtgaacaggaggctagtctggtctatagagtaagtttctggacagccagggttcatgtgagaacctgactcaaaacaaagcgaaacaaaaacccaaaccaaggggttaagagtctccaattttgctataacttgaacagtcatttagcctttcagggggtttgttgacagtttccgtttggtgattgaaaggaaaacagcaatatgtttacttaaagtatatagtgtaactagacatgggcaattcatggctgtaatcccagcatgtagggagctgacgcaggaagaacagagtttaaggacatctctagctacatagtaggattgagcccagccagagctgtaggagaccctgtctcaaaaataaccaagcaaagtatgcagcacagtgcagttgtaggaaaccatgtctcctttactctttgtcaaaggaaaacacgcaactcaaaataagtctccacacagacacctttaattttgttttaggttctgctgtgtaatgcttgagtggcctctgcagttgaaatgctgactggctgacctggagggcagaggcagtcttcttgactttgcctccaaagtaccagaattttaaacgtgtactactggcccggacttcccacctcaactttgttttttttttttttttttttttcttttttcgagacagggtttctctgtgtagccctggctgtcctggaactcactttgtagaccaggctggcctcgaactcagaaatccgcctgcctctgcctcccaagtgctggaattaaaggcgtgcgccaccacgcccggcttccacctcaactttgtaatacattttttaattcttctttttcagtttgcatacttgaagcttcctgcttcctccccggcccagctcaaagatgaagttctctatcactaagtctacctgtttccctatcccagatgagggggcttcaaaacacttagagtaaacccttgacttttagggatttgctgctacaactgtaataatgaaatgactggaattaccactttctatccgactaaagaaaggaatctgaaactctgccctacagtgatctgagcatgagagcatttattgaaaaaaatttttcccatctgagacctccaatttacagaagagccagaagcctctatgggctttcttccctactgacatcaacacccagcctattgaaaaaaaacttaaaactttggttgaggtgggaggtggtgataatggtacagacttaataaaaatgtggtttccagttcctgaagaggaaatacagtactgttgaaatcgg

SEQ ID NO: 240 - DNA, 1080 bp, Mus musculus
gggatttccttggttggtttccatagcttgatagaccaaaaacaaaaacacggccacaagggcaaacagcaacatttttatccacatgggaacggagcgtctcttctttgtcttttctgacttgacatctgccaagggagcatacttcgggacgtacttagatgagaacgactcttccatcctgaagtcactgagctcgagcggccggcctgcagcacctttgattggtctgcggcagctagcactgttcaaagtgaaacagaattccagatgattcaagtcaacaaccaaaccttagtgtgatttctaagcacactgcaaaatgcagcagcagaaaatcgtcagataaaagcaggggattgacgtatcacatgcttttctttgtttgttttgttttttgagacagggtttctgtgtacccttggctgtcctggaactcactctgtagaccaggctggcctcaaactcaaagatccccctgcctctgcctcccaagtgctgggattaaaggcacgagccaccactgcccagctattacatgctttttagtattttcttttgttttatggtgaagatgggaggtaagccagggccttgcatctttttatggatctatagtgggcattcttattacagagctccaactccatttctatcttaaaacttagtttcagactggagcgaaggctgtttaaagacgagcacccacagctgtctctccatctactgttaaccaccagaaatggtgatgcccaccttcaattatagcacttgggaaacaggtgagcaaatctcagtctgaggctagcctggtctacagagccaattccagaagagccagggctgttatagagcaaccatgtttcgaatactccaaaaagttagctgtatcatattataaaatagtatttaggataaatactctctaagcctgtcttggaggctgagtagtgtactgtgtgcctgtaatcgcagcacttgggaagtgtgtcatgagtctaacatctgccttgcatatagggtaaatccaagatcagcctggtgacttgagaacttgtctcaaaaaagaaaataaaactt

SEQ ID NO: 241 - DNA, 9606 bp, Mus musculus
aggaagaattgtcttcaggctttgttgtttcctggtgttgaaaatgagaacttgactaactcatagtgagccaagaccagttcagagctccatatatatgggctcagagatggctccacagtgcagagtgctcactgaatttcctgaggatccacattctgtttgaagcactcatatcaagtggctcccactcacctgcaactccagcgccaaaggatttgtcttcctctgctggcatcagagggtgcctggagttatgtgcctgtgaccccacgcgcatgcgcaagcacacaactaggacaataggaaagatggctcagtggttaaaaacatgtattgttcatgcagaggacctggatttggttcttagacgcatgtaaaagcttacagttgccaataattgcagaccatacacacaatgtgcatacgtgcgtgcaagcaacacacttatacacataaaacagatttttttttaaagactttgtgtatgaatgttttgcctgcatgtatatatgtgtacacatgcccacagaagtaagaagaaggtgttggctctcctagaacagagttacagatgatggaacccaccatgttggtctaggaattgaactctggtcctcttcaagagcaaccaatgctcttaaccactgaactatctttcgagcccctgaaacaaaccttaaaacaaaaagaaaaagaaaaaagctttgcaggtataacctgaaaaacataaaggcctcttggaagcattgagacggtctgccagctaggacagatggcacaggcctataatctcatctacttgggaagctaaagcaggaggattgcctcaagttcaagactaggctggcctgtatagcaagatcctatctcacaaacaaacaaaccactcttcctagcaaggcctagggacagtggcttatactctcaactacttggaatgctaaagtgggaggatcactagttcaaagccttcctgggctacagagtgacttaaagggcaatctacgctaacttaatgagatcctgtctcaaaagtaaaaaggcttgggactgtagttcagtggtaaagtgttgagcaagcttagccctttgttcatgtcttagttaggtcttctattgctttgatgaaacactatgaccaaaaccaagttggtggggaaaaggtttatttatttggattacagttccatatgataatccatcattgaaggaagtcagggcaggaactcaaacaggacaggaacctgaaggcaggagctgaagtggaagccatggtgggcgctgcttactggcttgctcagcctgctttcttatagaacccatgaccaccagcccaggggtggcaccatacacaatgggctaggccctcccctatcagtcactcattaagaaaatgccttaaagctatagcttgtgggggcattgttttcaattaatagagaattaatattccctattttcagataactttaacttgtgtcaagttagccgaaaactagatagcacagtgcaatttccagtaatgtaaaaagaaagaaaaaaaaggacaatgactttttacatcggggttagttgtggcttagtggtaagaatagacgctcagcatgcacagagctcggcagcaaaaaaaagaaaagaaaaagaatagggtgggtacaagggctgtatgggaatgtagcttggtaaaaggtaatttgctaacatttatgagaccctaggtttgaatcagagcccattatattgagggagagaatatgagactatgcaggagaatacacctaacaacagatagagatatttcactacaaggagactgttttgtaggatctgttttctatacagactgctcatgaggatcctagcacagaccatttagtgaaaagcctaacaccaaggctagcattgtgataaatacttgtaatctcagcgttccggaagcagaagcaggagaatcacaagtttgagactagcctggactacatagcatgttaaaggccaacctttgatatgtagaaagactatgactcaaaaaaacaacaaaaaaaataggggacttaaagagttggcttagcagggctggagagatgggtcaacaattaaaagtaccggctgctcttctgaaggacccgggttcaatacctggggttcagttcccaatacccacatggcagctcacaactgtctgtaattccagttccaggggatctgatgccctcacagtcttacatgcaggcagaataccaatgcacataaataaattataaaaccattaaacaacaacaaaaggagttggcttagtggttaagagtacatgttgttcttacagaggacatgggtttgatgcctagcacccagatggcagctcacaaccatctgtaactcttaattctggggggtctgataccttcttctgacctctatgtggaaacatgcatacacataagataataataaaatgaaaaggaggtaatgtcaggagcgcagacctgctcatgggagaaccatcatggaccagtcttggaggagggtctgccaacttagctattcattgctgcagcccgtgtatctctcctctgccctttccagtgggatgccttcagcatgcctgaactgcacaatttcctacgaatcctgcagcgggaagaagaggaacaccttcgccagatcctgcagaagtattctcgttgtcgccagaagatccaggaggctctgcacgcctgtcctttggggtgaccttgggtctccatggatgacaggaggagaacaggcagtgcaaagagcgtgccgtgtgagtgtgacagggcctgtggggcctgaggagtgcgtgtgcatggaggtcctcctctgctgaccgggatgagcccagagaacagggaaagagccagccgtctacctgtggatatagtggggcggggctttgcatccctctgcccgtatgtactgggtcatactctgcgtagctgctcaagtcacagggtcgcagctgtgagaatcttagagactctacagacaaaacaaggttatattttcacgggtaagagaccttacctatggagaaagattgttttgagtcatgaatgggtctcaggatagccctatcagagccaagggtagctgctcagaataatacaagcaattaaggtagagtctggggttccctcttaccgtgccttctgacttccaaacaaacaccctggggtcagagagggctggccagtacaacaactacagtggctcagtcagtgcctcctctaagggaaaggttgctggaccagaccctcttcttgtttgccaaagccagagtctccctcagatatttttgatggaagtgtatgaatgtatgtaatgttttgtggcctcaactgaatgtggggaagggatgggggtgtgacagtcatcatcagggcctgatgcctgagagaattggctgaataaagatgtaagaatttttctggttttggactctatagatgtgggcccccagtcggggtaacacctaatgaaagactgccaacaaagattgacacatccagagtgcaccctctccaaggtcgcagtgggaccaatatgttcaggaaatgtatgcctgtggattcaggtgtctttcaaccctccagggctcaggtcatgaagagacaagaataagctacagttactacacaggaaacttttttctccaggccaactcagagaaaccatagcagtaaccccttctccaaaaaactactcgtgggtcccacacttcacatgctaccaggggaaagctggtaataattattttcctgaagaatgttctctggtgaacttacaacacttagtttaggttccttcagacctcaaatatactcttaagaaattgatcaaaaaagttttaaaaagaagtttggctccctgtgcggttggtcactcctttaatcccagtattcgggagacaggcatttgagcgtcagccatttatacatggcaagtgccaggccagctaaggctacatagtgagaccctgtctccaaaagaaaaaagaaaacaaaaacattaagcaagatccgtagtttctttacaggcaaatgtgacaactgcaaagacacagttgtgaaaacagccaaccttagcctcagacaggcctaaggtcccttaggggtggaggggtgacctaattgactattgctactgggccggagttttgggcgtgtcagggacgtagagacaactataccgggtccgaccttaaagtcaacaacaacacattacctccgcctttctggaagggagctgtcccagctgacccttgggacccataggcttctgggacctggaggcagcgcatcctgtggtggtcagcctctgagagtggccattggttctacaccacagactgacgagacctttagccactcagaggaggcaccgtgcaggacgcgcggaagcggaagtgaggtttccgtggagacagcagagcctgcggaaggcggcggcggcggcacctgcgagtggaagctggggcagggcatggtcgcgcccgccgcgctgtgagagcggagcggccgctgggtccgccatgcgcccgcggcgctgacatgggcgccagcggctccaaagctcggggcctctggccctttgcctccactccggggggcggcggcccagaggcggcaggctccgagcagtctctggtgcggtctcgagcccgagcagtgcctcccttcgtattcacgcgccgcgggtaagggcatgggtatctgcctttgggaggacatccgggaatgagaaacgcccccctacatttgaatcagacgactgtcatattttgggtcccagtcaaagcaaggagaagggaaaaccaagcggcgttcagctcttgaccgcccagatggtctttttagagaattgcctgaggttcgtctcttagggagcagctccataattcagctaagacggcctctaagagtcttaaaacctccctttcatccaactcagcctgcaaattaaaggcatttatgtcccttctgttcttctaagccttagaagaaatctaagggaagatgaccttctgtttaggtgtcttgccttcctcactgtgaagttggacctccgagaatagtgtctggaaaagcagagaaaggcgtcagtgttgaaggtggggccacaacaaaaaaagtgccctcagccagttgggttctctagatctggaacactaacctaaccttcttttttcccaggtgctcacacaaaatggcctggacctagtgagctcctagggactggcattccctgtgatggaaatttgaccgtaaataccagaaagacccaacagtgtcgattagacagtgccagccactggggaatgacttggagtgcagccttctgggctcagacatccaccatcttggtctttggccctggaccagcagtgtctttagaagtgagaccagtatgcccaggccactaccccacccactccataaataagccctaggtgaagggcctgctactagaatcatgacctttgtgaaacagaccagtggtgaggactaactttagttgcctagagagggtgctctgatgtgacatcctgttggtatgacagggcaacagtggccttgtcacactgcctgcttccctccgggcaccaagcaaagagttcttccacggagaacgcacgttgtgcgtcttctcttggggttcagcgtacttccctgtggtctgtggcccttgccaaggccagggatgaggctccaatccagcctgttccccttctctccacagctccatgttctacgatgaagatggagatctggctcacgaattctatgaggagacaatcgtcaccaagaatgggcagaagcgagccaagctgaggcgggtacataagaatctgattcctcaggtgagggtccgagcagtgatcataaagcctacatcagtatgtcaacggagatacagatggggctttctgggggaagagctgggaagaacagagaggctcttagcatagaggcccagagctgatcttcactagcctctgtttccatggcagggcatcgtgaagctggatcctccccgaatccacgtggatttccccgtgatcctctatgaagtatgaacctgtgtgtggcatggcagacacgagcacccactgccccagcaagaaactcccaggatcaaggtgtagcttccattcaggagtccaggctggtgccacaaccttgaataaactaaactccgttggcccagaaccttcagttgtaagaggggttgtccctcagtgttaactggtattggcggatgtctgaacaataagaggttggtggctggtgagggctaaggacagaattaccagcccgtctcccccagccgcttgtgggagaagcatgacaggagacacgtgccggtcaggaatgcctggttcctggttacctgcctgacctgctttcttccaagcttgcctagggcccagccctcctagaagctacagcactttacaagcagagtctgccttcttccagcccctgggctgtaggggctctacccaagtgggaacttccttttcctcactccccttcccccctagtcagagcatttcagccgtttgctacctcgattcctcctgtatcggacagactggagatacataccagcctcacccttcctgcctacctaccacatgctcccgctcttaagctggacactttgctggctgttcaataagaatgaggaccagtgtgggaggcttctcctttcacccagggctggactgatctctcttgatttcaaccagttgccctcaagttgagagggtacaggccggggtcaggacaggctactgacgcctgtacctgtggggacttgccccaaaccacatattcgtcgtctcccttgtctttgcaccagtcccacaaatccccagttgtaggggagaggcagtccaccacctagtggtaagaaacgactggggctggtgccagtagctatgaggagcccatccccccccttctccttacagtatctttaccccttcagggtctgttaagagaaagtactggagctccttggtaaggatagaaaggaggggaaaatacttaagaggcataattaaaatgtgaaggtttgtaaatagtctagactatgataatgttggggcagagtctgatttctatacagagatggctttaaaaaaatacttccttgtggaagctctgtgcttctagagtgtgggaaatggcttgggacgagtgatccccagcacaggaaggctgttgtgttatttgttcaatttcaataaaagttatttgtagaccctgcacacgagagtggcgtccagtgagactttaacatccagtttctagactgctgatccggtaaggctagcaaacccttgcctgaacattgcctgtagcaataccagccgtggccaacaggtggctgtgtccaagaactgtctccagccctctcaagacgcagagggccactcacctgtccattctgtctgggaatttggaaacagaaggtcgtgtgggatcctagggagattgccctagtctgaggtgtgagtgtagccacacagttgtgagatggttctggtcccaacaataccagattatgtgaagtgaggttacagcctaaaccccacagatcaaggcctagctatacttgaacaacagacacttcccaccatggccttggcctccttccaggctctgaagtccacactcacctgacttcccaggcagccatcagaagggagagcacaggctcctgctgcagcctctatcgtagggctcggcccaacacctcctccgccctctgccgccaatggacgttctgcctacgtttctcaaggtcggctatgagcaggttctctgctcgcctagcctttggccataataaactcaagacgtttttaaaaagcaaaaacaaaacaaacaaacaaaaaaacccaattaggaagcaggagttcatcaactcagggcagttggccttcaagttgctcaaagctggaactggtcaagtcttagcctgttcaacatagatttgcggttctgtagaccaactgtcatccctgtaaaaagccaggagttaggttcctgtccaggagccaaggctccccatatcaggcagtatcctatctcaccactaccatcctgctcgggaaactccctgtcctggacctgcctagctaaccccaaagctatgaacaataggagagtcagggcagtgtttccctactccatccggctgggctaggctcacttccttcctgctggcagcctaaggaagtgtccctgccctggacagtctcgcctggactttgttttcccagtagtccccacccttggagcttcctagatttttgtcccttgtgaagccaacacaatggtgaccacagcctaggctatacacccagctcccctgctttctattggcagagggactccctagcactggggaggtgagccccttggacggtgaggggttgtcagtttaggtagatttgagagcaggcaaatttgcctggacctccaaagaggtcttccaggaattcgtattgtgagcttcctctcccatagggacacaattctccccccaccccatatcacacagccacaggcatcaacacattgtcacattgtctttgtcacaggttggatacttctgctcttgatggaaaaaaaactgactcagctactggaagagcccaccacccccaccccacccgttttcccctcgtgcaggatggtttcttctttggcacctgctctaggggaccattcgctcaaccacccagcaaattgactcccatgaatacagccagccacttgggccccctcacaccctactggatttgaggatgatgcaaaacttggagaaagatgagcccttggttcctaggcccatatccttcccatcacctggcacaactcatgcagaccttcctgagaggaagggtgcaaagggcagccagccaccaagggaaacagggtcaaggggctctcctccccgcccccctggccctttccgcctggagggcagcaggaagtgaggagaaagagcagggatgggaggcgggagggagtgggtgggaaggaatggggtttatcaaatccccagcagactgcccagagggcagcagctggcgcaaggaacctggctggagagactctactcaggtgagcgcagagtagtacataaagctagtccgcactgccataaatgcgtgtactcctgcggcgctccctagcttccaagcttgcggtagggaaaggggctggcggccagaagcggactttcggagatttgagtcgtgcattggagagcagatctaagaggcgagggtacaggtctaaacctagtcctcactggaaggggattgcaaggcagaaaggttcagaatatggagtcggggtactagggagacactgaagcctcctttctacgaagtcaggcccgaaactttggcaaattgctctttatttggagttgagtgggtacccctatggacaaccatcccaccttcacctcgtcgcagagactggtccggggagaatccagtaaattggcaagccctggcgtggatccggtgaaagtggctagatcactttccccttt

SEQ ID NO: 242 - DNA, 4773 bp, Mus musculus
aagtccaagacacatttaactttggagacaggtggctttgaggctctaccactcagttctttggccagactctcacctatcaagtcaagaaaaggttaagcaaatcaaactttgtgacttttctcctgtcagctagctgcagggacagggtataatcagaagataacagggatcatcttaccattgtgctcagcatggacatctgcacgtggctgctcaccattagcgctcccctgacctgcgtctccccaggtaaggccttgggtgtgaggaaaccaccctccgagctgttctctcttctgcatttccaagtcattctcatctgtgggattccttgcctgaaaatataggtagggaaacgggaatgtgggttaagagatcccatgaataagccatgagattgaaatctcccttaagtcggaacctcagctgaatgactaattccatcactatagcagttttgccccgtgtctctgtaatagcctactttatgggctctaccaagtacttggaaagcaccatatatttatcactttctgttgctctgtaactacaaagtccctgtaactgtttccactgttgaacaagctatttagggaaacctgaacccatatccccaggtatagctcagaataaacaatctgctttatgttgacagatgaaaactgggacgtacttttatcactgaacgagtaaaactcccagtgcaaagtttgtacgttacagccccacaccaagcactagattcctttgcgcctgttaacacgttagacctgagtgcttccctttgccttttttccccattactttcccttcatcactctagggttttaacttctaggttcaagtacctcctgaacatctaggcgctgcagaattgtttgcactaaggaagttaagaagtggcctaaagaagaatagacccattctaactaaatatgtgtccgagtgacgatgccagttttctcagcaactcaaatgtaagaagtgtaggtctggcttctatcagattataaccataccaactataccattatgtcacttagggaaaaacaggacacagattttgattcatatacaaatgttaacagtcgttagagaacaggatctatcacactataagaaatctattaaccagccctttttataattttatctgagaacccactgcaacaaaattcctaaagatgcatattctttaatgtttactgtattttaaaaatgactctataaagtagatatatttgtttcaatttctcaattactaagttactctcaataactaaggagaaagtaggtttaggattaaaatgaaatcaggtttaaatatctattatgctaaagttttaaattcagaacatacctgactgacattaaagaaatttttcaaagtctctctgtgtctttggatttgctgctgtaaggatgtctgtctctgcacaagcaattcttcttgggctttttgcctagagtgtagagtttctctttgtagattcagctgcttctgaagactcatgttatcttgctgagttaagacaggttgggaacagcttaaaagcctgtcctgcaatcttgggatcacagcatcattaggagctgcatgcttcttgtcagataaatacaactcacaaatgcttttagatttactttctgcaaaaggtagtgaaatgaatggatgctctatttccttggacagaaacaaaggagggagggaatgctcagaagattcacttttgttttggctcttttgtttgtgtaaaagcagttctttatgaaataccttttctaagtccaactgctctgtcatgttattctgcagaggcagacgaggctgtgaaaagctcagatactcatcttgggacccaagcagctcagtctcgttacttttagttgggaaagactgtaaggtcccgtcagaattggcaatgggcagtgctacctgggatgaaaatagagaggagctaatttgtttggaagatatcctttgctccaatttatttaacctttgcaaaagcattttctcttgcatttcctggccagatctaatggcttccctttgcatatctaactgctgttgaagtgcctttaagtcatcatgttgaggctggataaaatgctcagcagacatctcttcaaattgacatggtctgggaaacaccaacccttcttgggctttctcagtagagtgaaaaaaatttgtttgtgcatgaaggtgttctggatgtgcagtcagattattctgctgaggtaaagcagtatgtgataaacccaatgtcctgtcaggcaactccagcatctcaggataacctgaagatatggtgtcactgttggttgaacacagttcttgtgctctttcagtatcagaaacagggaatgaagcaagtgaatgttgtggtatcaggggagaaaatggaccaacctgctctgggaatattttttccttccattctcttagtgtttcttcatgagcttcttgtctagagtggatgatggcttccctttgtgtagctaattgttcttgaagggccttcaaactgtcttgttgaggcgggatgagctgggatatcttcgaaagtctatgctgcagttctggtatctgaagatggcttgacttgactttactgtcactctctgttgagagagggtgctgtgtgataccagagtcagcagatggcaaggacacacacgatggcagtcttaatgaggctttgaaggacgaaaaacctgtctgttgagaagatggattttctggagttagaggactagattgaaagctctctttttctgtgtctacccattcttggtgttcctgcaaattatcttggagagggaatgtatgttgtgaaactctaactagtctttcccgaaacgctggaatcttaaaatgccttaaggggtctgtcctatcacttctgactgatacagacccccgggatgttccccagtcggtgacttgggatggagaagacaaggcatcagtctgttgagagcagagccccttttctaattcattttgcttgggagcaaattcctcattattttttctagcaccaagtataagcctctgaatgtgtgtctcttcctggagtggtgtaaaatgttcttgtctttgcaggctgtgctgtggaaagccatgggtgatcaaatgactggagagaactctattttcttcctcagatgaatacacgtcctggagccgcttaggtacttctgaaactgcacgagaagcatctgcatgctgaacaaccacggaggagagtgattctactggcccagcctcactgtcttctgaacagctttctttatataaaagtaatgtctcttgaccatcacgtctaggcggaatcatactcctctgtctagtcagctgctcttgaagcaactttaaagtgttctggagaggtagggtctgctgtagaaaacctgaagatccatcctgagcttttgagacttcagactggcttgggagtagccctttcttgtttgcaggtaaaggctgtttctggatttttttagattgtgtatcagccaatgttagtgaactaaatgactgctgagctacctgatgtggcaaagaagacccagcttgttcagaacgtacaattttttccagcgtattttgtgtatgtgcaaacaagacctcctgggcttcccgcctagcctgaaggttatccgtctcaacactggactgctcttggagaaattctaaatgagtttgctgtgatgagatgggttgtgaagaatcccaaagcctgtccatattgtctgaggaaacagtggcatcactttttgttgaagatgtctgaaagtttcctgattcagctgaggcagagggtaatgaagaaaatatatttccagctggtgaagggaggaacactgggaggccagtctgctgtcccagttctttctgtgtgcacaaaagcagcttttcccgagcctcttgtcttgcctgaagaactttcttctgtagttctaactgttcttgaagaaatcttaagtcaccctgctgagctgtaatagtctctgaggatgacaaaggttgatcatgcatttgactgattacagactggtttatggtcgtaaagggtttgtgaattgttccagaatggaatttaactgggagactagtaaaagggcgttcaggcaccagtgggagaaaaggagacggttcacttggcttagaagatatattttcactatcctctgatgatatctgttgggaatctagactttgacaaattattaccctaggaggtttagatacttctctagcatcttgtaatgtttgtggcctaacataagacaaagtccttgaaagtgaatgagaatctttaaggacgaactcatagtctccctgatgtgtttccacctgagagaactgccactgacgttcttgtgactccacgggctgcttacctaacatttctgatacagccatttttccttgcctctgtgtaatgtgaccatgtcttggtacctgaatatgactctgctctaatgcagggatctgtgagggttgcacaggttgatatttgctaggacttagtttcagtctctggcttggatcccaagagtctgaagcagcagcaggcttgtaggattgctgtggtggccctgacacaacagaatcaggtaccagtgctgaggctgacagggatggggatctttcttttaatacagtttggtattcgagtaatcgtttcctggcagtttcaacagtctccttgtgtaacctatcaggaacaaataaaaaaccaaatactattaaatttt

SEQ ID NO: 243 - DNA, 7789 bp, Mus musculus
ccaaaataaataaattatttaattaaaaaaagaactccatttaccacaggaaatggactgttgcccaggaagtttatgtgacaggcaattctgctgttcccagggaaaagccttgaagaacaaggagtcactcacaatgtgaaggcgatggtactggagctgaaacagtctgaagaggatgtgaggaaaaacttacagctagaggaagaggaacagaacgaggccgagctgaaggagagacgcattcagaggaccaaacggggactggagatcctggcggagagaggtacaccattttggtttgtcacctccctagatgcatcaggcagcacacagataagtagtgtgcctgctgtggagtcctccgcagtctggcatctcaagtgccgtttggtccttaattaacgaggctcctgtggctttgttgcagctgagatggtggttgatccggaaacgatgccttacttagacattgcgaaccagacaggcaggtcactcagaattccccctgcagaaagaaaagtaagtcaggtttgggaggcttgccctggggatcgcctctctgggggtgctggggtgggtgggttgtgcttgtttcttagaatgaagagctctgactcacttggaatctagttcattttagggtttttgtttcattctgtaatctatttggcctttaaatgacagtttggggtaagcctcactacatgaattctgtttaaaatgaaggcctggagggagagcagcggtaaaggttcttgctgtcagcctgctgacctgctttcatcctcagaacctacacggtgggagcagagcagagcgctggcgcactcctacagccacatgcactctgtggcaagctgtacccagatccacagacatgcacacacacaataattaaactgtatggagttagcttgtaagctggacatggtggtacacccggggagactggggaccaagccctcatttaatacacagtctaaaccactgcagccttttaaaagtggctttggagggccggccagcaagatggttgagcaggtcaaggcgcttgctatcaagcaacccaagttctatttcaggaacctacatggtagaaaaagaaccctgaaagttgtccggtgacctctacatatgtgctatggcacaaatgcacacgcttacccacatacacacaaataaatgtcttaaaaagttgtctaggaaatgctggcattgtcaaataatttggaagtgtggtgatactgcttgtgaaattggaggacgggagactgagataagtaagggactccaagttgaaaggaaaaccacaaacagcactgaggaacttaacattctgacttggacagtcttgctgcttagggcaggctggcctccatcctgtcctccctcctcggtgtcccaaatgtgagcacagcccacagcatcacacctgcagtgctctcaggaaggccaaaagaactcctgcctgctcacctgtctcgtcttgaaaactgaaacagatgtggctcagcaggtggaaggagagcctgaagaacgcaggggctggcgccactcagactgcggcgtggcttgaaggctgcagggcttcagttagctaaggctctcatggagcttagctaattgggttttagattgagttgtgtttggttttttttgccttgcttttccatagagctaatacactttaatttgttttattatatgcagtactaacttgtttgaaagtactatttttaaaaatttaccctctttcctaggcccttatgttagctatgggatatcacgagaagggcagagctttcctgaaaagaaaagagtatggaatagccctgccctgcctcctggacgctgacagatacttctggtaggtgcttttgcattcattcagcagatactagtgtaaggggaggctccccagcaccttcctacctgacttcaactgatttctaccccagagtggttaactctgggagccaggagttaaggcacccaccagaatgtggtggcttcctcctttgtatttctaaccagcccccttgcctgtgcagaaggacacccactcatttccacctagtctgtaggcttggcacccgcagggtgctgccaccggatctgttgtcacactgcttcctaccttaggaatggtatcggtgcggacaatgccccaggcactacagctgagcaaattttgatccattctacccagctatgctggcctggatacttcgaagccccatcacattacctgccatctgcttcattcatggcaactccccatgcccacctgaatccctctctctctctggggacagaagttccacttttccctctcctgcccagccacaggctggttgaccctgttgaccaatgagataacggagaacaatgttttacaaaatactgagtgaggaatgcttcatcataagcgcagtaccaaagtctgggctgcaaccgtatctatctccaagtacagaagtaacattcagataaatacatagcgcacagaaacaccccccaacaaacactctcttctggtctccatagctactgcatgggcacatacacaaaacacaaacacacacatacacaaataaatgaaaaattctggtaagcagtgttaagacgaagtaattttagtgctttcgttttaaaactgtttcaacatgaaaatttgttgaatagcaaagcttttaaaattgcaaacaaagtcattattacatagaaatacacttttttttttcttttggttttttgaaatggttttgctgtgtagccctggctgttctttaaaacagttttatgctgggtttttgtttgttttgatattttgtttttgttttaacttttccttcccagttggcatgctcaggtttaaatttaaacctatcagcttcaaaactacagtgtgcaggtgttggtttcttttctctttcttttctcctctcctcctttctcttctcttctttctttttttgagacagagtcctggctggtagttatagttattctgaaactctaggcaaaccaggttggtctcaaactcagagatctgcctacctctgtctccttagtcctgagattaaaggtgtgtaccaccatgcccggcctgatgtttggtttttgtttttgtttttgttttgaaagtaagagtaaaatgtacccctttaatatgagacctggattttgatataattttcattttgtgttctggccacacacagttcagttctgggtcatttctgtccttgttgcttgtccagcaggtattggaagagcttttcataggccttggaagttaatgcagggcagagtgcccattgcactttatgaatggttaagcctttctcagaaggtgaacccgtcaacaagttgcagatgagggagtctcccttgatatgagagcacatttctacctacagcctctctgcctcttctcaagtcaagttttcaggctgtgttgaagatgttctttccctgggcctaccccacccccaaccctcatcttgtgtctgtctgtctgtctgtctctgtctctctctctctgtatgtgtgtgtgtagccacatggcatgtatgttgtcagatattcatgactaaataggaatgctagaagaggtagggatgaaagcatgcaaaaacattgttctctgtgttcttgcccccattggactgtgtgcagcctcgtgggtgataacaaatctatttcattagactttgggatgaccatgtctaggtaggcaaggtttaaaaaaaagctatttaacagcatcccattgaaagtagatggacaaagctttggaggtatctgtggtcgcagatactttttgatctgagggctaggtctgcattatgcattgagcagtatcataacaaagtacaaataaataattcatgaatagtgtcttcattgttttccttgtgtctggctcagcctgttcatgggccctcaggagtcagctaggcatttagcctggtgttttccagactgttcccccagtgagaaagtccctgcgcactgaatgtcttgtcagaactgccatcagctggagcatttttagggagttgcaggtttcagggtgtctttaaagccacgtgtcaacctttacgcatgttagaatctcctggggagattttagcagtgggacagccagcttctgtcatggagagctttgctactgtcgccctaattaggtctcagcatcagtatccccagagaaggactcctgtgtctgggtgattgtagttcatagccagggctagaagctactgtgtcctgggccagatgccaccatgttgctatcaagaaccctaattcctctgtatccattcagaggatccctattgtaaataccccattagttaatcctagaaacacaccaagagctaaaaggctttctggggacccatgaagggccctgccatgacagcttccttctcttgtagtgagtgcaaagagctgctggacactgtggacaactatgcagtcctccagctggacattgtgtggtgttacttccgcctggaacagctggaatgccttgatgatgcagagaaaaagctgaacttggcccagaaatgctttaaaaactgttacggagagaatcaccagagactggtccacataaaagtacgtcactgtgattggttgtctcagcctgcttgtggggcacatctgcctagatgtgggagctgctgccagaggtgattgagctgggcagcagcatacaatacagtaccctctttactagccagagtgttagcagcagcatatatatcctttatattagccagagctttagcaggttttgagagtttaatgaatctggctgggtttttgttgtgttctgttttgttgttgtgtttttggtttttttgtttgtttgatttttggttttgtttgagacagtctcatatagcccagactgttgctgtattattaatcttcttgctttagcttctggagtgctggggttacagcatgcatcaccatgctcaatttagtcttgctgcttctgtggtggtttttttgttgttgtttttgtttgtttttcgagacagggtttctctgtgtagccctggctgtcctggaactcattttgtagaccaggctggccacaaacacagaaatccgcctgcctctgcctcccgagtgctgggattacaggcgtgcgccatcaggcctggtgtgtggtggttcttaaagagtttactaattgtagagcgctactctcagtctgaccaggaaagagccagtgacttagtcatggcctctggtgcctagcctcagtgtcttgactgatcccaccatgtggaagagatactgcttagaagttgtcccagtgacagctgtggtgccctgggctatcttgtcatcttattgctgtggagacatggctcagttacagcagtgaccatgtgactctttaattagaaataagaccacttattctttttctcccaataacttcagggaaattgtgggaaagagaaggtgttgtttttaagactctacttgcttcagggaatccaaaactatcacagtggaaatggagaggaagctcgggaatatctcaacaaggtgaggacgactgctgcctctgccccacctctgcctctgccttggcagtggagtattctttgagtcacgctcacggatgtgtcagagccctgcacctccgtccggtcccctctctcacatgcagcatgaacacttgtgtctgtgaggctctggcagggggttgtaatgaagactctttaaaatggcagtggcttgaaatagtttctgccctgcctctagcatgagtacgccagggtagagctctgcaggccttggcttccattgttcctgctggtttgtgtggcacaagcagagaggactagagagtcagaacagacctacctgtgcctcagaaagagactgccagggctggagagatggctcaacaattaagagctctgactgcatttccaaaggtcctgagttcaattttcagtaactacatgctggctaacaaccagctatagtgggatccaatgccctcttctggtgtgtttgaagacagcgaccatgtattcatatataaacaataaatcttaaaacaaaataaagagagaccacctgcagttacctagcaaccacccagccagcccacctacaagggagagagatagatgctatttgcagcctgttttgctgtatagcccagatgtcctttgcctcctgattgctggaggcaccaccactgccagctaagctgggaatgaaagaaagaaagagtcactctggcatgcctgcagcattcagcctgcctattgttgctaagttatggatatgttatgcaggcagagatagtgttcgcttcattccttatggtggcaggttagacaagctcagtatgtctgaatcttacacacagtagttcacatttggtagcctcactcctgggctttagctttgctaagccttattgttactgctgtgaggtgagcgttctgcttcttcctgtttgtaggcacggcagctctttaaggagctttacatcgatccatcaaaagttcacaacttgttacagttgggattcactgcccaggaagcacggctgggcctacgggcctgcgatggaaacgtggaccatgcagccactcacatttccaaccgcagagaggtgagttttccattctctctgcagcacccaggaggctccgaccctttgaggttaagaaacaaagacatttgtgactttatttctgaactgggtaggaaaagaccaggcaggaggccagaagaggcatggagggctggaccaatgcattgtcttacctttttttgagacaggctcccgtagtccaggttagcctcaaacttgctctaaagccatgtataaccttgctctgctgatcctccttgccgatacctacgagtattcatcgtgcctggttttctgtagtgctggggaggagagaaacctggggcttcaccagtgttagcagatgtccacgacagggctgcacctaccagaatcacgccagcttgaagtagagccggggcagcttcctgtcatggtggccttcagtctcctctcaggatcttgctcaacaccatactgtgtttctgggagttatttcaaaggtagctgtgggttggtgagatggctcagcgggtaagagctcccgactgctcttctgaaggtcctgagttcaagtcccagcaaccacatggtagttcacaaccatctgtaaggagatctgactccttcttctgtagtgtctgaagacagctgcagtgtacttacatatgataaattaataaatctttaaaaaaaaaaaaaggcagccgtgaggctaccatgataatttaggattaccttcttgcctggaaacatgtcagatcataaaaacaaggttttaaaaagctgcagtctttacaagtacacataaaaaaaaaagttttagaattctaaagtgaaaagaaagggaccttgtcatacctgcccagttgtacaatgaagaacctgatgtagagagttggtggtgtggtttccctgcagtatagcagtctgtggaccacagtggagtaggaagccattgtaggagtgcagctatgggttggttatgtcctgacctgccagcagggctgtgcaaacgtctcccttcaccacagtcagcctcgatgttccagtcatggtccctggtcctggaagcagaagtcagggacaggtcaggagaagctggctctgtaccttgtagttgagtgccctaggaagtgagcctcccggacagcattc

SEQ ID NO: 244 - DNA, 14496 bp, Mus musculus
ggtggagccagcccgggcctctgctgacagccgtacctgtgactctgatcactagtcttcgcgggcaagaccagctttccggggccccaggctaggaagcccgagtttctggaaccatagaaggggattctccaagataatgaggacaggtaaccaaatgtatattggagatgactgacagtgacttgatggctggacactgcagctctggttgtgaggcccctccccttttctgtttcccaggccacctgcccttgctggtctagtgactgattacataggactcagctttctctgactttctgctaagtgaccttagaacctagaaaagccgtgcttctcacacagggccgtgttaaagtgcagattctgctgcacaagtaggatcggatgctctgcgtttctaagacattctcagataaccccggtgccacagttccacaattagagcaacaaagattatttatcttacgtgcttaatgaaagaagtaaattgttctgaaaaatatacctaggtgaaactgggcacagcctctgtctccctgctatccatccaagtaacccgtacatagtagtaggactactaccaccctaactaaccctaaccctgcctctcctgtctctgctctgtccctggttcaggttaaaatgtcttaagatgggtaatagggtagattctattacaagaagaattggaggagggggaggaagagaagagggaagaggattatggggtgtgtgtgtatgtgtgtgtacatgtttgtgtggtgtgtttacatgtttgtgtaggtacagctgtatgtacacacgccagaaaagctcgaggctagaggttagccttaggagttgttcctggggagctgtccatgtttttgagacaaggtctctaaatagaacctggtgctttgcctttctcttatctcttcagctgtgaaattaggagcacccaccaccaagcctggctttttaatgtatgttcaggagatccaacttagatctgcatgcttagaaagttatcatctcactagctgagccttctctttccagccccagaagggtggacttttatttctgtccttttgccaagagcatcttataagttatgtgttggtaatgttacttctagttcttcgtggtcaagaaaggaaaggcttagattcttgtattctgcacacaaaacatctagaaatcatgttctctatatttcaactttttctttcttacatgctttaatttcatattttactggggtaggaggaactagtttatctctactaaacatgagtctcttttttggagtgataaaatggcctggggttagatgatagcagtgattgtacaaggttgccaacgcaccaagaaacactgaattaaacattttgacagaatcctagtgagcaaacctaatcctttgcagaccatgtgagaatagctatcacaggatatttgaacacactgtgaacctctgagattgtgttacttgctgaaaaggaaaaagaaaaagaaagaaagaaaaagaaaaaaagaaaaacctgtttctagttgtggtatggctcagtcctagcacatacctttaatccaagagctttctgtttattgtaaacaggattacattaagtcatcggtaggtcaagaggcagagcaagctttaagtgaggtaggcaggaggtgtaagcgaactttcctcttcacatacagcacaggcacttttgcttcctctggtgaagaagggctgcgaatgccaagcatttaagtatctctgctctaaatattagtcttccttggagtctcttccagttcttcttccttctctacataccttctttaggcacccagtatgttcttgattctgtgacgatttgatgaaagaaatgcagtaaaggttgtaaccattaatgaaatatggctgcatcccacctgactgcctgtggtggttagaatgaaagtggcccccataggttcataggcagtggcactattaggagacatgtccatggtggagtaggtgtggccttgttggaggaagtgtgtcactgggggaggggggctttaaggcagtctataacaatatatatatatagctaataagctttcttaaattatcatcaaaagaagacagattaggcttccaaataaagggtcagtgtatatgataattctcaggttaacacattctaagggtaatacagtcggcataatagagtaaatttctgctctgagtctctagataaccttggctatgttggcttttaaaatgagaaagtatatcagttcctcagaaaacaaaaagcttctctcggtataaatatttaaaagtgctctccatgatagtgttagagtaaatacattaaaaatgtatatgtgatatatcctccatagtaggtttagagcactgattctcagccttcctaatgctgggacccttaatacagttcctcatgttgtggtggtcctcaactataaaattattttgttgttacttcataactataattttgctactgttatgaattagaatgtaaatatctgtgtgaataacaggtttacattgctgctttatgtgtttttagtttggccccaaacagaaatatattttctataatatattttctacaatgtaaaaacatgacttggggcattttctttatttgcatctattgatcaatttaaattaattattctcactcttaataattgtttagaaatggaataattttattgtatcgaatatgtgttttcatttgttactcttgacagttgaattgttttctttcttagctgtgaaggacatctggaaacaacaaacagtcacatctccttaaatggatccactttccgatctttgaaaatactttagagcctccagttaaagtgtaaacttcccagctaagtgaagatgaagatcttgtcatttctaacacttgtataaaaagagaggttattcaaactcaagtgagtagtcaaaattatacactgtcaaataatttataactaaaagatctcctatttatttcttcttggtaccttaagatatgagaacacatctattgtataagctgatggccccatctctagtttatgaattgactgaattttcagataggtgcatacctttaatcctcctttaattctcaggacggaaaggcaggcaggtctctatgattttgaggccagcctgatctatacagcaagactttttcaacaaagggaagaggaggcgcggggggtggggggtggggtggcggggagggagaacagcaacaagaagaacaagaaggaagaggaggaggaagaggaaggatagatggaaagaaagcaaaagggggcaatcggaattttcatttttctctaacagagccaatactggtaacagaggatgagaccattagaaatcagtgttccattatgtgcccccattctctcccatgctatctgaattcatcgtttcactttatgatgctaaagtgatttgtgcggggctgtgggtgtgggggaaagaggggagtgggagagaacccgtgtccagccagagttccagtgctctgggcggatgcagaaagactgcctcaggctctccacgacgccctgggtgggtgtctggctgtgggaagccagggaatcccagatcggcatggggaggtgggaggtggacaagaggcagccttaggtactaggttcccagtctccagcatcccatgctggatacagtggaggagctgagaacagaacagggggggcccagggcggctctgagccccaggccgaagggaggagagggcagggggatagggcgctgagtggttcccacacgggtgagagcccttggtctggtctgtggctgcagcacaggaaggccttctggcaggagattagacgcagctcattaggagaaagcctatcccatcgttcaagcatggcgggccctgataagcagagacagtctatggttttagagctttattgtagaaaggcagggagaaagagagaaggtagaaagagagacagagaccagccatggctacgtggagagaggggagaagggaaagagagggctagagagtaagaaaggtgaaggcttaaagagagcaaggaggggccaagcagcccctcttatagggggctggtatatcaggtaactgtggggcagagcatacctggctatagtcaggtaactgtgggagtgaagtctagccagaaagccagaagcttgggacattgtctgcatgactgatagtcaccgaattatggagttgggagctctgtggtttcaggcacctgattctggaaacatggctcacctttctgtcccttgtagagttttctactgggtcaccagaacaagcaccattcaaccaaaataggctgcctttcacagtcccacagatttgaacatcacagtttttttttaaaccaggttatttattccctctctacaaaatgtcttgtgcacagtgtaagaacatcgcctttcaataaagtgctgaatggcctatagcaagacaggagtggagagaacgtgagacatctgaaagagagagggagagagagagagagagagagagagagagagagagagagagaggttccaccaccaggaaatggaggaagtcagaggtatgaaactgaggagaggtaaccagccagatggcagacatggaatagtataaatggattaattgagatacgagctagttgaggaacaaccctaacttaaggcctaggtattacccataaataaatgagccatcatgttccattcaggaactggggagaacatagaaaagaccatacggttacagtccacagtctagtaaaggggatagacatgaaagaaaaaaaaaacagtgtagtctgatgaagctgccattaaaatcagcctgtggacaagagtcccagggaaccctttaaccgaacactttccattacgcaccccattccaagatgcttgtcctttctagtaaatgggggatatgggaaccttggctttggttggtattccagccaaaatacaatgtaatttgtgtaaatacaatgctttcccccatgtgaaccaaatgaggaataagcccccaaagctgggaggccataagcttcgtatccaagaagggtgtggtgactgaggacttgtggggccatgtagttgtctaccgttctgctcacacatggcagatttctctattacagaacaggacaagaacacctcaaacaaagggctgagtcttccctgcctctgagtcagggatagcatagggatactaaaaagaaagggtttcgggtgcctctgaagtctggtttcgttagcatctggttggaaagggaaggttgtctgaaagagaaggcaaactgcccttaccatctttcttagggtttctattgctgggaagagacaccatgatcatggcaacccttataaaggataacatttaattggggctggcttacagttcagaggtttagtccattgtcaccatggcaggaagcttggaaacatacaggccagcacagtactggagactgagctgagagttctacatcttagtccgaaagcatcagaagaagactatcctactgggcatggcttgagcatatataagacctcaaagcccacctccacagtgacatacctcctccattaaagtcactgctcctaatagtgccactccttatgggtctatggaggccaatttaaactaccacaccattctagcctcatctattgatcctaagatctagagataataagtcccaaagatcatacaagatacaccattttcatctgtaaggagaggaggaaagaagaagggacagatactcaaagaaacaaattcatctagagttggggatatagtttagaggtaagagtgcatgcagagcatgaatgaggcccccaggtatggtctccagtagggagtacataatatatattataatatattacacattaaatatatttatattatatatttatatatagtataatatatttctatatttaactacatatacaatatatattaaatgtgatagtctaatatatgatatattatatttaatatctattttagagaaaatgtttgaggaaatactctagtcagagtacaaataaatacctagaagaccgagacgggaaaggagaagaaaaggcagaaaaaacagtaggcaatatgctttcttctttgttctactgttggttctccctttttttctactgtgcacacgcacatacatcccaagtaaacatggttaagactgggaatgtacagaagttaaagaataatacagatatcatataataactatatgctaccaagttttaaatggaacctacccatgatggtttgtatatgctcggcccagggagtggcactattagaaggtaagaccctgggctggcgagatggctcagcaagtaagagcactgaatgctcttcccaaagtcctgagttcaattcccagcaaccacatggtggctcacaactacccataatgagatctgacgccctcctctggtgagtctgaagtcagctacagtctacttatgtataataataaatctttgagccagagccatcaggaactgagcaagcggggctgaccggagcaagcagaggtcctaaaaattcaattcccaacaaccacatgaagactcacaaccatctgaacagctacaatatactcacatacataaaataataagtaaataaatctttaagaaggtgcggccctgttagagtgggtgtggccttgttagaggaggtgtgttactatggacgtgggctttaagcgctcatcctacctgcctggaagccagtattctgctagcagctttcagatgaagatgtagaactcagctctacctgtaccatgcctgcctggacactgccatgctcccaccttgatgataatggactgaatctctgaacctgtaagccagctccaactaaatgttgtccttataagagttgccttggtcatggtgtctattcatgacagtaaaaccctaagacactactgttaaggaaaataataaataccaacctatctcaaccagaggagggtatctccaggttggaaaggcaacaaatgtagagaagggaatgaaagacttctgagagagtctttgagttacagaagaccagggcatggctggatcctgagacctcatgttactgcagtgggtgggcaaagagaaaacaatatgtattaggctaagtggtaagtctgggctgagggaaagtttgacacaggttaagcatctgtgacctaaagatctgaaacattctaaaacttaaaagttagaggttgtcatgatgcacgaaatctgggtcaatattcccaaatttgaaaaacttcaaaaatctaaaacacctccaattccaagcatgacaaacaaaggggggggggtgtgaacatgtctcttcttttcagataataacagaattacatccatgtcccggaaagaaatggagaatcaccagtgggatggaagagaaaacactaaacacaagaaataaatactaaaacacagtgggcatgcagatgtatgatggttatttggtcgggggaaaaagccattttctttcattcactctattgttagtaaaatgtcccagagtagtggtcctcacccttcctaatgctgctgtgaccctttcatacagttcctcatcttgtggggaccccccaaccacaaaattattttcattgccacttcataactataattttgctattgttgtaaattgtaatataaatatatgtgttttccataactcctgagaaagggccattggacaactccaggtagtggcccacaggttgaaaaccactgactatagctatacctaaattgctattgcatccctggagaaggagtatggcagctcctgaattttatgactattacatcaaaacccgacacttataagttgcaaagataggccaaaagctttgaaatagcagttttataatctttcaccagatttttcttttaaaaactactgttgctaatattaatctttccttttatagtgaggtgccggaacagtggtcctgaaaactcttgccaatgcagtcttgcaaaccaaatcactattaaaaacacaggctgaacaactgctccagcttctgctagagtgctactgtgagcttttcagtgtatctcagtgttttatctgagcacattgacttctaaactttttatgttaagcaaaaaagacaaataacttacttaatttactaagtacttataatgtgcgaagctttaaggaacattgtctcctcatgcccagccaagatatggaaacacacttaaagcaaccttggtatttatattgattaatgtagtcgatcaatttcttgtgcatggctaggcattgttctatgggcttagaatataatgtatccgtgaataaaatgtaaacatccaagcccttggggaatttatacctaaaaggatgaaggcagatgataaaaagatacatggagaccaacggcaagatgaaaagtaataaatgtcatagatgaggggaagagaacagcttttaaaggatttcggagtcatggggaaggggtagccaggagcttatagttgactggcgtggccaaagctgagctcaagaagaaacaaagtctgagcaactgctggaagggaagagcatccaccaagctgctgggggcagggagagtgggttggagtggagagaattttttccagagcagagatcccccgtgcgaatgggtatcgaaaccagtaagtagcaaggaactgaaggagtggtataagtgagatcaaaagggggccagtgggcacccaaggcccagtgaggcccccacatgcggaccatgggagaatccgagagacatggtgcctgatctggctgtcgtttataaagacagctctgcctttacgtagagggtagccaataaaggagccgggataacgacgatctcacattttaggtagcatttaagtgataaaggcaggaggtgtaagtgagctttcctcttcatatatacgacacagatacttctgcttttgttcttctactgtccctccgtattgtgcgtggcaatattgtaaagagacatgtcggttcacatttcatagtacgccacaatgagagaaagggaatttgacgtgagctggaggaagtcggggcgttggatccaggaagcagggttcctggagattagacaagggggtgtttcgggagtctgaattgggagtctttatacacacagagcgcgagcccacttctgttacaggatattttactcatgttgtcttctcgccagaaccattttcttccaagcacacccaagacccacttctttacagttgtttgcacctctgctccaatgttacctttcagaaagatggaagcttcctttagtggccaaaatagctgctttctttactctaaccacttgtcttagttagggtttcattgctgtgaagagacaacgtgaccaaggcactaactcttataaaggaaagcatttcactgcagctggcttacagttccagagattcataatcatcaaggtgggaagcatgcaggcagacgtggtgctggaggagctgagagtcctacaccttgatctgcaggcagcaagactgtaattccacaatggaaggagcttaagcctaggaaaccttaaagcccacccccacagtgaccactttctccatcaaagccataccttctaatgtcactccctataggccaagcattcaaacacatgagtctgtggggaccattcctattcaaaccccccccccaccacctctgacaggctttatgttttcctttggcacataaatcagcacctaaaattatgtgtgttatgggagtgtttttcattgtctttctgtcctctgtggctgtaatttcactaacctgcttattcatagcccagagcagcacctagcacaaaacaatcactcgatttttataactgaattaaagtggatatctgaaaggctaggaagggactataagaaaggtatttggggctggagagatggctcagcagtgaagagcactgactgctcttccagattgcggtgttcaattcccagcaaccacatggtgcctcactaccatctgtaatggagatctgatgccctcttctggtgtgtctgaacacagcaacagtgtactcatatacatgaaataaataaattaatcatttaagaaagaaagaaggaaggaaggaaggaaggaaggaaggaaggaaggaaggaaggaaaggaaaggaaggaaaggaaaggaaggaaggaaggaaggaagaaagaaagaaagaaagaaagaaagaaagaaagaaagaaagaaagaaagaaagaaagaaagaaagaaaggtaggtatttgggaggaggggtagggaagaggcgcagggagggatgtaccattcagtggtacagcagcagttgcttagcacacgtgaagctctagatcttaactccagcaacaaaacttttaaaagaaagagggaaaggaagtataaaatgaaaggtagcctgggatccagggtgaaggcactgcctatatacaggctttggccccagtgactaaggagttgtctctgtaacctagtgagcagaggagctatagccccaggctaatgttgctatccagaatgtcttttggtacagctgaaattggaaagagtattgacccagtttaataaacatgtttcaatgtattttagagccaccatttacagtagaccacgtgatgataatgtcaagctctccaggcacatagcattctcaaaatatgaataaactctgtttttccaaacaagcgtttctttactacttcattaacctaagttcaaatagaacacatggacaaaggcagaaagttgagtttaagaataataaaaatagccggacgtggtggtacacgcctttaatcccagcactcaggaggctgaggcaggcagatttctgcattcgaggccagcctggtctacagagtgagttccagaacagccagggctacacagagaaaccctgtctcgaaaaaaacaaaaaaacaaaaaacaaaaaattcctactctttatattcccaggtcttccaccacccacccctctcatcggtaatcttcctctaccatttgaccaaaactaaatgtatttttcctgtgttgaattcatgacaagaaaaaaaatcatattgagttttgagaatccctgttttgatgtcgacacaagttaccttatcagatctggttggtatgaaaattaagaagcttcagtgtgaagaagacccagatgtcagtcatcgcttcctgctttctcctttaatattattactagtagtgggagtggggacatttcatgtggctcaaaatgctgagcatgctatgcaactgtggcagtttggctaggttgccttgttggtggaagtgtgtcactgtggggatctcctgtttgccttcttcttttttttttttttttttttttttggttttttttgagacagggtttccctgtatagccctggctgtcctggaactcactttgtagaccaggctggcctcaaactcagaaatccatctgcctctgcctcccgagtgctgggattaaaggcttgtgccaccacgcccagcttcttatgaagatgtagaacgctcaggctcagctcctccagtaccatgcctgcctgggtgctgccatacttcctgccatgatgataatggactgaacctctgaaagtgtaaaccagccccaatgaaatgttgccctgataagagtggccttggttatgctgtctctttacagccatggaaaccctaatggaaggcagaagttggtaccaggagtggttctggagaaacagaagtgtgaggatgaatcttttacatatctggaatgggcttcataatttgtcatcacctgccaattcaccagtaccttcaactactgagacctctccagacacactctcctgggagctcggagaataatgaaggcccatggtggacactatattccaaactcgaagaagtaaacgcctttggttatcttgacccatcaattgtgactggcaatggattagctggcctggtataggaaacttgctacaccttggtgggaagtaaggaaaatgattttgctggctcattgctcttagcatctctgggtaaattgataaaggaaaggaacgaacttcatgacaaaattgaatggctccagatgcaaatcaacaatctaaaggtttctaagtgtgcccttgaagagaatcttccctccagcagccatagagctcaagttacagaaaaccaaaccaaagccctcattataaggttgcctgaactgcagcaaacattcaagtctcagcctcagagggtgtcagcagttaaagtaaggacgttaattggcaaagaaagggatcctgtaacttgggatggggatgtgtgagaggagcctattgaagctgagaacttagaatcctcaagttcttaaggattcccctcacctgaggaagtagtaccctcagccccaccccttgaaatattgccctttcacctgaggaaattaatccttcattgtctgataaacaagcagtggtttttctctgaataccaggcaagacaataccgatgttcctcaaggctcaccaatggttgcctctagaccaatcaccagactcaaggcaaagcaggcccctagaggggaggtagaaaatgtagtccatgaggaaatactctatgctactaaggagcttaatgagtttgctaatttgttcaagcagaagtctggggaatatgtgtgggaatggattttaaggatttgggataatggtggaaagaacataaaactagatcaggctgagtttattgacctgggccctctgagtggagattctaggtttaatatggaagcttgcacagttcaaaaatgtgtcagaagtttgtttgaatggttggctgaagcatttatcaaaagatggcctactaaaaaggagttggagatgcctggtattccctggtttagtgttgacgaagggattttaaggcccagggaaattgcagtgctagattggatacactgtgtaaaacctaaccctccacaatgggaaggcccagaagatatgcccttcaccaatcctataagaagcaaactggtgagatgggctccagcacatatgaagagttttgttcttgctcttttccttgtgccagaccttaaggctagagatgctgttgctcaactggatgaattaaatgcaatgggtttaattggacccaaggtagcagggtaatcgaagttattataatgggcagtatagacaaaactatgttcgtaatcacctaactcataatggtcagcacaggtgaggtgaattttatactggcatgacttgtatggacctttggtactgattaatcagacatggtatttccaagcaccaaatagataggaaacctactgcatatctgtttgatgtgtataaacagaaaaactctcaaacaaatctttaaaaaggctacattagatcgtggtaaaaggcaatctcgaccagtgaatcaatttccagacttgagccagtttgcaaacccagaaccccttgaaggtaagggtggccaggttgccctgaggaaggattttgataagacaactaaaagttttgctcttagcctgtctccagtgtttcctcagagggacctatggccttttacaagggtaactgtacactgagggagaggaaataaccagactttctggggtctgctggatactggctctgaattgacactgattccaggagatcccaagaaacatggtggccctccagttaaagtaggggcttatggaggccaggtgattaatggagttttggctgatgtctgactcacagtacatccagttggtcctcaaactcatcccgtggtcatttccccagttccagaatgtataattaagatagatatacttagaagttggcaagattctcacattggttccctgacctgtggaatgagggctattagggttggaaaggctaaatggaagcctttacagctacctctgccaaagaaaatagtgaaccaaaagcagtactgtattcttggagaaactgcagaaattatcagtgccaccatcaaggacttgaaggatttggggatggtggttcccaccacatctcccattaaatctcctatctggccagtgcaaaagacagatagatcatggagaatgtcaagttgactatcaaaaactaaggtagtaactccaattgcaactgctgtaccagatgtagtttccttacttgagcaaattagtgtctcctggtctacagagcaggtttaaggccagcactaagaacccattcctaatggatactttaaaaaatataaccgagagttacctggcaatatttatccccaggtagtttaattatttcaatttcatctcttattcagtaatattgtgaacttgtttcaattccacaattgatttttataaattatctctatgcttt

SEQ ID NO: 245 - DNA, 11872 bp, Mus musculus
ttcaaacatatgactgtcagagtgtgctacctttgactacttcttggtagaggtggtcacatcctgtgttcaggatgatgccacatttaaacccaagataatttttcaaccaatgaaacagatctcctctataatctataaaatacagttgtttctctgtatccatggggtactgattcaagaaatgcccatggatgcccaaactgcaacaactctggtctcttgttagaaaggtttactgtttgcatataactagacctgtcctcctgcatgactcatctatacagcaccaggaaagactcacagaaggcttagtgctctgcaaatggctgctacactgtactgttggaagctaacaaggagaacaggtctacatgtgttcaacgaagataatgtcccgacactgtggcttcgttggaggtatgtgtgtgcttgctactctgcttgtttccttaccttggtcaactgactttctctggtatcttatttcccaggtctcttctcctgggtctgggatttttcatttagcctcactatggagtggcctgcccttgcaactatgaataccaatcagtaagtagtaaaggcatctaagccaaatccaagaaggcaaagtgagaacatcagttctatggattattctagacttgctctatatacttcttccatacttccctacaactactactagaaactgcctctgcagtgttcacaacactggagtcccagtgctatataccagaaggcaggaaggcagcaggcacattgtcaggcatcagcaattgcaaactgagcacaccgagagcttgctgggagagctggacaccttaccactcctaagcctttggtactatcaagaacactatgcttgctactggatgcacctgttaaaggaacccattccctttgttctctcctaaatgatgccattacttgggaaaattgtcaccatcaagccctccttcctactgcctttccagatatacaggtaaagcaagtgacataattcccagggtctcacatggcttccacactttggcaatgggtgaaattacaacgcattactttcccagatctttcaaaatttgcatgtagaggagtaacatggcttaagaaaaaaggtatataaacttaccacagcgccaactccatagctggcggcaggggcgagggcatggtaggggtcagctgtgtacaccctgccgtaactggaaaggagaagcatgggggtcagacagaagcagttgagaccgagactgaaggccctgtgctgcagaccaggactattaatagggaaaatggcagatggaagaagttttcctatctctgttcctgagtgcagtaactgggaaatcctgactactataaaatggcaaagaaggggtcaaatgggaaagaagaccaactgtattcacagccaaagaagagacagaacaagagagcaagtacaggaagaggctaggcctgggtgctgtgtggcagaagccatgaaggacagactccagaaagagccaggctggcaggagcccaaggactcagggcaattctggaaatagtgaagggcgagaggaatgctgcagatagcatggtgctcagggcctgcttgctctggctctgtacatacccgtcgctgtaagcggctgcagcggctgcagcagctgtggctgcggttgcagtagcaggctgtgcatatctgtaggctgcatatccaccctacaggagagaagagaactgactttacagctacctctccccgagacagacacccctccccccagacagacacacacgtgtagacacaaggacagacacaaacacagacacacatggaaagagatgtttcaaactgcaccagtttgcatgttcctcctatggtaggaaatcaagctttagccaatgtagaaatttgctttccaatttgtgacagtaagaaaaataaagtatacaggtactacctagtaattttaagaaatacagatataattttggatcttacttcgcagtgtttttttggaactcttgacatggaaaatattcatgaaatgttaggagaattgagtcaacattcatgtaacagttgaaagaattaaaatttactatccctatcagtgtcaatgtcagactctctgtactgggattagcttgtcactaagaatgcagcaggtcacaggaagatctaacccagagcttagatccatctggcagagcatgtctgtcaagagcaatactgagaaggaagagccaagcagaccagacatcagagaactgcctgtgaatcaataaatctgctagttagagtggctaggacagagattgtggccttaaaagctaaccgcttaaccctatttctctccaggaaaacctcaactctagcccacattccagacttggggaaatcagattgcaaatggcttatgagtgtttgactagctctgatgaggtcatacatgcctcagctgcttccttttcccacagcaacctttgggagctttttttcccagtggatcatataccttcttgagaagtcctgaggaactcagagccatcacagcctactactccacctgcattttgatgaactaaacaaaggcaattgatgtgtgtatgaacagagatgttccttctggaagcactcaaggacagtgaggcagggtgatacaactggtatcattgtatccttctataacctacctactttatctgattcagagatacttaaaaacaaaaccaaccaaacaagcaaagaaaaaactccaaaaacccaagacagggtttctcttcgtagccctggctgtcctggaacttgctctgtagatcaggttgcccttgaactcaagagatccacatgcctctgcctcctgagtgctgggattaaaggtatgtgccactaccacatggcctgttacacatttttattgccatcctttggctgtcaaaaatatctgttcagttggtccaattgactcaggtggttcagtcatgaatcacacataaaacagtgtttattcctgtagaaggcccacatcccatgtcagctcaagtatcccattctttcccccctttgaatgctcatttttttttttttttttgctaactttgcaagagatattctacatttccagtttttgggccattttttagggttgaagagatgtgtgtgtttgtgtgtgtgtgcatgttcgtgcacacagatttgcctagagacagagctaccctaggctgtctaggaacttgcaatgtagaacaggctggctttgaacttacagaatacctgcctcttcctcctgagtgctgggattacaggtgctaccatgcctggctaagaagtatcttctaatgggacccttgcctttccatacctagcagttctgtgtggcttccctgattcctgatacctttcattgtggaaaattattttatgagcttgtaagttttctcacctcatatggctctcccagtctacgctgtaagaattcagggtcagcagcttcagatacacatttaaagcgcactggctcttagctgctacgcagcactcctttgctgtcaccctttctacaggtgcagggacagtctgagttaccattatcagaccctgtaatgacatggccaaagtggagtgtggcaggaagcatccttgtgactttcagccatatctactacaagagcaggctggactaccccccccccccccgaaatccctcacaactggctccacagggctagctccagtctttttgacctcagtccttaagccttcacagaggacacagggtgatgaaaacattggttagagaacaaaaagctcatggttatagctcagtctttacctggatcatgaaggctcagctgttcagtctatgtagatatggttccatttttcagaatggaagctgaatctttagtgagctgtctttgtaataaaggtactttgatactatgctttctcttcagcattccttcaaacaccaagataatcttcacaattttagaactttaagatagtgaaagcaactacatcttggtctatgcttagctaggtatagcatttacagactgaagcaggttctttctgatggtttagattcagggctgacccgggggagcttggcggctactgcatgctgtctccaattgcagctctgagtcgtggctgctaacagggaggatgggctcctaagcaaggcaactgacagcaatggttccctcagtggcttaggtccttcctatcagggaagaagtgggccttcttcattgcagtaatttgctttcacgagcaggcactgactttggggtctgaaatattttattgacaccgatgagcttgggagaatactggcaacaaggagaacaacattaatgcttttgatcatcagacgtcttttaacagaagtcatttaaaggagggctacttgtgggcggtatgggtaacactttatcaaggcaacccagcacttcacccccgtcttatgggaagtgcactgtgcaccaggaagtgatccttctcacatacatcttactccagaggctttctgcttttgctgacattaggtattccacagacccttacataaaactcaggacaaaatttacaacaaacaattgacttaactgcattctaggttttacagtgtacaaagattccaggctaagattttcccattccccgatttgactttaacgagtaaatttgaaggcacttatatacagaacatgagagcaaagtgcagtttgaaacaccaagattttcattactgtttcttaaaattttcaaaaagaacaaggtgggagtaaggagaagagggctcaggcgtgggggtggggtgggggtggcgccacattaatattaatcacattaaaactgagcatgccgacatccggagctaaaacaacagcaaaaccaccacgtccagactggcactggctaactctatctatcccagcattctcttgggacagcggtttgccctaggctctaccacaagctcggtgaagtacacagcctcaattactagagcgtgcagccacaacgacctggtattacggaaacagtcagtcaccacttgagttaacattccataccctaacaactggtccctccccagcccaaaggaggagtaaatcttgcccacccgagccctggcccataccacaatgttaataattataacaagcagtaacccatctgttatatcagagaagggaacagagactccactgagagatttagagtgagatgttaacatttcttcagctgactgcacaaacaaacaaacaaaaaaagaggagaaataattcatttggagatatgaagtcatgaatagctgatgtgtattgcttttaaccatgcactgatgcaaaactgaagcaaccattaataaaaattaaaaaggacatatgtatttacacacaatcagacctgtttgatctgaagcagtttgcagattctatctgtgtgtgatttgaaataaaacaaaaaatggggattagcatggccacagcacaccagagtgtaggagggcacacacagacggcttctggaactcagctgcttaagtctggcacggctaagcctggctcaaatccacacatgccccttgaaaaatggttaattttctttgtaacctttctaagtaatgcctgacactccccgtttggtggcccgagcccattcttcaacagagctgctcagacgtgctctctgggagcaactgcagactctatctgtgctcttccaagtcccctgtgtttgagaatctcgttctctcagttacttgtcacactcctgctcccactcccagcttcttctcaaggcttaatgctgctgctttagacccctttactaatgactttccacagtgttaaaggaaagctgtttcccatacccagtgctacctctttgaggttttctacttcttccctaaatcaggtttatcgtgggattgacactgtaccactgggcctcttctgtagcatttctgcagttatgtttgaaacaaagcagaagttctaaccattgtcccctacatgtgacccttgtctgaacccctaaagattctcatcttgtcttgattttaaccttgcctttaattttattgtatttttgctttaggtttacattaaaacaggactttggtgagcatgtgatgtcaagacaccttctttctacctgagagacaatgacatgtgacactgaggaggaaagtgtgtagctcaagaccagcagacaaatgaaagcttgttatctcatgtagtgtgcagatggacagagcaaggcaagtgtgtgcatgtacaggcacgtgtgtaagggctggcaggcgtgacgattaacatcaccaccgaggagtagagatctgttctacttagccagggtctaatgtttggcctctaagaaccactgggtttggccctggatgatcctaatgccctccttccccacgccagctgagagcctcagccacaggagacagtgagctcatgcagacacagcacaggcttgaatacagaattcataatctctgctctgaagggacaagtgtcacttaagatccctcttgttatcatttcaacttggggttaatgagagaagctgttaggatcaacttcatcagctttgactacatgatttatgagagatgaactttaatgattaaatctttcaaatactttggtattccacatttctccaaattagttcatttctgcaatatcactgggttacatgacgtagctgggttattaaattatggactattttttttctctgagtgtcaagctattgagaaaactctctaacaagtgtgctattatccaagcaccgatcttatcaagtgaaaggagagggcacaggagctatgcgtcccggcacgtgcagaccgataacaacgccacacttctgcagcagcacagtccatttctgactctgattttactgagcagctaaacatgggacttaacgccctgtgcaggcagacttctgcctgcttccttttgccatctctttcactgttagcactctcagctgctaaggtctccaatataaaagactagtttaaatagcacaggcaactgtgactgacaggctgaaagaggcagcagtgttagatcgtggactgtacatgtgatgtgcttgtggctcatgtgtgctgagggggctggaaggctcattctgaagggagtggcatgatgtgtggatgtgatgtgggcactgctgaggtagcagggcttagatcacacgctcacaagtcttgattgtccaaaaaagcctctgttcccatctctaacgtggagctggaatggttagtataattcaattttttcactgcaatccacaatctgattgattggcaggtcacactggcactcctacctgaggtattttagcgctaatgattggttcctgtaacactattctataacagaacacaggaagagcagttcaaaaacacagctgtggaaggaaaacaatcatacaaagagcccaccatgggctgccagccttttctttcctttggatgcaagcatgcttttcacaggatgagaatcaggagcatttgttaccccactcataaggtaaattagggtgaactatggcctttttaatgggaaaaagggaggcagcagggatggggagtggacacacccctatcctggaagagaagggctctttacaaatggaggatgtgatagctagatcaggacattttgtctctaataagtaagccataaggaagcagaaagaaagaaaagaaaaacactggctcccaggacccactctcagaacagcagaggaagactcagtagcgcctacactgaagtacctctcccgagcgacttcttctcactctctgcctgggccggagtggttttgacacactaaatcctgctctcaccctactgcagtatgcacttctgagggaaccagctgcaaaggcatggtgatggatttccagtcaggaaatgtacagagagaagcagaacaaactcagggaacagtcagcttgtgtgtgcctttatgagccctcctcagctccctcacacctgcaccatcagtttaacagctccagctagaatactatagtacagctctggtttgcagcagaaggctttgaaatgatctcagcactagtgaccaacttgtgtcctcccaaggactctgtgttacatgggggagagggagaggaagcaggcaacagggctcttgctagcaggggtcgctgggaagggtgttctgactaagccactggattacctgtttaagattctgtagattattcatttagattgaaaaacaaaccaaaaaatccttttgatgggcacagaacaaattattatccattaagattttacaatgcaaaataaggaaacaggagacccataaccaaatattcagttggctggtttaaggtaaaagcaggcaaaaccaggatagaagcaggatatgtttaaaaaaaaaaaatcccaaataaggaagatattacataaaaaaacaacaactacaaagacaaaaaaccctaagcccaaacctcagttggggaaataactcaactatagtagattccaaaaacataaataatctgtttatgaaaatgggtttcatgagaatatagagaacatcatatgtaaatatacacatccacaaatgtgtaatgtgcaatgtgctgtaaggtaagccagatttgcccagttttcaactgtgaacacaggaggaaaagttacttcttaaaaatttgctaaagcaagagttagattttaattaaagtataaagaaaggcaatgagacatgggcatggggtcttcatgcttggctgtgtaaactatttctgaaattctagtagtcacatctaagggatgggccaaggatccctacctgtggttcttttacaaggtagacacactctgaagacctactctagatagcacagctagcctcacctggcctgagaaagcggcgtcagtgtctctgaatggactgacatcatactgctgaggaaggagaggagagggcaagaaagcgcctcctgaacacactgacccacctcagagtaacttcccactgctaagtcttccttacagaattgccttaatgatttgggtcagttgactatgctgacattcagagaaaggccatttggaaggcacctaatgatagaccttgagactcaaaagcttttcccatgtcagctagattcctttgaagtaggtatgtgaccaacaaatcatggaacatggaacttcatctccagctagaaggacaatgggtttaatgtcaatgtgcctgcatgataactgagcgtcagagtccaggctgctacttacactctccggtttccctggcttgactcctaagaaggagacacactggctgtggacttccaggtagaccgaaactgagtctctgtgaccctcaaatgctctacacttctctataactactataccatgagaccagctactgacatcacttgcacaaatttatgctcttcacgtcatgtgaagttagcacacagttcagaaaacttcctggcattacataaacaaagccctgaccctttaaagacggtgtaagatggagagaaaagcagagacaggaaagagctggtgtcaggtaagctagtcctgtcatttatgtatgcagatgatgcgacaacatacgactttaaagctgctgatcatctcacagggtaagagatgcccagagcactcgtgggtgggcacaggcaaggggagaatatgtccagcagactggcccagcaaccatcacaagacccaaagacttagtttttgcacccaggggcaagcgcagtggcagagaagcatgcttgcattcttaaaatatataaatatatatatatatatccacaaggaaaaaggaaaacaaaagttaaattatatttttaaaaaaggaaacaaaaaataaaaataaaaataaaacaaactaaagaaacagaaaaaaaaggctggcttgtcaggggttggggtcaaaaaggccccagtgtgtgtacttacatagaggtcagcaccgtaaaatccgtcctggtaaaccacactgcagaaatccacacaaaaacaaaaacaaaaaacaaaagaacagaaacacattccggttattgaggacggcagcatgcacatgcgctacacgggcaggtgatgtatgaatgtgacctggacacgggaccgcggcaagctggtgacagagatgtatatgttccatggctccaggacatgtgaggagggctaagggtctgcaaaactagacgaagcacctggaccctggataccgcagactagtgacagaagccgagctcctggcagggccgcaggtagctgcctgagatctgctgggttacacagaccacctttagcatctggagtccttttaaacatttgctattctttaacagcgtacaaagggtagggatggcgagggcttcacttcaggaggagagtgaacaaggtgaattccattaggacaggagctatttgctaagtgtgtttcaaatgatgcttagtagttattttcatttttcaaattatagattttttcctgttatccatacatcacctgctttttaccctgcacattagacatgcgataagatttggctgatcacacaagcatgcaaagtattattattcagcatttttaagaaccaatgcaacaccttggaaaaacaagtcaatcaattctgaccaaagtaaacagagaaatgtaattaaaaaaaaccaaaagaacaaaacaaccaaaaatacccacaatgcattgctttcacaagcagaggtaatgagctcaaggttaaggtgattggtccaaggattgaaaggtgcagtgggatcccagatagtaacaacataatccagagtgggaaggagcaactggaagattttaagggttcttgcctaactgagtattcaaagaattctgaaacatacaattggtgactcaagctttggtcatgactaggcctgtccttgacggtgaccttaaggaagccaatggcatggctcactctcctgtctgggaatgggctttgccaagcaggcactattagtttttttttaaacaaaaaaactggagtagtagtatactattattcttaaaatgctgacttttctccagccttatgaagtgtgcatatgtacatattttcccccaagtattattttgggagtaaaagacattaacagtggcagagagaaaagactaacttttttcacatttgtcaggtcaagacttggctgttttacatatttctaaaaatctgttttggtttattagcaaaataaaatggataatttcttttttcattataatgaatgagctaacaagtagggctgctaagtcttatatctaagagttgcaaggtcacaccttacaatgcacctaacactagacctctgttttgtgcagccggagaagcagatgaacttctggtgtctgtaggcaggctttacctgcgttagtctccacgtacttagagagtctgatattgggatgagtctgcctttccactgaattttcctaaaagacttgcatagttgaaggctgaagaatgggcgcagaggctgaggggagttactcttcatcaatgtcagtgcgggcacgggcaaagactacaacacatccttctacaaagactgttgccattagaaacatggatatattttattgtaagtcaaatcatttattgtgaatattcactggattctacaagagttctgataatccctgaacccaatgtggtaagagcacagaggctcacaagcgactcgaggagagaaattctaggctattccccaggaaacactggacttattccttgccatcttccatgtaaacagatggtttagttattaaaaaagaatacacagg

SEQ ID NO: 246 - DNA, 33327 bp, Mus musculus
gcatgacccacaaaccatagatgaaagaagtttattctgtgctaatggagaaactcctttctctgggtaatttgagtccctactctcaataaagtttgcttttaattatacatagcatctttcatatcagaataaaaacaatctagaaaaaaaaaccctcactattctttgcttaacacccaagtattaggtctaaaagaaggaaagagtgaagggaacaaataaaatgtatagattatttttagaaagacactgaaagaacaagaataataagccacaaagtaactttacttttggctactttattgggttcttttttctgccacccttccaatcccccagcataaggtaagagagaaaggtcagagggggaaagggcgtattgaaatcattagactacttcttagggtcgtcttgtttcttggggcaagttggatcttcatcgccaggatttcgccgactggcaatcagcaatccagcaatccagccggcagcaaacagtaaacagcaaccagcaaccgcaacaatcagcaacaagcagcagcagcagcagcaggagtagcagctgcagcacgggcagggacggcagtagcagcagcagcagcaaggcaagcaacagctctttgcaggctttcgtgactccggcatttttacagcctctgaagagtccgcggaactccgaatgtaaactgccttcagctggcaaaatcacacccctgccagaacaccagacaaatcaaagttagctgctgtgaacagtctgaagcagtccctatcctcccacacctgagatcgaaacaaaaacatattcacataacatttttgtagttttgaagaaaccaaaaacttcaccataccacaaaagtacctggcctgagagtgttaaagagatccttcagctccttgggtcatctgaaactgcaccgcactggagaagagtcagactgcgagtcctcttcagagtgagcaatttctagcccgtgcttctgacttgctttacattctcaccccacccctagtccatggactgtgacccatcactcagagaatgtgaaatgcacactcctgggtaaaatgcctttgtttgcaacacttgtgggtgttagctaaagaactatcagagtgtgaggatcttgggcagcccaaagagaagtatgcaaagaatggtagaccatacagatgaggcacaactgcagagacagcagttccctgaatgtgcgcctattcagcccttcctcgtctctacatcaactcaccccagctgctttgctacctttgggttgtagtttctagcctcttatcagccatgtatttgtaccaaatattttcgaacccccaaattcctaaacaacccccccttggagcctagtataggattacaccttaaccaaacttggtaaagtagtcctccgccatccacccaggaattgtttctacaaccttttactttctgttactgggttttgaaaaccagtgcacaaagcagtagatcgtattgtgtttgttttcacatacacttgattttattggtcctcctctcctgcttgcctgccccctccttttggtccccttcttccccccagtagactctctgcatgctttcctgaaatgggtttcagagttggaaagtttggagaagcaaaatccaagggcatgaattaagaaattaatgattgcttagggatgtctctgatacttctctatactagttaaggtaacaacaaatgcactatctcccatagcagataaatcatgacacaactcaaaaacaaacaaatgaacaaatgaaaactcctggcagtggtgacacatgcctttaatcccagcactcaggaagcagaggcaggcagatttctgagttcgaggctagcctggttcacagagcaagttacaggactatacagagaaaccctgtctcaaaaaaacaaaaaaaaagtcaggaaaaaaatgatagaacttcattggggtacaacaatagatgtttaattcttccccagtaaaaccacatttaatagtcttgcctgccagtggatgccccactttctctagaccacctcagtatttcccccatttataaagcagaaagaaaaacagactattaaaatggcacaaccattgtctgggggtgggggagtcatgtagtaattctggtgctccagtagtcacctgcatgaaagcagtgtggtaagcatcgacaaccataatctgttgctaagcacctgctcctagcaaccatctcgcaccatacaatggcaagtgaatcttagagactgagccatctcagatacgctacccttctttttcaaataaatgacttccaaataaatcatagctagaaataaaatttcagatcttatcatgaagcaatatctcttcaaaataaattagaaacgtattcttctattgtctggatattggccctaaatgtaaaccagggtggcctcaaactcaaaggacctgctgcctctgcttcctgagtactgggattaaaggtgtgcaccaccatactggactgaacactagatcttttcatacaaacaatgctctctcatttacacgagagtctctcttttgacctgcagcctctgattttctccagatttaaatcttgatctcattgaaagtcacttatagacagacaatcctttcccaccagatatatggacattctagggcagcaaaaagatttcctaggggaaaatgtcctagaggaactgccccagcagaatctacctaaaaattcctcagacgttatttcttctcccaaggattcctttcccatctcccctcttcttcactgtccacatcatttctccaacagcctggcttctgctccgccagtacggagttgcccagttcccccaaacccctctacttgctcttgctgggacattccaacttcttttcctccttcttgtctacatgtatgctcgacccactactggataccctcttcagaacgggatcattaattaattttattgaagttgataactttacagtaatcctcccaccaacaaaacaaagaagaaacatttcttaaaaatgctctgttaatgggaggcagaggcaggcggatttctgagttcgaggccagcctggtctacaaagtgagttccaggacagccagggctatacagagaaaccctgtctcaaaacaaaaacaaaaacaaaaacaaaatgctctgttaagtgggcttagtcctctcacaaagctacattgtgtttgatctgatttctcgacataaacatcagaattctatcagattgtttgtaggggaccactgcatttggggagtctatctgtagaagtcattgtcaggtaaaaacccgggaggtgatacacactacggatcgagtgaaatgtaaactacatatgacatagttttttgctgagagccggtcaggcaagatgcctctctccttgcaagtgaccttcactgcctgacacttgaaactggtcaccccatgcgtggagatgtagtttactccagctttcagaatcagaaggctacaccaaagcttgcaatagctaagacaaccctggagcggggagcgtgggacacattgaatgtcttacttacttacttaatgggtggattaactaatgcagtgctgaggaccaccctcagctcatgtgtatgttaggcaagaaaagagcacatgagcccatatgtaaaggaacatcctgggcttgcacaacagacattcccttggctacattctttcctgttgacggccaaaagcgcattcctaagatccggctctcctcaaactgccataaaaacaggagatttcgggaaatgtccacaaaggagaagaaacccagtaaagctccctctagaaactggattagtttagtgataaggtggggttccaaagggctattagataagaggctacctaactaaaataagcaactcttttcaactccacattccactgaagaaggccattggtagcttggcctgggcctttgtaggaataagtacaccataaaaatgggcaactaatataaattacgactttctttctaagagtggacgcctactactactagaaaaaaataaaaaaagaatcaggcatggcgccatctttaatcccagcctaggcaagctgatctttgtgaatttgaagtcagcctggtctacaaagtgatttccaggacttggtttccagcaccacagaaaccctgtcttgaaaaaccaaaaaggaagagagagagagacagagagagacagagagaggacacctgctatgcctattgatcttttccatttacatcatccatagttatggtcttctaatcctaataaccctatctcccacccacttgtgcctctcatttctaaatttttattttgctctacagatttacagtaggcccactcatatgatggaaagtggaaagtgggttacaactgtacaaattaaatccaaacatcagatgattttacaacagaacaaaggaagtccaaccccactttccattgtccttctcaggacaggtcaaagctactgaaaacctactgtgcccaggtgcttcaaatggattttctctttcatgttttgtaaccactctaggacctggtgacacaaggctctaagtagaaggctaaaggaaacattagggcagagcagaatctgaagcctaaatcccgcatttttaatcacttcactgctctgttaccaatgcatttatcaggcatcggggtaatcagcaggactgtgtgggaagacagaaagtgcttggggactgctgtcctcccttgcccagcctcaggctcattatacttcagacagcgtgtggcgagagtgctgaggaaaaaaagccagctgacgcgtgggattgccaagcaacagcttatgaaacgaattcaaaccatggcaaccaaacactgcaggcccagcaatagcttcatttcatttacaagagtgagaggagggctttatcaacaacagatgagataaacgagcgggctactggctccgcaagcacacggagttgtcctcgtcaccactgccaccattatttcccagcacacaaagccaaattatctatgaaaattattccttaacacaaatccagaattcagctccatattatgttatagaaactgtaatgtacacatattcttgaagggagggtgaagtaccaactaccttaaatctcacctaattactctttatttaatagagctattcatttgtaggaggaagacaagtaacacatgaagatgtcttatttaaaaatcaatttctgcagaaagcactttcaaattctttctacccaataatgctgttctctgggtatttttttttccactccataggcaagaatagtatggtgtggagattgcaaacgtgtcttcatagggcacacagctaataaaacgcacatcatgattccctcctgctaaaaccctttatgtatcagaacggtctgataatcatatcatacgccacctcctctcccttaaaaacggtacccacaaacaccatttagtacagtcccaggggcttgtcattcagagagacactttttgccctggtgtgcacctatgcagctcaggtgggcttttaaccatgttagacagcactcctaggtcatttttattttattttttctctagtgtgcatgggtaacgtccccgaaatacagagtgctgttacattaggagtcgcaaagtattactggtgctagaagagactacatgtcactgagttagttgttttaacctgtcctgattctcatgcctcactttttagtcttaaccaggctctcttccaccaaaaaaattggaagaacctgacatctctcgtggaggacagctgaccctagaacacattgttctgattgtaggtgtgttgaaacattctgctgatttgtgatctagatattgtgcctttcttacaggagaactcgtgactattctagcagtgggaaaaggggaatcttcatttgcaagccaccatcaaggcagtggagtgtggattcaagtcgattttgctgaggactcttagacaaattgttgctccttacaaacatggtgtgtgcctctggtttccaatggtttccactccatcacatccatgttggcctttcatgagcaccacagattacctttactttctcaatctctatgttcagatgaaaagataactgagtggaaatcggagacccccccacccaggatacactattatggtatttggagatgaaaaggaacccaaatccattatggagaaagaaaagaaaaggagggagagagggaggcagggaggcagggagacagggaggcagggaggcagggagacagggaggcagggaggcagggaggcagggaggcagggaggcagggaggcagggatggaggagtggagggaaggagggaagagattccctttaatgtttcaatgtagtctgaaatgctgattgaatcccttagccttgaatgctgtcatcagtatcccggctcccgataagctctctcttctgtgtaggatgttcatcttgtctgggatggctccaaaccctttgcaggccacatatatctctatgcctctctataggtccttatttctttgaattcaaaaggcctaaattcttataacttttttttaatgcagttctattttacaaatgtccttttggaacttaaaacttgggatctctgattctattagagcatctgctaaaatatctctattctgagtcaggaaccttaggcctgttgtgactgtagcaggcctggggtagaaggacaagctggaggcagaggtgacacccaaaggttaagaattcacaatagcataccttcataagatgaaagagaagtaagttttttttttcataaggtgataagcattcacgaaatgccaaagcaaccagggtcagtggcaccaccaagaatctgagtaagaccctgtctcaagcagaaagggccttctgattcttctctggaagggagtttcatgtagaaatagagaagtctagatctccatgtaggaatagggaactctactcttggatttacagatgctgcagcacctagcacaccagccattctgatccgaaagcgattatcttacacgtgccttatatgcattctctcatttaaatctatgaaacagtaagatcacgcttggaaatatcagagaagatcaaacttacaaaaacaagttgctcatggcacatagctaagaatttttagtagactatttatcttctaccagtccctatgctaataataaccatcatcatgtaaccatttcctcaaccttccctcctaactggattttgaagggagaataaacagcattgcccagtctcaaagtgagaatgtgtatgtcatactggaatctgggaataaggtgtttttgtgggctgagccctgggtccaagtttctattaagtcaatacatagcacccatctttctttccatacatatggatatgcagaagacttgccacaacagcctcaaaaccattaccttttgaaatgtgccctttcttgggtccccactcaaagctgtttgcaactcaatccccagatcctgttgctcccaatggcagaagagattttgaagatgtaattaaagttatgggatttcagatggaagaattatcgggctcatctgagtgggcccagtctactcacataaattcatgaaggtgggagaccctttcccaggggagactagagagatgagatctgagaaacactcaatattctggttttgaatttgaagatgaagctgcaagttaaggagtgtggtggcctctagaagctgagattagagtggctggtgtgccaagcactgcagcctctgtaaaaccaagactagaattccctattcctacatagaaatctaggcttctctattcctacatagagatctagaggtctctattgctgcagggagcttcctttcagaggagaaataagagaagaatcagaaggccatttttagggcctcccttgcttattgataaggaaatagacttttggcctataatcccaaaagagttgaattctgacaaacaacctaagcaaacaggaactggaggcctagcccatcagacaggaccttggccctatcaacacctgcattctaacccaaggttaccttcctgacctgctggactctaagatgataacactgtataccttaagcctctgggtttgaggtaattgaaaatagtttggttaacatagattttgtttgtggtttttaaagacagggtatcatagctcaggcaggccttagattcatagtccacctgacccagctgcccagattctggggttagaagcacatgcttgggataatttattaaagcagaaattcaaaaggaatatggcacccgacatgttatttgtacaaaccatgtagcctacaatgcttgctttcttctgagagcctgaaatttggtgcgtgataggcagtggttgttcagtaagcagtctccaggaacaaccgtgtgctctaagctttcttggataaaatataccacctatgtagtgtgcattttattcttaagaaagggtatattagtatgtcccctcaacagaggaaaagtccatgaggaagcctgtgcatagatctctccaggcccgaagtagttgcccccattggccttattggacatccttttgctataataaaacctgagtcatgaatgcaaagatacactgagtcctatgagtctgtctagcaaatacactgaatatgtgggctgtcttgagtcccctatttcagtgccctctgctaggaatctaagctaaggtatactccccatagactccctgtatcctctcccatcccaggcctctagctagtcaccagagatgcacccccctcaggcttccattcttactcccaggcctttctcaccccccttctccccacatctgatcgtcatccctgttcccctcctcgcctcctctcctacccagttccctctctccatccacctatttagtttccccttctgagtaagactcgcacatcctccctcaggacctccttattacccagtttctttgggcctgtagattgtagcatggttatcctgcatttaatgtccacttataagtgagtacataccatgcgtgtccttctggctctgggttatctcactcaggatgagattctcaagttccatccatttaaaataatgagatcacaggccacatttcaagtgaccagtaagttccaaaccgttacagtatataatatctgaaggagactttatgttctatgtctcacttggggttagtgacagaggcatgagacgcaagcatgattggctttcttgttgctaagcaacagtgattttttttcttcccccccagaacaggaaccgagtgcaaacaggaagtgccatgttccaccaaagctccactggctccctctagtggccatttagcagtcacagacaaagctagagataaggtacttgctcaaatgccaaggctgcaggcaagctcaaccatcccccctggatattaagttcaatgccaacaggatttcagatgcagcaataccaaagctagaatgattcatctcttcctcctgaaaacatgtcctgagagcagaactggccctagaaaacatctggctgcatagaagtatcagaatggagacactgactgtggaagagagaaagacctctctctggaaagggagggagtcagaagccctatgggaaactgtagattataagactggggctgcctctagatttcccttagttaacaagacaccaaaacaacactccttaggcttctcttgagattaggggcctgaaatgtcaataaaaatatacacgttcaaggcaatgaccaacttagtttgttcatgaggcactgagctacgtaatacaatggtaaattagacagcatgatccatactccagtggagaccctagtccaaaaacaaccctcccatttgttaacacattacctacccagaaaatagcttaaatgtaacctaaccaaaaattaggcagctctagattcccaggtgtgcctgggccatacatctctcaagcctactgttgttgggagagctggatctgggaaaggaagacaagatctgaagtactcatggttccctgccttacccaagcatttctcaacagtccttgtaattttttcagaaatccttccattcagagtcctgcctccctcggatggaaacccaagcttagcctaggggaaggactatgccctagtaggttctactgattggatgctcttccatacaactttggctcatgaggaaaacaagaactgcctggcagaagccatgccccatggatgtgatagaccatgaccaagggacagtaaggattagaatcaactaagatttatttatcttatgtgtttgagtgtttagctcacatacatttctgcgcagggacactggttttccttccttaggtaacaaggtagacgacagatgatatagatgatagatggcatgggtatgtgtgtgtgcacgcccctccccctcgacctattagggagctcaaagaaacttgtagctggctagaaatctgatttagagactaagtagtagaaacatgtatgttccctcttcttgtccgcatggacactgctgtggttgagttccgaactatgtctctagaacatccacaacatctacttgtggaaactaacacttggaggtgggaagatgcataaatagttgagagcacttaattctcacagagggtctgggttcaattcctaagacccacgtggtggtccataactcacgttcgggggggggggatcgatccaatgcccctcttgtaacctctgtagtcaccagcacgaacaccttacacgcgcgcgcgcgcacgcacacacacacgcgcgcacacacgcacacacacgcacattttaccttctttaagtaccgggggcaggggggaggggggagtttccccgtgtgctcgtgcacgcgcgcacgcacgcacgcgtagggaatgtaagtaaagcgtctagacaataaggacctaaaatgaaagagccataagctacctacttacgtttttatttctcagttctccaagttccaaatcatccggcccactaaggtccaaacttggaggaagctcgagtctctgcttattaacacgtgtcgcggcacggctgacttgtgcgtcaccaaccacaaggtggcgaaagagattatcacatcaaaccagcctgccttctgcctcttctataccattattttgctaagcagaagcatttcctgagcgtgagtcattcaatgagcacagtggtcctatggattgtggccctatggattagctatgatttcacagatgagcaaaccaagagctgcagatacctgtggagtttggctgttacctatttttagtactgcatctgcatttacaccagcgtcaccacacacatatgagtactgtagtgttacttatttggcaattgctctgccatcttttggcaataagaatttatttcatcctcatcacagtcttacaggatcaccatcatatatgtggtctgttgatcaaacatcatcatacaacacatgactatatgtttctatatgttatctatgtttttacttaaaggttttttattatgaaagaaactgtattcctggtaacaactttcaaattataataatgagtaaaaagtctcctttcttcccattagaactagtcaaaagcgtaactcctcacatattccttcataatttgtttacaaatacataagcatacttcatatgtttatcttacaatgcacacaaatatattgtacacactgttctacagcttgctttttctaattaggacagtatcttgatagcagatgtgagctgaggccacactggcctgtggacctcatttacagatctggagtaggacgtgactgtcctcacctgagaacagcaagtgtgtcacctgatatattgcagcctgaggtgacaatgaaatgtggaagaagagagcggactctctgcagcagcaagaaagcgtggtgaggtgtaaggcaagcctgttaatgggcagcaagtgggactggtccccatctctggtatattcaggtccttaagctatagttttgagaaagttcagatttggatacaggcaatgttcacagtgcctttggggacagggcacctctttacaccaccgcacagtgccaacgtgtggaaaccctgtggggtagtaattggtagcattttaaaggtgacaaaattgagactcaaagaggacaaggctcccaaggctaccctacttgaagcagcacctccccttacctaccttgtcagtacttacaggaccctggggaactattggctattggtagactctggaagaccggatatcattatcttcagatatgtacccactagggaagccagccaggtccagtgcataactccacagttacagtcacataagcaaccctttttaaactgagtatgtcacaaaacaagaagccatgagtgtaggaaagggaggacaggggtgagagagagacaagaaagtaaggattagagcagtcagaatccatatatataaacatatatgacattattacagaacaaacttaatttataaaaaacattaaaaacacccacataaaattaacctaagaaaatcaaagatacagattttacttcttggtgcctaaatatcaagtaattttttaaaaaccaatcctagaaaactgttttttgtttgtttgtttgtttgtttgtttgttttaattagcaacaaatggttagcagtgaatgtaattgtctgactctatgattactactcagaaaagttaaataactcatgtactttaaaaaagaaattgaaagggaaaaggatggacctggacattgttttgttaagtgaggtgatccagattcagaaaggaagaggcaggcggatttctgagttcaaagccagcttggtctacagagcaagttccaggaagtcagccaagcagagaaaccctgtctcggggagaaaaaagaagagaaagaaaagaagacaggcaggcaggcaggcgggcagtgaaatactggatgttctctctcatgtacagatgtgtgtgtgtgtgtgtgtgtgtgtgtgtgtgtgtgtgtgtgtgtgttgtgtgatatgaaactagaaaggagacaaaaggggagaaagaaggtgttgatggaggtgttgatgaggggagagaacaaaaatagaagacatgacatggcatggaagcaggaaggaggctgagagggtaggagaggcaaggggacggggaggagagaaggaagaccagcataaacaaattatgctcaaaaataccatagcaaaccaaatactttgaataataaaatgaaataaaaagaaattaaaaagaaataaacctgccccaaaagatggttttcagcaactattcatatatatatatatatgtatatatatatacatataatatatatatacctttttgtacagagtaaacattgaaaaaatgtttgtatgacaaatacttatttaaaactatatttaccacctctaacattaaactaaatttacatccattaacatatattttggatttattcatctttataattgtagactctctattactacatggcaattatagggcttctaaaacatgaagtagcactgttttagaaaatccatactgaattgctaaggggataaagggctgattcttgttgatattgaacgtggcaatcagtgtctggagcttggaagaagataagagcaaacaaggagtattttattaatacaatgacccaaagacactagtatatatatggtgtgacataaataatcacaaattaatctgtgcaggtttttctcagtctctgccgtgtatgtgctttcaaagcacttgctccgggatgcaggtgcagcccacactttgcttacctagtctggagacaaaggctgagctcagtcctcaccatgacaaaacattggtttccttaagttgctcttcctacggaaaaataatctaagaaaagacttaactgcaaggaccagtgatttggaagtcattttaatatcacctgggatatttcttagtggtcatgacaggaaaaacacagggaccacagcagagatgtccggatatttattagaatgtaaggctcctgcctcactacctcattcatggagtccagttttctgccaatcaacaaggaagtcttttgtacaacacatgtaccctcattcggagctatattggtttttcaatttgcttgtttgtttagaaaaaataagcatatgccaaaggaaataaaatattgagaagagatgagagaaggcaaaagagaccttaagggggaggggtggagaagataacagaacatgggtgatttgaaaatacagagagggtgggggatagtggaggtagaagtgtttaagtggagatgggcaactgggagatgagaagaggaagggatgcgacaggatcggtaactatgaaatgtcataaggaagcctgacactttgaaagctaaatgttttaatgtaaagcaaacaagcaaacaaaaaaacacacacagtcacaagttgtaagacccaattgtaagacccttgaccagtttgacttcctgttttccaatcacatgggacaaagctatttgtaaagagctttgtttctcttaaagtgagttctggggaagtgactctcgagaatgagtgttttagaaagagactttcctaacaagattaaattcacagctagagtcttcatttattgtgtttgggtccgatcctctcttcatttctttttctttttaaaatcttaacaaagtccctccatatagctcagacatgccttgaacttggtatgtatggtagcccaaactgaccccgatcctcttaaatgctaggattacagagccaccacatctggcacaactgaattctattataaaggaattttgtcatacataatcaggcccatcaatttcattcccacacactaggtctccactgagggccccagactttgtctctatgtctctcagctactgctccagtgccacgccttggtcatggcgtcttcacagcaatagaaaagtaactaaggccgaattcttccactgagctacatcctggttaaaatatttcaaaagcactccaaggaaaccccactcatactgcattcaagagccttgcaatcatgttgaaacctccgcttctgttttaggaggtctttctccagcaacagctcagacggcttataccagctttgtcagtattcaccatagcagtaataaacctcagcgaactgtgaaggccctcacctacagtcactgtggatggccttacccatcttgtagctctgggatggagaagggcactttgcactcagcaaacacttctgatttacagaaagggggctgtgcgcatttgggtgtttggggtttattattggtgcgtccaagaggtttgtaatcgattgctagaactagaagctgtgtgcaatcatattggctatgtaagaaaggctgttcctcctccttcctggatcagtcttcggaaacgcccctcttccatgctgcccccatttagactgcaactttgaacttttaggtaagcgtgttccatatgtcctgttattatcatagagtgggatgtgctggtagcactaaaagcacatacaccagtggccttctaggtcaagacactagacacctagaaggtgactggagagttacttctgaggtcccagtcctccaggttgggattcctaaggctgtaagtctttgctcattcagcagctgggagacagttgaagagttccaggacagagactttgaagaactgtcgaaggtgagagaccacagagctgagtaggacactaccaacccaggttactggaagtttcaaagagctgcccagagttaagttctagtctcctacacccagagcttaaagctataacactagctcccagatactaggacactgacattaagagtctagtgccctcagtcactgacttgagtttgggtataagtatttgaaagcttagaacgacaagtccctagttttcaatgcctaaaagcatttctttggaaactcagagcaatcaattaagcctttgactctgagaatttgaagttatacgtcctattctcctttggttggttgcttttgatttgattcttgtttgtttgtttatttgtttttgagtcagggtctctatgtagtcctgcctgtcctgaaactcactatatggaccaggatggcctcaaacttatctacctgcctctgcctcccaagtgctaagattaaaagtgtacaccacgtttggatttatggcattcttaaactcatgagaggtaatttggtcctcagtagaatgtaggatgattattaggatatcctctggtgccagtttcacccactgcttgccatcggcatatttggcagctttcttaagcagcaagtcagattcacacttggcacattgaaagagggagcctcaccctcttttagtcatactattagctccccattgagttcagggatggcctcgtgcactgccatggtagcgtataaagttctcagctgccacatgatcatcgtgctgcagtttctttgaggatggcagtcttcttgggtggcagtgatggcggggattgtgactagaagtccttccatgatgctgtggcgtaaccctggaagagtgctaaacagtttctggtacaggagacactgaagaccatcttgtatagttctaatggttcgtatagttctaatggttcgtgcccatcataaatacaggggtatccaaaaaggcagacataaattgtctttttgcaccacgctttgagtgagccccaatttccccaaccttggtgcagaaaccagtgccacaacatagtcaatactaacaccacacgtgcgtgcgtgcgtgcgtgcgtgcgcgcgttgttggctctgttaatggacaagctccccagtttctcagccttgactgtgccttgtaacttgccacgggtggaatcatcctggagcatgcagacagggttgttaaggtcaatgaagggaccagtagtggcacaaatagccaatttgtcagagttaaatgcagcgctggtgcccagatgctcgatacagccaaatccatttactcagaccttgacatcacttctcaggaatgtggctggcactgtatgaaaagatgtggctgtctgtcaaacagggagaggcagagagccagcaagcatgctctgttccgcagccaacacgtttctcgtttctcagttctccaagaatgctccagtgaatgaaaggcacccttggggttgtaggtgtcactacatccggtgccttgcaaggagctccgtaggcagtccagtttcacattatcacaaaaggagtggcgttgggggaggtgagggtagcagacaatggctcacttctcaggcttttggtaaacaaaggcaagtgggtatttactctacttcttttccagccacttgacatttctgtctttgcgttcccagggctatccaggtctaagttcacattcttagagagtaagacaggcttccctgaagcagaagtaaaattgccagacaattttccttctcctcctgtcctgagtggataagagacccatacaactatcctgcctagattgtacctaccaaggataattaattacctttagcatcccagcaggtattctcagcctcctgcaactcctcaggtcaaagggctttcacaggttcttactcatttcctgttatcttccccgtgactgtcttcctgaccctgctggtcctctagcagccaccacgtgctctgtgtaagatcaggtttctccaggatactgttcagacaatgaaatgagggcgtgtcacagcctgatgaaatacaaaaggaacccccgtttgcctaaatatacaagccctcctgtgtaacctcattgatgaagcttaggcaacatcagtgcaaagcaaacccgagtgcttccaagttctatttatatcattgtggtgatggctgatactgcttttattttataacacaatatttgctccttacgaataaatcaatccctaaagttggccagccccattgtcttgtcacaagttcagcacatagtgtcacaaagcattcttccaactcgcccttctcctatttcgttacagaaacactttgcacctccacttactggggacagaattcatatgaagaatgaagactgttaggtgtatagtgtcacacacctgtaatcctaactcttgagaggttaagacaggtggatcacaagatcaaagccaacccaggctaagtaatatgttccaggcctggtctgggatacatacaaagatcctgcctaaaaataaatagataaataaaataccgggaaattatgccccgtctaaagtagagcaggtgtcaaggtcgtcaaagctggcagtggactctgggaagacactccagactctccagggggcaaacatgggatctgctaccaaagctgcacaggcaggaggctgtgtcgtgttatgttagatgacctgaggcctccttttcaacagctgagagacgtgaaagctctcagatagaggagccaagggaacatagagacatgttgtgcatacactgtattaaaagagttattgatgccatggatagacagatgggcaacagtgtgttggtgctctgaggagaccttaggtcccagaatcagagaaaggcagtatgttgggggctctgaagaaaggaagtgagggctcacaaagcagaagtggtaatgcttcttatacctctcacagctcaagcccatagccagagtctctgatcccctggcaggcagcagaaaaggggatgtggatcaggatgtgtgaccaccaataccctgttagtgtaagcatgcttttccgggtaagaaaccctggcatatgagagtcagtctgagattcacacttgtctcagtagagtgcccatcaagtgtttgtgaagggggaaggactgctaagggaaagatactgtggcttgggcagcagttggcttctaacagtacatgtttatgaggagaggtaagaccaggattttgacagacgccctggaaggcaaagagggagaggggccatggctaggcaataatggtggagaatttccaagatggctgacttcttcctcactcacctgacttaagacaagcctgacagcttcaagcaaaggctttgtagggttttgtctcccaccagtaggcccctgctgatgctcaacaaactcaaggcctgctcaggacatgtcccacaattgttctgggctatcctagctttcttcaaactgagcacatccaaattaggggaggaaaactctacagaggtttttaaatacttagcccttgagaagagacttcccttagtctagggtatagcctctgtgggtctgtagatatgtccagacctaagagaggcagtgcccccccaaacatacatcccgccactacatttgagggaaattataagcatcagccttggagtgaggtacaactggagtgtaggagagtcacctctgctgagccccaacagcttcatttggaagtttaagagtttagaagaccagagaccaaatgtgaaattgacaattgtcttgtcattaccactgctaccaccaacaccaatgtgtacagagtattggcccttgctaatactagagctgagtactttagtccataggaactggacaagtttcctggactagccatatccacagatagatatggctgctatacatttaaggttaagccagtgtctgcaaccaactatttgagcacctggtcgtagtaatataagccttccaaaagcagaatatatcctggggagttaccttttaaggtaactctccaagccaccaaaactgtaagagctactaaaccagtggtgcaaaggcccacaagtgataccatcctccagaagggtagtttaaatccagaaatattggctgcctgggggcatgaagacatcactctatttagtaatcagaagcagctgatataatacacacagcacacaagtcctacaactccccagtgtggtcagggtagaagctggatggattatggagaatgattgtagactactaagaactaaatgaagtgactctatccatgcatgctggctatggtgccatccaacatggacttgatggagcagttgactctgactttgggtcactaccagtaagtgttggatctggccaacaccttctctgttatcgttccccaggagagtcaggaacaactttatttttatctgagaaggagagaccaagagttagaaagattccctgataggtagactgatatggagactgtactggctggttttgtgtgtcaacttgacacaagctggagttatcagagagaaaggagcttcagttggggaaatgcctccatgagatccagctataagacattttctcagtgatcaagcaggaggagggccccttgtgggtgggaccatctctgggatggtagtcttgggttctacagaaagcaagctgagcaagccaggggaagcaagccagtaaagaacatccctccatggcctctgcatcagctcctgcttcctgacctgcttgagtacttgtcctgacttccttggtgatgaacagtagtatggaagtgtaacctaaataaaccctttcctccccaactgcttcttggtcatgatgtttgtgcaggaatagaaaccctgtctaagacaaattggtaccagcatagtggggtattcctgtgacaacctgaccatgttttggggaggactgtggaaggactttggaacttcaggctagaagatccattcagtgttacgagctctgtcgaatgttgtgtaggaggttggaagataatgttgagaacagtgcagaagatggacgcctggtttgtgaaatttcagaaggaagattaaagactcttttcagggccattgctattttgattatgaagattctgtggttctggttagctggagctgaagaatcagctgtgattaacaagataccagaactactaaagtgaaaacttagcattactgggactattgatgctggttagctggagctaagaaattggtggtgattaagaagagaccagcatcattgaggtgacatcttctgggaagtgttttctgagagcacaaagaggatgtgttccggagatagccaaagttgtacctcatgcagcagcaggacttggtaatgtgtaagagtcacccaggtggtactggttttgaaggcatgaaggggtcatgcagagcagctgaggctcagcactgtgagaggccacggaaagccattggtgaaggtgcagtctcagttgcaattgatggcccaggacagaaaggagtcatgcaaaggaattgaggcttggcaccgtgaagagagcttatgagaggctgttggtgaagcctagttacagcggaagacaacagtgttttgaagatgccagtatcatgagatgaccaccaagaacagcagcagcagtggagtacaggcagctggagcctagaagacaagctgtgtgctacaaagggcagggctacaaaagtgacccaagcccttggaggagcccagaagatcatgagtggatcccagacattggacggttggagcttgattcgcttttgattgtgactgtgccctgatatttttccctcttgaagaaagaaggtattttagtggagctcacaattaagagtctttgaattttaaaaaacattgaattttaaaagatactggatattttaaagggattgaacttttaatatgtaaagactgtgggacttttaaagttattgagatcttggggatgaataagaaagtgagggttgctgggcgtggtggcgcacgcctttaatcccagcacttggaaggcagaggcagctggatttctgagttcaaggccagcctggtctataaagtgagttccaggacagccagggatatacagagaaaccctgtctcaaaacaaacaaacaaacaaacaaacaaacaaacaaaaaagtgagggttgaggcttaatagtgatgtgtttgtgtggtcaattgtactggctggttttgtgtgtcaacttgacacaagctggagttatcacagggaaaggagccttccttgaggaaatgcctccatgagatccagctgtaaggcattttctcagttagtgatggggggtggtgcccattgtgggtggtgccatccctgggctggtagtcttgggttctataagaaagcaggctgagcaagccaggggaagcaagccagtaaggaacatccctccatggcctctgcatcagctcctgcttcctgacctgcttgagttccagtcctgacttccttggtgatgaacagcaatgtggaaatgtaagctgaataaaccctttcctccccaacttgcctcttggtcatgatgtttgtgcaggaatagaaaccctgactaagacagagaccatggctaggtactatcaagaggccttcttcctcaccctgcagcttaaaacaaaggccttgtggtttttttctcctgccagtagccccccaccccaccccttcatatggactggctcaacaattttgtggtcagatcagtaccggttacacaatagttgtgggctaatcagtcaccctgtctttcttcaaactgaccaaccttaaattagggtagggaaactcttcagaggcttaaaaaaacaaccctcaagaagagactggattttcaacttcatgagtcactgtcatcctgcccaccccccactctccattccccacccccacccggaggaggttctttttctctgtgtcctgaccttggcggctgattctgtcccctcctgtttgctgtgtttgagatttcactgctgctttctacctatcaagttcaagatttgtcctgccttttaattctttaactggcggagaaaacaaacatgtcaagacctctagacaatagccaaaaaaagtgaacaatgaacatctgtcattttgccactgtggaatctacatagcccccaccatttgtcatactttggtgactcggaatttgggttcctggaaatggcctaaggcagtcccattgtatcattatattgataatatcacataagcctctggttctcttgcagatttgatagctgtgagtcggagagctgtgctgggatcctagggatggggagggagcaactgccaagtttgggagcctggtttatctgtcaaattcttgtgaaattatctggataagactaaaactaccccagcagctgtttggcaaggctaaatcacacatactctcaactgatgatgggcaagcaattggaaaccttcgtgagatagttgggttattggagagtgttcaaccctcatctggcccagttactgagtcctctgcaactgtgtaaaagcactgtgtccagatgcttagtactatagttgagtggttctcaccaggagacaagggaaaaatttttgtaggtattgttgttgtgcttttcaaattttaaaaactttttattggtttgttgtgaatttcccatcatgcaccccaatccctctcatctccctgcccttccatatctgccttcaacccctctaaagaaaacaaaaataaataaacaagcaaatagataaaccatctcaccatggaaactgcagtatgtcccagtgtgtcccatggtatacaccctttcacctacacagcttgacttgcaaatgtgcattgcagtgagtcactggtctgctcgaaggcttctgctatcagcactgggtccgcaccaggcctcctctcagctatccttgctttggttctgcaggaccagccccttcacttgctccagcagctcatggatggggcaaatgttgaagtgggccaactcaaagcccaggatctgggttcaatggccagccctcacatggcagctcatagctgtctgtaactgcagtgctggggcttctgacaccctcacacagacacatatgcaggcaaaacatcagtgcacatagctgttaagttgacccatgccagatatccagggacccataagaaggtaataaatgtgactgttaagaaattcattatgtaaatagttctggcaaggagccacttttgtgtgattctgtatgggcacatgctcttgcctgcaatgaataaagtacatggcatctgtcagcaattctgcacatctttaatgtcccaacccctcccaacccttggtccctggctcccatctcaaccccatagcctcccccaccacacacaaatgaataagtaaattcaattttaaaaattaaggagaccaaacaagaaacgttgtatcaattcctgcacagcacctgtgtttgatagttttaagtcaacttggcataggcaagagtcatcagagaggagggaacctcagttgagaaaatgcctccaaaagatcacactgcaagcaagagtgtgagggcattttcttaattaatgattgatgggggagggccattgtgggtggtgtcatctccgggctggaggtcctgagttctatagcaaagcaagccttggggagcaagctagtaagcagcaccccctcataatctctgtatcagctcccacctccaggttcctgccctgtttgcatttctgtccgaacttcctttgatgatgaacagttttatggatgtgtaagccaaataaaccctttcctcccaaacctgcctttagtaatggtgtttcatcgcagcaatagaaatcctaagacacaaaatgtgggctagcatgagactgtgaacctcttagatcactcagtcaaaggtagtcactacctacttacaaactctccatatgggtaccactaggctcacacagaaaatccagaaaagttcctccgtggaactggcaaaaggatagcagttgctattgccaaagtccctcaaactcatatgccctgtgatggcttagcttggttatcaatttgacatagctaccctctcccgcctcctcccatacactcgctctgctttagaccccttccactttgattttgagcaatgtctttacatatcattttagtgattgatctagaaataatatgtaactaagtgacaggtagccatacgttttttcaaattatattttcaatcaatgcgttatcacaatttgaaatgtacaaatctttacactttacggggtgtaaatgtgggtgcagcatttaaataactagaaagggaatcgagagaaagtgaagctagctgataaggaaaggctctgtgcttcccaattttaaatgtgacatatcagcagatcagttttcaaggtgttgggactataaaactgtagccaattcgtgtcccaacgatcctactggaatcatctggggtcccatactctggctgtggagccactggttgtttgagagtctctgttctggagtttgatccttgcggagttggaggtctgaattcagactacagggtctttggactctctatgctctgtgacccaagtgtttaatattaactctgatggatttgttgatctgtgtgcagtgtagggtctctgatgtgttcaaaactttacacagtaaggtttgaagttaaggtcattctgagtttgcattgagaatgtttaagtctcggtgtctgagtctgacacattaaagtgtctttgctcatggtgaaagatttctgcagtctgcagaagtccatttccaaatgtggaagtgtcccatgtttaagggtctacaatcactgtgtgaggtctctgtgccaggaattaagactgaattatttgggggcctttgttcaggaataatactgccaaagttttccatttctgttccaacgttttaatcctaaggattagaaggcctgggttcagatgtgtggcctttgaatttttagaggatctaaatcccatatttgttcctgggtctttgctaactaagtgaattcttcgcggtctttgttgtatgtctcttgcctgaggtatttggaagttcacgttcagagagccatacattgtacagtatcagtctgggatacacatgactgtggcctctgcctcctaaatctttcaaggctagtccagcggtctgagtcttgggtaaattggtgatttgtgttcagggcacaaaatctaaaattttcagaatctaccttctaatatttgaacccgagctaattgaaagtgaatgtgaattctaaaattagaaactatatctcaagttctaaagagatcagatagttctattctgcatttagaatgaaacttttgaaatgtttaaatttttgtgtgagttagacctccctgttgaaaatgtgagattgctaacttctgaaaatttgttcaaaatttgactctaagatatttgagagtctattttctagattaaaggggcggggtgaagggctgggtgtctatactgtgtttgtgcatcgctgatggtgtgcagtttgaaatcttggagtgcctgtgttccagagtttagattaaatgtattcggtgtcagggttcaagctgtgaactgtctggaattttgtggaagttgtttcccattaatcccattaatgtttgttcctaaatatgagtttatcatgtaaggtttctgaataactgaagtgctgggtttctctttgtttggttgtctatttttaataggttgggagtctaggcaggagctgcaatcattgaggctgagatggtgaagtctgaattcagaccttaagcctttcaatcctacaacagtacaacagtctctatggtagagatggagactcctatgcgtgtggggtaatgttaaggctatgagtgggttttccgaaacctttgagaataactgtgttctgtgtcacagtattcgaggtcagtgttaaggctttttttttttttttttttaagatttctttctttctttctttctttcttttattttattttattattttttttttttttggttttctgaggcagggtttctctgtatagctctggctgtcctggaactcactttgtagacgaggctggcctcgaactcagaaatcctcctgcctccagagtgctgggattaaaagcgtgcaccaccacgcccagcagatttctctttttttaattaattaattattttttctttttcttttattagatattttctttatttacatttcaaatgttatcccctttcctagtctcccctctaaaaatcccctatctcccccccttccccctgctccccaacccacccactcccattccctttttttttttttttttggtttttcgagacagggtttctctgcatagccctggctgtcctggaactcactttgtagaccaggctggcctcgaactcagaaatcctcctgcctctgcctcccgagtgctgggattaaaggtgtgtgccaccatgcccggctcagatgcaaatattataagcttgtcaatgaatccatatatcaaatcactggcattcacaagtatgtattcaagttgtgactcttttaatattcttttttaatattcttttgagaatttcatacacccatctaatatatttttattatagctagcctactccactccaactcttccctgatctcccttaccacacccctccaacatcccggggatttctctgctttaaataacccactgagtccaactagtgctccatgcatgagcataaagctggccatcctttggaacatgggtaccctaccagggtagacacctatggagagaagtgagcctccctaccccaatggccatcaacagccgggagctctttgttaagggtgaggcctcatgatccccttccccatccatgcttgactgagttgaacttgtacagttcctgtgtagccagagctgaggtgagtccgtaagtgcaggagccactgccacacagcagacagttcagaaacctctggctctgcctccttttctgcaaagttacctgagctgtggggaaaggggctatgaactagatatccatgtccaaaagagcactccacaggcattcattgcaaataaccttgattagttgtgagtttctatgctaaccattgtttactgcacaaagaaagctctttcatgaggactaagagcctgaaatgtactcttaaagtgtgtgtcacaaggttggaatctaacatgattgggagatcttttaaagggcataaggttgtttgacttctttgaagatttgtttcctaagtatgcttctgagtttatttttacgattatatactaattatacatattattggtattaagtatggtctttccgtgcatgcatatagcattcactgaaaatatacaaccatttctctttctatatcctcctacccttcgcaattcctagtaacaactattcttttaggttgacaatttttatttttcacatgagaaaaaacatggtgcccatctttcagtgtctggcttacttttctcggggctaaatggatggctttgttttgtgtggtgctggtgatcaaacccaggaccttgcacatgctaggccagcattctgtcactagataacattccgctgtgtttctctcccacattttctttatttgtttccctgtttatgagtagctaggctgaccccagatcttaactataatgaattgtaccacagtaaacacagatatgcagatatctctttggaatgctgacttcatttcctttcaatgtatgtttacaaattgctggatcccatggtggttctattttttccatttgagacgcctctgttctgtttgtcatatggctgtcctagctcatatttgcaccagtggtctatgagaggtccttcccccaccccacatcctcatcagcatttacttaaaaagtaataatagcctttctgtgatggaatttcactgttgttctttttttattagatactttctttatttacatttcaaatgttacccctttcctagtttcctctccgaaaatctcctatccccgcccctcgccctgctccccaacccacccactcccacttcctggcccaggtattcccctacactggggcatagagccttcacaggaccaagggccttctctcctattgatgacggactaggccctccttgctacatatgcacctagagccatgagtcccaccatgtgttttctttgattggtggtatagtcccagggagctctagggttactgattagttcatattgttgttcctcctatggggctgcaaaccccttcaactccttgggtactttctctaactccttcactggggaccctgtgctctgcccaatggatgactgtgagcatccacttctgtatttatcaggcactggcagagcctctcaggagacagctatatcaggctcctgtcagcaagctcttgttggcatctgcaatagtgtctgggtttgatggttgcttatgggatggatccccaggtggggcagtttctggatgatcattccttcagtctctgctccacactttgtctctgtgactccttccatgggtattttgttcccccttctaagaaggatcaaagtatccacactttagtcttccttcttgagtttcatgtgttttgcaaattgtatcttgggtattctgagcttctgggctaatatccactcatcagtgttcactgttgttcttatgtgctaaacatgaaagctaccaatactgcacaattatcgtgcatcctttggcaagttgtatttttttctttttagaaatgtctattcagatcacttgcctatttaattggatacttggagttttgttgattatttttacttctttatattttctgggtattaacactccatcagataaatagtgggcaaacagtcctagtttgtaggttgtttcgtcattttgttgattattttctttgttataggcagaagctttgtaatttgagtaatctcatttggtaattaaaaaaaaatcatggcccatcttggtgtgtttctattatgtgtttctcccccctccccccggagtgtcacagctttcatttaagtttttgatctacattgaattgatttgggggcaggaagagatggggtcaagtttactcatctgcatgtggctatttcatcctccaccccgcccccagcatcatttgttgaagatgctgtactctctgaaatgtatatattttgacaccttaggtttttgctttgttttattatttcatttcatgttttgtagtgctgggggtggaatacagggccttgtgcacatatgcaattgttctagagttttatttctccttttatttttatctttctttctttcttttgtctttgaacaagattttatttagcccaggcctcagactttctatgtagtcacagatcacatagaactcctcgtcctcttgtctctacctcctaagtgctgggattacatgtatacactgacacacagagcttgatttttttgttcaattatttttcccatgagcataatatattcattataaatggtactgaatgtcataaagacaatttcatatacatgtgtaccatatactttcagcatattcttccccatcaaaccctgccttcctctctatctcctgttactcacctttcttccctagacagtttcaattctacttccatgttttgacgtctgttttgaaatttaattggctgtaggcacatgacttcatttcagggatctgcatccttggttaagtttatgccaaattaaaaaaaaaaaactattgtgaatgaattgctcacataatctgtttccaagcaaattggctactaatttttgtatattgctacctaactgagtttgcttaccagttctaatagtcttttgattgaatccatgtgcagaatcatcatctgcaagcaggaataatttgatttcctcccctcttgtttgtatgccttctgtttctttctcttgcttaattgctcttattaaaacgtctggtagtatgttgaaggaagtcagtgagaacagacacgttcgtcatgttcttgatcttagaagaaatactttgcattttccctattcagcagaaggttgactttgagttccttgtacttccattttactaacttgaggttcaatttttctgtgcctaattttttcagggctatcatacagaatggcatattttactgaatgttttttcggcatctattgagattatcatataattttaatcctgaattctgttgacttaatgtattagatttattgatttggatatgtcgatgttgcatcaccagaatgaagccaacttgatctttcttgagatcctaattaaatttgattctctggtattttgttgaagtttggtgtctatgtttatcagagatactggtctataactttcttttttaaaagatttatctattattatatgtaagtacactgttgctctcttcagacacagcagaagagggcatcagatcccattacagatggttgtgagctgccatgtggttgctgggaattgaactcaggacctctggaagagcagtcagtgctcttaaccattgagccatgtctccagcggggtctataactttctcgtttgttgttttattcttatctggttttgactacagactcgtgctggtctcagaacagctttggaaggcttcctttcctcttggttttatggactacattaagaaaaaggaatggtctttaaaagttcgctaaactgctgcagtgaaactatgttctggacttttctttgttgggggactttttatttctgattctttgtttttaatgatttgatggttaatttggtaaatcatacgtgttcagacatttcttccaagctagcttgttagcaaataggttttcagcataactaactcctaatgatcccttgaatttctgtgctatcagttgtaacatcccctttccttcatctgtaattttagttggattttgtggttttgttctatgttagtctagctaaaaacccatctcatagacagatacatacatacatacatacatacatacatacatagtaaatgtaaaacagtgtttccctgaattctgttagccactctgttgctgtaaaagtgaatatgtaagttaaatatacatcttagggctgaaatagcaagttcagcaacactagggacgattactggaaataaaagggcttgcagctgggtatgaggtagccctgtgaacagataagagaaaggccggggctctgggaaaacaacaaagcttattttgacaggctccagctgcctgaacagagagatcggtgacctttcaccaagtctttcatctaattgcaacagacccaacagtaagtaagaagagcttctgagaaaagcctctactcgttacattcttgttcttaaaggtttggaaaggcaagggacctctaagttaatatgtgatctgcagatgtacttataaggtggactacagtgctaagagtcaccagagcagtaggtgggagagaggggctgattaatgagtgactatttcaggctgtctcagatccaggcaccaggcagccgagcttggttttctcccatgctcctgctggcagcgggactaactgggggctagcttgcctgccgagttctctgctcaggccctgaaggaccctgatatattcataaaatcttcttttaaatccacaatacatcagacacaattactgatgttatggtgtgcttacagacaggagctagcatgactgccctctgagagccccaacaagcagctgaaagagccagaagcagatatttacacccaaccaatggacaaaagcccgggacccctgtggtgaaattagggaaaggctggaaaaagctgaggaggaaggaggagggtgaccccataggaagaccagcagtctcaattaacccggaccccggagatctctccgacactgagctaactatgcagcataccgtagctgatatgaggcccccaacacatatacagcagaggactgcctggtctggcctcagtgagagatgtacctaaccctggaaagacttgaggccccagggaggggggaggacaggtggggcgggggactaggggcatcctcttgaagacaggggaggagaagtgggatgaggaactattggagggcagaccaggaagggcataatgactgggctgtaaaaatgattaaataacaataatgcacaattcaaagcccaccttgtcagtcgtgccttagggaagctccctcggctctccttttcgatggtttgccttgcttagctctgtgcctagcactttgctaagtaagcatttgctcaagccttccatggatcctgggtgaattcattgctc

SEQ ID NO: 247 - DNA, 19374 bp, Mus musculus
gtgtgtagtgggaggcgacgaccgctcctaaggttttggtcgctgtccccgcccccaccagggtgacgcctggcctcctggagcccaaggtgagactaggtgaggcgcagtatagtaagaactctcttaggccaggaggccacttgcgtccctcgccttcaggaccgccgcggggaatccctcctctcccgcatctccggcctccgcctaggtccccgagaagccggcgccggcgggagcagcgcagcgggcgccgggaggggggcagggaggaagccggcgccggaatcacaaagccgcgagcctggccgggcggggacattctcataaaaccgatcctctcaaggcgacagagacagggtacttgctctgcactcagtcctcgatggcctcagcgtcactcgttttccctgctagagcaatagttaccctcactgttggggaaactgaggccagaagcctcaactaccagagagtggccgaaggaaggaacgagagtccagttcgcctaccagtttttcttctgcgcatgctgaggtctccattctagccccgaggctttgtgggcacaccagactggcctacaacccggccccggtagaggggcacccaggtgtgcgggacttaggtgtgctagggacccaggtggctcggaggaagcagctaaatggtccgaaaaaggtctcaaacaccttctctagtattgtgcaaagggatctagggccacacagctccagggtggcggcatggcgcggcctgtcaggtccagcttgttcccggaatacccagccggtcagggcccggagtggaagtggggggaggtgtcgccgagaagccggtctggccggcccggggtctccggttgtgccgagaattacaataacaaagtcccgattgaggtgacaaggctctggatgctctctaggagaacctggaggcttctcccgagggaatctggccagggagagtggagtgtggtgtgtgtgtgcgcgtgtgtatgtgtgtgtgtgcgcgcgctgcggagtgtaatgtgacactgttggtgtaaggtgtgtgtgacaaccagtgttaagatgcttgaagcagtggattctgtttgtgaggcgctgctgtaggttcctctctgctagggtgtgtgctatcaaggcgtgttatgaggcactggattgtatatgtgtgggtgcagtagagaggggcaagcaagacctgtgctgtatatctatgtcctggccaaggagtgggcaaccatttatgttagggtgcgttccttcagcggtatgtgtagggagctaggttttgagcgttcatctggcgaaccgaggcagttacattcgtacaggaaggcacgaggttgtgtttgtgtgtctggcattgctcagtatcacacccgattgtgttgtagctatctatggccacggcttgtgtgtgcccgctgctgatcgtgcaggcgccgaagcagcttctgagctggtgactgtgccccagtgggcgctggtgtgcgggaggtatgtctgtgctcacatatgtacgggtgaatgtatgtgtgtatgtgtctgtgatgtggctcttccaagtgtccgcgacgagctggaagcgcctgagtgagctgagcaaatcgcccaacaagtgtgtgtgtcgtggataacgttcctagcttccctggtcctccggcagcccccggctgagctgagggccttgcgctttcccgaaaccttctccattccgcgcgctcctggagtctctcatccccgcggcttggagcgcgcccgggtgcggacgccggggctggggtccaactcggcaccccctcccttctctcggcttctcgcagtggaccttggaggccagggagccccagccgcaaccccccactcggtgtcccagcggcctccgcctcagtcccggcgcgctgggcatcgactgggccccggtctcctcgctccaccgagcgcccctccctcagctcccgccggccatggccgctctgggccccgagccgccaccgctagatccttacccgcctcggggcagcaccggtcgcccgccccgctgtccgtgagccgccgtcggccccggcgcgggctgcggctctacacggctggggctggcgctgcggttcaggctccggctccggctggctgtgggcgcagcagcccggcggcttcgcgtcctcgccgcgctcccgctccgctagtgtgtgaggcggcagcggcggcggcgacggcggcggagccagcagagagcggagcgcacagccggcccgccccctccctccccctccctcccggcctgcccgccctcctcccgcccccccgccccccacttcggccgggaggtggagcccggaccgatctggtcccgctgggaggggaccctgaccaccgcgtccccaaaacagcaccccctcctcttacgttgccccccacttgcctaaggccgactgcacaggcttccttttcggctcttcaccttacactcatcccacctaagcctccatccaggaccccttcggaattgctctgtcctgcatcaaacacctgtccccgactctgccgcctgggggaagtcaagaaacgggaagtgtctcttctggctctttcttccccggcatcttcccaggggagctgcccctccaggcccacccttttcccagtcagaccccggagtctggctccggagtggccctcccttctctttgcgccccggggaagtccgcccctccccctccggccggagctgtaataggggtgagaatataaaaggaactgtagaaagggttaggggatgggatcttggaggtctacagtgaggactgggatgaaaatccagtgcgaggatgaaatgacgctcctgatgtcagtctgttcgaaggtcccctgatcacctgccctctgggcggtgtagagcttctgccgcacgcttcaggcagtgacttaacacacctcatagagtcaaatgggtctctaccccgtgaagcggctcagtgtcacgacttgtgtcacactcccctcaccgtgccacaagctcccttgccacacactctgcgagtcacacaccgtgtcacacgcagtgtctcacactccaatacttggtttcttgcgttcagctctggctctctggcgccatcttgaggtgcttgagcagcgtgggcactccctctcgttcaggttttggtacccaggctgccaagtgccccaattcagtaggacctcctgcctagttccgcgttagaagccaaggctccatgttccaggtcagacgaatgaggaaggttatctgtagtaaggccaggtgctgtgtatggaaagtgtagtgactgctctctaggtctctgccgtaaccgctggacgccccccccccccatttctgtctctccctcatttttctatctacacctttcttctgtctgtgtttcttctgctttctcctcttcctagcctctgggcctctttatgtgggacattcttcaaggtaggggtgagagctataacttgctgaaggagtgatggagaactgccagagatcttccagagcacccccacccctgactcatctacctttctgatctggaccttctgctcaccctcagccccaggaacccacctggggtgctcaatgggagatgcagaaagggcctgtcatttaagtgtcttctctctgtcccttgcaaagctcatactctccccaccattgaacacggcaccaaaaagcaaatcagtgggccgaagagaagaaatcttccacagaggagctgccccagcctccctgcccccagcatgtgcctgctgcccactgcagcaaaccctcccaggctgcttgctgggagccattcaaaggctcctctgttctcctcctttgctcggggctgagcaggaccagcagccgcagagctgggcaggaaatgctaatctcccagatgttcccctccatcctccctgctccaccaccatcaacccaaaatcctgcaccaactggttggaatagaactgggccaaggcagcaatagtagggtatggtcattattcttccctgcttcatattccttcctactccagttgccagactgtctctgtggggacctgagttgggacaatgtaggtatgagtattggggcttgtttcccacccctgcccccaccccaggaaggcaggcaagagagctgagacttcaaggaggatggtcggggagtagagaaggtagcatctgaagaaggaagccaggctcttggccctgtaccaaactgggaggaggaccagttggcaagtgaagccttgggggaggctcctcaaactgacagtgactgagagtccatctgggactgtgtccagagaatggagcctgggtgatgctgggtatgaaaatggccgggatgcttgctggcatgtgtttacctgggatggtctgtagctaagaggactgggatgtgggagaacctaaaactaatagaaaggctgttgactcaggttgctatgatgctagtgtgcctaggctgaagccagataatcagacgacccaagagactattgtggaactctctctctctctctctctctctctctctctctctctctctctctctctctctgtgtgtgtgtgtgtgtgtgtgtgtgtgtgtgtataccattggtctggaagctgaaggtgtgtggctgatgcacttgagactgactatagctgagctgttttgtattaatttgatgtagttagggctgtttctgaatctactgtgtaggtcttaaaggagataaaaagctgttgctaggagcctgtacctgaaaagcaggctgttacctgggatgagaacagagctaccgttgtatataggattgtagctaaaatgctattggtcctgaagctatagctgtgatgacagcatattgaggattggctatagctacgatgctattgcccgggattgtaactgggctgttcttgtgtgcaaggctttcactgggatgctgttacggctgcagctaaagctccaaagctctggtgtagctaggacgccatttcttggtaatatagctggaccactgttgtgtgggggctgtagctaagactgttgtctaggagatgggaagttgttccctgagatgctgttctgggaggcagcatgctactggagatgggagctgatctgctcagaatggtcctccagtggctattgctggtctgtgatgggctgggtaggggagggcaggtgagtcctgtctagaggtctggaagatgccaggaccctaaggtcggctggagctgctgttctggggaggcctcagcagctgctctgctgtggagctcagaagcctgttttcattactgttttaactctttttttaaccttgtttttctctcggctgcactttcgctcactcattaattttggtatttttctcacggtgcctcagcccctgtcatggctgccatggcaacaggaggcagtgtgcatagtgccaaaatatctgatcaaaaaataaccaaaataagcaaacaccaggatggctatacacagggctacggccaaggcagagttgatgggtgagatcctggaaaccctgggctcccaggggagccctctcccccacttctctagagaagctttaggaattttttgataacctgggatcctgcttcccaagggagcttacagcatactttcctaggactctgagatttttcagtagtccatggtcaagagacaatttttttcatgaggttagaaatgaggagaaagttctaagagcttctacctacccctcccgttgcccacctctccccttgcccacctccctccttgcccacccctccccctgaccacccctctccttgaccacctttctccttgcgcacccacccccttgacaacccctgtccttgcccacccctcccctcgactggtcttagaattattcctcctctgctgctcctatcccactcggctatctccactttccttcctactttcatcctgatgggatggactgccctcctccaaactagccatcccaccccctaagtcctcagtaaggtgcctgagtcagttatgatgccttccaagcacctggcagttctaggtctctagcatcgcctacctaggggaggctcctggacattccaagtacgctcactctactcctatttcctctctgacttcttagttccccggagatgccccctcaaataggcatgttctaaacagaagagagcctcatgcaagagaggaagggtcagaactcctggtattaccagcctcgcctcctttatcacccactaatgttccctctgaggaagcttgtctaagtgtctggagcactgggaattggggggataagaaggaacccctcaatcattcagttacatctctgtctgttcctgtccccccccacccccacccccctggagaaagcctcactcctaacgcatctgcatcccctctgggaatggttagaacttgtctcccgatcttcactttcaatttctttctcccctcccttcaagagcagtggtggccttggcctcctggcagagccttcctagcccgtttccatagaaacctggtaggttgtgcagtgcaggagtgggaggggagacagaaggaaagagggaccaagcctcaagggcagcccccagatgaaggaatatgggtactgagagaagatggggttctgctccatctagtgtgggaccttgatttgggaggggagataagaggtagaaaatgcttgctagattctacctgcatgtagtgtgccctgctgcctcccgagatggtgccacaggaactgtcttctggtacagagaaaggggattacccccttcaactttttaaaatccttgtttaccagaaactgcctaattaagaatgactttcttcccaggactctctagtctctaagacaggaaccatgggacaccttctctcccccaacagcccctcaccctccctagcccagcgactctggaatcagaaggctggacagccccgggggacccggtggcctctgctgaccccatggcgtgcagctctcaaaggtcccattcatgtctgggggctgaaggcaccattgtcgtccccccccaccatcgggcgggagggggatgttgtatggggactgaggggggtctcgactcagaaggaaggaatgcgtctggagaagttgcccataccactctccccgccccccgcggggggcagggtagctccaggctcaaggtccccaccagatctcagtccagaccctttcgtgaccccaagttgggtctccagtagttcccagaagccttcgcgtatcccttgagggtggggactactgcagtgtcagagaaggggtgggaggagtttggccccacctctctgtactcggggaaaccagtgcacaagtcgggagctgtccagcacttcagatttggaaggctgcttattcgcctacatgcctttaaacaagggcgtccagagccagccctggtagctcaggaggtcttcttcctcgcctaaactaagacctcagactacatctctcctagattggcttggatgctttgggtgtggagatccctcggtacttcgaactgacttgggaagcaacatatcccctactcaatctgagcagaaatgaagaattgagtgttaccaaactgctgtctcagacctgagcaggaaaaaaagatcctatgagctcaggccttgcctcccctcccccatctctctatctgtgcctgttttcctccctctctcctccctcccctcctctttccatccctgctgggttgggggctgctgaattatcatttctcagttctgctaatgtgctccccgctgaggggagggatcataattctgggagatgattaagtttcaaattgttttttctttctgttgttgaagaagcagctttactatggtccctcctcagtgggggaaggcaccccatctcttctcttaatcccattttcaggactatgatttttgaagtcccctctagacttttgggtgtttaagtttgtaagggaagcgagaagcataggctgacccttgactcaaaaaagtcatacagtgtacggtaggaacttaactggtctctgtcacttcctgcccatgtgattaagttacttaacctatctgagcctcagttttcccatctattaaatgggctcaaggagtattggtgaagatttaaaatgttcgtccaaatgtttagtttatggcaaaactccataaatgttgatagtatacctcacaccgcgtcactgttcctggaaacctccctgagcttgatctttggttcaataagtgtttgcaaaatgctttctatttcccagacactatgcagcagacatgaaacaatctatttatcacttaaacacctctttatcctctactaactcttatttagcttaatgtcactcccatgtcctgactcccattgcggcccgtctacttcctgccatgacgtcatgattcccactccgttctttcttatctcttaatgtcacctggattcttttctttctttctttccttttcctttcctttcattttcttttctctcctcttcttctcttctcttctcttctcttcttttctcttctttctttctttctttctttctttctttctttctttctttctttctttctttctttctttctttctttctttctttctttctttctttttgagacaggctctctacatgtagccctggctgtcctagaacttactacacagaccaggctagccttgaacttagagatccacctacctgtctgctgggtttgcattcagctgtcacctgggtgacacctgggatatcctcttaacatgcttgactcttttgtcttctctgtcactcctcctgtcactgaggccatcaaagtaaaaaggggtggagggggtagaggttaaattttcaaaggaacagagagaactctaagccatggtttgtgtgtatgcgtgtgtaagtctgtactgcactatttattcaacagtgagtgtatagtagacttctaaatgttagcatctgaactgtaagcttattgtctacataactcctataagagccataaatctctaaaatgtgtacgtttctttggctacctgcctatcttctctttccctgcctctgtcttctaagaatgtactgttctcatattaatcacctttattgagatataactgagattaaaatgctcatatttagttagttttttgtctagatagggtttctttgtcccgaaactccctctatagaccaggttggcctcaaacacagaaatctgactgcctttgccttctgagtgctaggattaaaagcatgccattgtggccagcttaaaatttctaaaaaatatattcttttttaaaagatttatttatttattatttatgagtacactgtagctgacttcagacgctccagaagagggcatcagatttcgttatagatggttgtgagccaccatgtggttgctgggaccggaactcaggaccttcggaagagcagtcggtgctcttaacccctgagctatctcaccagccctaaaatatatatatattctattttatcctttttctctgtctttctctgtttctgtctgtctctctctgtctctgtctgtctccccctctcctcaatgtatgtgggtgtgtgtgtctgtgtgtatctgtgtgtatctgtgtgtgtctgtgtgtctgtgtgtctgtgtgtctgtgtatccatgttccacagtgtgcatatggaagtcagaagacaacttgggagaatggtgggttctgagaattgaacgcaaatcatcaagtttggcagcacctttccccactgagccattttgctggcccaaactgcatacatgtagtacatataattcaaggagttcagttgtcttcgtttcctctgaccgcgaaagcttacaccacattagcagggggagctgctttatgagagctgggttgggttttgtaggccacagtttgtttgtgttaaggacagtttcacagagctacatggtcagcccttgtaacaatgtacacttaaattatttaaatttaatttttattaaacaggtttctctgtttctttgggtctttatttccatatgaaggttcctgtgtcagataagactaaataactgtatatggttttcgtctgtcactccatcctttgttataacaatctgacccatagagctaagcaatggatttaaaaaaaaaatgtttcttctccaacactggatgttgtttgttttatttccatttgtctcactttataactgtgtgagggtttgttcagcacaggaaacagaaaccagtctaggtattttaaactggagggagttaatttagggaactaatgattccaaaataatcaaaagcacttgtggaatggactcccagaagctgcaccaggagagctagtatgtttgccatgactggcaaggtaagaaatcaaaaggccacggcggtggaactattgatttaaaaaacactttgccagaaacttgctttccaggaattaggaagcagagactcacaagctggaatagctcttacacgagaatgctacatccctagggttctacttatcagtgaagaaccagggagacggctcagtgggcaagagcattgggatggtctgggtttgatttccagaactcacatggtggaaggagaggacctgccctgtgcctgtaccatagataactgacatgtagtgaaaacagagagctggagacaacagaaaggcttctcctgtcttcctgccatctgatgattaccactgttaaggggatcagaggaaggcaaaccagatctctagactttgaattcgaaaagaaaaagaaaaacaaacaacaacaacaacaaaacagagacagagtccagtggcacaagtgactttggtgaattgggatgcttgaccagaaggactgtaaggtccaggtttgctgagtgagttcaaggccagagccaaatttttattctactttttagtagaaagaattctggggacctatttcggtgttatagttcttgtttaagactctaggcttagtctccagcagttacacacacacacacacacacacacacacaccagagaaggaagaaggaacgaggctgtggaagttctgtgactaagcaggtaatgttaggatcaggacagaggacgaggtgaaagaaagtgtctgtcttggagcaagtttcagcagcacaaatctaggactggtcccagttctaacttggaactaaggggatcaggctctgagaatccctgggaaattgaagcaaaagccagtgggagagaaaggagcagacaagactgtcttaaaagtcaaaggtacgaccgtctcgttccccacaaggaagtagctgtacacaatagtcctgggccttgagcatagaccccagggacagtggcagcttctctcttacactggtttgggtccgtgtggctctctgcaggccatctgccacctacctcatgaccatccttctgaaacaaggcccaggattgcccagagaggtatcaaggaaaaaccccaaagtgttttcaaagtctcatctttcaagcaggaaggccaggaatctagggatgtcttgcaggaaaacaccatggagctaaggcctccctgctgttggtatctggttccttctgacacagcagaggtttgagcatcgtctcaagtccaggaatcaggagacaggtccttggggttgtaaggaaacaatggcatctgaagacattccaaatatgtcacaggtccattaaatggcaccggtatgagtgtgtctgttgagtgaatatgaaaatgtaaggagaagggatagcttggctgcctggctcctaaggagcttaaggcagacagcatacgctggggctaaaagcttggtctagttgggtggtccgtgatggcacatgcctttaatcccagcactcgggaggcaaaggcagaagcagaagcatctatctctgagttcaaggccagcctggtctacaaagtgagttccaagacagccagggctacacagagaaaccctgtctcaaaaaacaacacaaaacaaaatgcctagccttgtgattctgctggaatggcgctgtcatttattcgttgtatgaccttaggccaattacatcttctccctgggcttatccttccacctataaaatggacatacttgtatacttaattcgagaggtagctaagaggattggctggataatgatatgcgatagatgcaaaaacacttggccagtccctgacatatactgaacttttgagatgtagtgtctactagtattgtttgcaatgactaacaaatatctttcaagaacaaaatatctttcctattaatcactgggaaacccctgtaaaaggacattctttatctgtggtttattctgtccctgcttagtcactttctggataagtcgggatccaggccaggtgaggatgcctcttggagcctgtttcctctctctgaataatcttcttttctcatccttagttcagtcccctgtggtcccactgggtttttagcatgtcctgtggagaatggcatgttggcatcctgataatgaggaatggtgtgtgtgtgtgtgtgtgtgtgtgtgtgtgtgtgtgtgtgtgtgtgtatgtgtaagagttgtaagatcagcaaggtttggggtcaccacctcagacctttcatgtcccgccccctctctctattctccttttcccaaatcctccgactttatctaggtttattgaatatctactctgtagcaagcattatgctagacagcccctaatgtattcaaggcacgtgaataagagttacaacaaatagagccacacaagcatttatttaatcacaattataatggcttcattcaggggagatgatggggagtattgagagtagataatgggacaacctgccctcccccaccagtgaggtacaaacaggaccagacctgaggaaagactaagaatcagccagacaaggagaaggaagttccctgagcagagaggagttcctgccaaaatgttagatgatcactttatggtgtgtggccttatccaggggtatttgattctcagctggggactcccaaaagaataaatatttaatggtgggatatacggagacatgtgacctgctgatagcatcaggagaccctcttgttggatttccagccaaatcatgtggttagaaggtctatctctgagagagagagagagagagagagagagagagagagagagagagagagagagatagagaataagagagcaggactgtggatgtgtctttgtgacagtaaatatcagtgcaggtgtgcatgagtttatgcagagctctagctaataatttttggcttctgggccaagcagcagaaacatacattgaaattcaggagcacgccagctcctgaacggagaacagaggagggagaaagcaccccacccccagtacagaagcctccaatggtcagattctatgtccttgacactggacagtccaggtcgtccactctgccaagtgcagagcactaactagctggaacttctagacaagcatcactgttgaagatgagggaaggaggaaggctttaaaatttgtagtcttttggaaaatcattattttaaaatgtttgaccctcctctgtatttttccccctgggcctctagtgggtgtggtctattaacactctaaatgcacacatgcacatgcgtgtgcgggtggtatgtgtttctgtgtagaggaacaggtgtttgagaatgacattgtgaagagtggtaagagcccccatgggctagtggtcagcactcaagttcctctcctcctctgtcccacccaggggctcagtcctcccactatgcccatctccggcgctctgcataaaggctggaatcatctgtgcatcaggcctgagtccctttgtattagcgacagactgaacatgtactgaccacaactagacagacaaaaataatatgctcacatccaccttcaagcccataaagcgaatggaacctgggcccattgcagtgaatgagcttcaataattcatcccagctgctgatgtggtattgacataaagctaatttaacactggaggagcccgggaaagtaaggagcaattacgccttcacctgcggcatggtctttcagccagctctgtgctgtgccagaaagccagctcctaaaataggagtagttctggggaggccgctggcccccttctctccgtgaatatggttggcttactggagatctcttcagatttatcttgctcactgtctgtgtgcgcttgcccttgcattcatatgtacatgtgaggctagaggtcaactgtagatgtcattccccatcttggggtgttttgagacccggggctctcaatggcctggagcttgatgaatagactaaattttctggccaggggacccctgggaaacctactgtctctgttttcccagctctgggattgtaagtacatataagtacgtataagtataagaaccatgcccagattgtttaatgtacattttggaactaaattccgtttccatgcttgcaaagcaaacactttactgatgagttatgtcccatctcctcctgccgttttgtgagacaggatctcatacagcttgggcattttttatgtgtgcaaatgttaatgtctgaatgtgtgtgtgaacatgtatataactactcgtgtgctcaggttcatgtttacatatgtctgcatatatgtagagcccaaaagttgatggcaggtgccttcattgaccactctccactgcttttgttaaggcagagtctctcactgaacccagagcgcaccgattccccccccccccccccagatcatctacccagcttgtcctgtgagcctctgtctctgcctcccagctgctggaattacaggcagactgccacgcctggctagactctacacaggctctggggatctgaactcctgccttctgccttcatgcttgcataacaaagactttactcattgagctctctctctgaccttagaacttttgatcctcctgcctctacctcccaggtgctgggattgcaggcatgtaacaccacacctggcatgttgacagtattcttgaacagagactgaccgcctctctctctggatctgaacttctcaatagtcagagatgtttctttaaaatgcgtcccctcccttttttttcttgtttgtttgtttgtttgtttgtttgtttgtttgtttgagacagggtttctctgtgtagcccaggctgtcctggaactcagtctgtagaccaggctggccttgaactcaagagatcttcttgtctctgcctctcaagttctgggactaaaggcgtgcgccaccatgcctggcttaacttttctaaaatatacatctcttctcttctcttctcttctcttctcttctcttctcttctcttctcttctcttctcttctcttctctctctgtttgtgtgtgtgtgataatgtggaggtcagcagacaacatacaggagtcagtcctctccttccacctggggtgctggggattgaactcactcaggttatcaggcttggaagccactgagccatctcaaaggccacatgagatgtttcttatgtcagttagatcagggtatttcctgtatctctttccatggaatataatcctctagtactttctagaggacaaatggacaagtgaggctgcagggaaagggaactatgactgatatccaaaatgatgtccaagagtccctcaaaaataaacctcgggtctggggatgtgctcagaggtagagcagttgcctagaattcctagcatcacacacacacgcacacgcacacacacacacacaccataaataaataaataaataaataaataaataaataaataaacgccgctcatttgatatcatatactgaaattcttgttttaatttactcaaaaaatatataaggggctatggctggagctcagtggtagagtgcttgtcttgcttgcataagatcctgagttcaatccctaccccccaccccccccccaaaaaaaaacctctccagaaacctcagcatttattgttatcaggttcacttaacggactatatccttgctgtcagagggctgaaggctcagtgagagaggcaggtattaaacacgtagacacgtgagtgagtaggtgatcataaattgttaccaatgctttttgtttctctttatttattcattcatccatccagctatcaatccatatgagagaaacaataacagtaagcgacagtttggaatgacagtgactctgcgtcctgcaaggctttgggaaggcagagtgtgtatctaatgctttccttcttcctagaaataagcgaatacactttactggagctagtggaagaaaaggaattaggggtgtgtgtgtgtggtatgtgtgtgtttagtccgggaaatcaattcaaatcttgctgctgccattttataactggtttggcgaccttggacaacttatttctgtcaactctcagttgccccatctggaaagcagaaatgataacatcctccactttatagacttgttgtgagaaattaagtaaaataacattctaaagtgcttaccaatgcctggcatatggtaagtgtcaataaattaccattattgctattatgattatcctcaagtgtcctcggttctttattacccccaggctttgacacaatttgctccatctgcctggatcacacactgcttcctggatccattcatgctcgtctttcaagtaacacctgagacatagctctctcaaaaaacttttctggcctctagatccgtagctctccggcacacgtgaaacactttaaaatggctcagggaatgaagctctgaccacgcaagactagcaacccgaagccaatccctggaaaccaaataaacatggaaagaaagaactgaggtcacaaagctgtcctctaacttcttctctgacgcaccctctgacctccacatgctcactgtgccacgcgcatactaacacacacagacatacttggtggtttgaaggagaatggctcatatatttgaatacttggtccttagttggtggaactgttagggaacgatgaggaggtgtggctttgttgaaggaggggtatcagagcctgtggcctttgagatttcaaaagctcagggcattcccaggtaactaatctttgtctctgtgtgtctatctctctttgtgtctctctcttctctctctctctctctctctctctctctctctgtctctctctctctctgtctctctctgtctcattgcttatgaatcagatgtaaactctatcagttactgcttcaagaccatgcctggttgccatgattcccaccatgataatcatagagcctgaccctctgggacggggaaccccaaattaaatactgtctttaataagttgccttggttatggtgttcttcttggcaatagaaacacatacacatgcgtacgtacatacacacacaaatactaaataaaaccaattaaagtcactgtgtgagacagaagatatagctcattagtagagttcttgcctagcatgtgtaaggtcccccagtttcatcacacatatgcatgaatgtatgtgccctatctgtctgtctctgtgtgtgcatgtatgctcacatgtgcatgagcatacactcgtgtgataataaaacagctgttcagacttggaagagtgccatggtccgatgacaacatttggagacacgtaagcatattgacacctacacaggggcttgccttactatctaaaacttctttgtaagtctaacattgttctaaaataaaaagggttattattttttagaagatttatttattattatatctaagtacactgtagctgtcttcagatgcaccagaagagggcttcagagctcattatggatggtcgtgagccaccatgtggttgctgggatttgaactcaggaccttcagaagagcagtcagtctgtgctcttaaccactgagctatctctccagccccaaaaagggttattttaaaatgaggactctgtgccaaaccacagtgacatgtcatttcagagtatcaaagtgaaaaaggaaggaaggagagagggggggaaaaatcaatctcagaaaataacaagtattaatgaggatgtgaagaaacagggaacttcatgcatggttgtcaggaatgttaagtagtttctatgaaaacatagtatgtcccttaaagaactaaaaatagagttgccaagtcagctcagctgataaaggtacctgggggatctgagcctgatcgctgggaccattctaaaggtgaaaaaagagaaccaactccgcagaactgtcctctaacctttacccaaacgtaaagtttctttggaaagtgagttatgtcaaagaatggttcactgaagcagacacaggtgaaaggatgatttgctaaagcaaccacatgaaaggacatgtcatgaaggattcttcactaacaacacgcatgttttggtttgccttacattgggtagctgagcccatttgtcgtggctccagagagaaacacaccaaaaaaaccttctggtggcattctggcagcttatgccccttccttggacttgggccagttggcagagtgatgtcagctgatacagagtcacctgaaagtttgctaagacagactcacatgctgaggcaagacccatggaggacatgtgatgtttggagggagtataaataggacttaacagacagtgaagggggtaggcttgcatagctagctttgcaatgcttcctgatctcccgtctttgctgaccttcgcttcgttgagagagcaatggcaaagaacttctcctggtgtctaagctggtcctaatcactcctgcagatttatgtcaacttggctgaggtctggctgtttctgctaggtcatgccactgctgctgattcgtgtttgctatcccagcactactgaactggactgctggtatatcgtggtgtagctgcaagtggattgagctgctgctgctgctgacctgtgaactgaacggctgatttcctgacaatgcagattggatttgctccaaagaacaatttctaaacaggtctatttcccctgtctcccaataacctttcttttctactacctctggtgggtgttgggttagaaggaaggtcaaagcatttaagaacaattattaaaattagggctgggaaaaatgtaagcatatacacaatgcactgtggcatatatggtcatgtgacacacatatacatgtaataatcatgtgacacacatatacatgtaataagtgaatatgttttttttaattaaaacagtcaactttaagttg

SEQ ID NO: 248 - DNA, 3296 bp, Mus musculus
gtgacacattgatgcttttacttgtgtaagcaatatggttgacatatggcattattatttatgaatgacagcataaattgtattacaaagtctactgcaataatactgcactttattggaaagctgcttgtttgtagacagtattcaatccctaggtttgcccacaagcccaaaggtaacaatctttgaaataattaaatgcattcctgttcccataaactagagcctcctggattttggatttttgtgttgattctttttattgttgttttggctgggtttttcttttcaacatggaaaacattcctatcaaaaaagaggagatgaagcaaggaaaattagttttctttttccaaaatcacaatttctgtcacccagtatgggagggtgggggtgggctgggttcttctagcttcttctccccttttctgacaagtacaaaagtattttcatctctgtcaataaactactggtgggcacatattttatattgaggtttttttttttaatccgctcgaactacagagtttaattataaagagaaaagatacaaagccatggaagagctttatcttatgagatcttctcatagcctccttcctaatgttatttaacagttacagctttggctaggattttcacaacttcctctcctcttacattatacctttctaaagtcatgtcaaaaggcttttgttctatgtgggttttatagagggggcttcccagagcacacatgtggtctttcatgtatcagggggtcacccaactcagtaatagctgagaaagcagaatcaaaagtaaccttcaacttaatatcctgttgattatcttgttggatttttgcctctaatatagatggaggtggtgctagatggaggtggtgctagaactcttgtagaaaaggaaattattattatgttagttattattttggcctaagctacaatgtattacatactcttcttcacagcttctctcccccatttttacacctttctttaagggaaaaaaattggagtgttactggggccaagagtcacaataatatattcagtggatagccaagttgtttgtatttggtgtctcctttcccacaatgtatacctttgtgtgtgagaacacagtgggtgaagtgcaatgcatttattcttctgtatgtatgtgcacatcacgctataagagatcacagtagacaccattcaaaaggagttgctcatgattgctgggatgtttgtggaatttgcttcacctcatcccttatttttcttcttgtaaacacaccacgaatttttgatcaagccttggttctcttcactcgccgggaaatgtacccttgccaggagccctgtggcggatatccttctcagccacaagctgaggttttgcccagtgcaggttttgccctgtttgaaaagaacaatttggggaaacttaacaaagaaagaactggcttccaagcgttgacagttaccggtttgggaagtttgacagagcagcctttctagaaacctgttggaaaaaaaatgatttgctcagtgtctgcctgccttcactccttccttctgtccttcctttcttccttccttccttccttccttccgctaaggaacctgagtctacttttgaggcaatagtcctgaaagcctttgcgcgttctcgcaagcgcgcgcgcgcgcacacacacacacacgcgcgcgcgcgcgcacacacacacacacacgcgcgcgcgcgcgcacacacacacacacaggcacacacaggcacacacacacacacacacacacacacacacacacacacacacacacacttgttcttgccctcgctttttcctctccttccttaaaaaaaaaaaaactgtcaagaaggaaaaggtttttttttttttttttttccttcttcttcttctggtttgcagagaaataaaacacttctgaaagaggggaccgagacatgactttgaacttggttcagctcctctgtttcctgcagtgagaggagaactggagctgggaaagaatagccaggagggcccagccggcgagctctccggcgggaattaaggcatctgccctaacgctcggccctcgaatccagcgcccagccgcgccatcctgaattgcgggctcagcaaagaagaaatcaaagcgaaaggagagaataggtcaaaaaagagaggaaaggaagagtggggaggggggtgaggaagtggtagaagaggaaaacctacaagtgtgagggcttgaaagaaggaaataaggtctttgggtagcaaggctgttattctcacaaccaatcttaggttaaaaaaaaaaattgggagtggtagtatttttagagcaaaccaatacatgcacttttcagtataaattgctaaataaggcaagcaaatgtgaaagactgaattaggcaggcttttaaaataaatggattgaagcctttctgcttagatattttccatctctcccccctcccctccccctgcggtctagcaggccagtgtagcttctgccctttgaggtaggggaatgggaggaaagaggaccatttcctctctccagcttctaggaaagctcatgatttcggtcaagatgcctttttcttgtggtcgtttctcccgtcccccttaccaaggaatggggaacacggaggaaacagagggagccttggtagaaaggttggctccaacagttgagccagacccacctaaggtttgagaggttgtttgatcaggcaggagctcatattcattgcagcaaatctcaacaagagtcttcttccagcgtttttggtgatttcatttcaatataaatttcgaagtatgttgttattctcttgcgcgaattttatctcagtttccagagatttattaataaaagcagttctcaggcctgcgaaaggtgaaggaagacgatggtcacgggctgaacctttacacttccccaaactcttggcccgcaattccctttcccattacctcttaccaatctgagggcggtgggacagccatgttcttagtgggaagccagcctgggttcgagggcggcgcttgggaagctttgcggtggcttcaccaaagagtgacacttaccgtaagccccacagtttattttttctgaggccctgattctgatacggcaacagccaaattaaggcctaaaccttgcttgattctgggcattccacttccagaaccaatgtggctgtggaccgggtcaggaggtatccacccggagggagacactgtctttaaatgacgtctaaactgcccctcagggtctgctgcctagttt

SEQ ID NO: 249 - DNA, 4128 bp, Mus musculus
ggatgaaagggtttatttggctgacaagccctaaccacagtctgtcaccaagggactcaagcaggaacctgaaggcagggactgaagcagagaccatgcacgaacaccaatggttggcttgttcccagcctctgagtcagctatctgttttatatctcccaggactacctgcctagggatggcaccacccacagtgggctgagcccttcccacagtatgggctggctgcctctgcatgagctgcctatgatcctggccaccatgtagaagcatgtgagatcagatccttgtgtgggactgtcatcacagacaagcaggaatttaggtgattttaggtgacttcactgatcctgggaacagtcctctgctgtaggggcaatatctccacccctgcagacagttcttcaagagacaaagcagaaatttctcctgtggacactttccttggcctgcaatctcaagccagctctgtgaaacagtctacaggagacgacctgcgccagctgccaccgtctggaaaacgcatctcaggacgcttgtcgtctgactccctgcaaacctgcttctcatgccaaaagtcagtctagtgtctcctgggctgttctgcctggaaatcccatcatttttaaaggcttgtttggcaccagcggggaaaggctagccagcttaggttaaagaagccagtcttagtggacaggacatggaaacacttggtgcagggagtggctggcatacagaaggaaaatccagagctgcctgcccctctgtctcaaacatgccacctcccttcacatctgagtctttgggaatcccagagtcagcttcattactccacttcataggtgacaagcatcgcagagagggaactcatctgcccaggttttgcagttaatgaatggcatgtacaagggtgggacatcggtctggcttctgaatgccagctgaaggacgcatgggtggagctcttccctgggcacaaatgtaaaggcatccctgctggtgtgaatatctctacacacaaggcagagccacagctcatcatgaccttctgcacctaccgcagagctgctggggcccaggacctgttggagggccagtctgtaatgtgcctgagagacttcatatgctccgagaaggagggaagcacctcccaccccttagcgtttcctctttgcttctccccagagtctcaggtaaaggtcctccctcattgtctgcttctatgtgagaacagcaacagtccacaagcctaatcaggatggactcctgcaagcagggacagctgacctgataataatggcagttgctttgcttggaggactgtattctacaacagagggtaatggcatgtatgcatggcagggacatgcaggggacactggatggaggtggatatacagagacaggcgagatggaaagaacacagcagaagcacaagactatgtccatgatcatggagacctggtgcaacagtgcaggctggtatagatggggcccacaggcagcttgcttcctcaaagactcatgctggtgaacagaccatgaccaatactctccattatcatgagatgccaattgggcacaggaggatgctgggtatgggttggcttagcctgagcaggatgcctagggtgtacctgctggaaggcagatgttctgagtctgtattatagcacgaagagggaagaaccctgtgcctgctgatcagctgcagcactcatcttggctctgacacagcgcattgctgatttggtgctctgggtaagccccttaccccgcctgacttgcagcgtccccgtctgtggatgggagaaagacctcccctgatatgtagacctgatgcaggttggggatggggaggtgagcttggtgaaagcctccggatggctgaggttttcatccccatgaaactcaccaatggaatggcacataagcacacagtatacacagcacacacacagagacacacatatgcatgtacatgcccccacatgtgttcatacacacacacatacacatcttatcatttatacaacttacacacatacataattattccataacaagtacaagctggcttttaactcttactgtactgtgactgagtctgtctgtctgtctgcatgtccactcaagcttgtttccctctgccctctctgtactctggatagaatttaggacctttgtgcacagcctctgagctgcatccccagctttcctcctctattctgtgtactgtctgatgttccctataaggtacattccacacttaagcaaagcttgaattaagtcagtactagccacccccattcagattcaagaaccagagcatggccatcccagcaactcctctgactgcctttgccccctgactgcctctatcccctgactgcctctgccctctgactgcctttgccccttgactgcctctgccctctgactgcctctatcccatgaatgcctctgcaccctgactgccactctcctcttgtttggagaataatgagaaactagggagcctgaggatgcagccggagagagatgtcccaggccggtctccatcactacaaaattctttcaggctgcaatgtgttcaaagggagcgatagctttgtgtctgaaagccttcttaattcactctgattctttctaaacaaaccctgaagcccttggagaagggcagggcagtgagtcaggcttttgcagggcctcccaggcctggagaagtctgggagaactcctgtctccctctgctgtagatggggagctgggagcccctctccttttccagctgtcagctctggaagggggctcttccttttccttgtgagttgttgggccactagggacagcagtaaggcggtggggtgggatctgagactgaccttcacctgattaataacttggtcactccttgttcacttaaggcccctctgggcatccttgacagtctggtctgtggagaggtagaaggcaggtccccagcgctgtattggcctgtcagtcatagtctagggagccccttctggctgaattgcaagttgagtctccgcccagaagaggagctctcggaactcctccttaaagagaaagttctgtgtggtactgcaatctctcttttgaattccagcgatcaaacttcgggggtccctcaacgttggttcttggagtctggccaggtcggggtacctgaggcgggaagaatctaggatcagggtgggccatcaggttttggaggccgccgcccagagcggggagaaagaacgggggcgccggccccgtcccacgtccgctcccgccccgggccagccccttcctcgccgcgactcgcccgctatccccaccccctcgccctcggcgcccagtgggaggcggggaccggccttgctgagcggggcgccgggctctgatttgctgcgggcgttgggggcggtggggggtgggggaatccacagcctccgcgttgtctgccagcagcgagggagggagggaaaggggggaaaagtgctcagcgccgaaggcgaggtccgcactcctggtccccgcggctggcgcaggacctcactccagcggagcgcccacggggagcgggtcgcggggcagcagcggtgaggaggccacgagactagaaggaggaggacagggagtgcgcgagcagccagcgagggggtcccggccgtcccgggccacagtcgatccctgcgccgtgggcgagcgcgcccgctgcctcttccagaacagccaccgccgcgggggagatcgggcgggtgccgagcttcctatgactccctgaagttgtcgtgctcccctagcgtccgccacccgggacgtgtctctggtccccgtgcatcgtgtgcgtctcccgctccccggcccgcgcaccccgccggcatggacgtacacacccgctggaaagctgcgcgcccaggcgccctgctgctgtcttcgccgctactcctgttcctgctgctgctgtgggcgccgccttcgagccgcgcaggtaagagtgctctggggaccggacctcggggactgtaagaggtgcgcagaacctccgcgccgctgtcatctcgggctccttcgccgccggcctcctccgagcctgcagaactttcctccttggcctgt

SEQ ID NO: 250 - DNA, 2611 bp, Mus musculus
attagaagtagagctatgaggctagttgagctggcccgctgattggttatatggtcttgtgcttccttttaacttctctgggcttccacttctccctcggcaaaacacacaagaccacgccttgcagctgcaccgcgcagatgccttccgagctgtcctaaaagctgggatctctccggcagtgcagggtgagtatttggttaggaggctgctttctttatcccttttatgagaaaaaggacagaccagcaccagttccaccttccaagtcggaagcttgggcatgtgctagtcagaccatttacccgttatcacccagcaaagatgtgatagctctggagtcttctccaggaacctgcttcagatcccgtatctcagacactgtttcctagtgccagccttgctagtcagcagagagagagagagagagagagagagagagagagagagagagagagagacctgaccagggtggctgctgtcttgatatcatagctcatcattttgtgttcaacttcacaggactgcagactagctcccagatactttgtaacaaatgacaccaagacagtgagcttaaaacaaaacagtgaggttcaggggtccaagcctctggccaggtcctccacttgtgctctcatgaagctgccatcctagtctgaactgctaatcgtctgaaagaaagatccatcttcaactcagccagttggtgtctgtcagttccttgtgggctgtcaggctcgcactatgtgggctgttggacctgtttctttgctgacgatcagatggagaccacactctacttctggctaaatagccccctctatcagcaactcagagcttatccagctgctttgccaaagccagcatggggtggagggcggggggtgggtatcatggtcatttggtcaggcacagtcccaccttcagacacaaaggtggcaggagtcatggagaacaatctggtggccaccatgtgacacgatagtcacacaagcatgtcctcaatttccagattcaggaagaatgtcaagaacaggtgaaggacccacccaggctcagttcagtgggaaaacgttctcaacagctttgatgtccctgagctacatgcaggtggcgttggtacctggctggctgcggcagatccagagcagaaaccacatcggtgggagccaggagactgaagagcttcccttcctactgcagtcctgttacctggggttggccggtctgcatagtgtggagtcagcaccagctgaggatgtacacatcggttgacattggccagtgctgctgcttctgcctctacccaagtggtcattgttgggagggaggtcgttgggctccagagggcaggtcgaatgttgaaactacctgaagttcagaccagctcccaaactgagccttcggaagaaaggccttttgttaggggagcctctggagtgggaagagagggcagtctccctccccgaataggaagtctgctggtggtgatatctaatgaagacttttatgatagaaatgtaattgttaaaaaaaaattttttttttacatcggtctcagagctttcaatccaagagctcgatcattccctcattcatgccctaaataagccctaattaatctcgaggctggaagaaaggaggctagattgcagctttctctgtaaggacacacttcatattttgggggagtttgaagaggctctcaagcacttccctcagtggtattttatcagcggctcagagcggcttcattaggctgctgaagttgctaattgcattaccatatttttaagcctcataggtgcgggccaggcttgacatcttccaatgtgcccaaccgtttgccagcttggcatgtcagagacccctcgcacagtttgcctcaggtgcaaggaaggcgaccagcaccagtgtctcaggggcctgctggccacctgctgggagggaagccactaccaggtctcattcacttggcagagagaatgtggctacagaatcaatgtcgtggtgaggctataactccagcattcaagagactaaagcaagggctgaaagatggctccataagtaaagcctctgcctctgtccccaaagccacatggtaggaaagaattaaaggggggaaaaaaagcatagctttaaaagttaatgtcgtcccatggagtagaaaaaaaaaaaaaaccttcaataccctcgccaaggagggaaaaacaaaatgagcccatgtgtgcacgcatgcattcttgtgggtagatataaacatatgtgcacacgtttatttacatagacatgaatatctatatatgtgtgtttggacagatataaaaatataggcatatatatgataactgtgcatatgtgtgtaggtagatgaaatacatatacatatatatgactgtatctaggtagatgtaaatatatgtgcatatataaatactatatgtttacatagatataaatacatgcatatatatggatatctatatattgcatatatatggatatctatatattgcataactatgaatgtagatatatgagtataaatgcatgtatatatttatatagacttgaatatatgcagattctgtattagttacttctc

SEQ ID NO: 251 - DNA, 14339 bp, Mus musculus
cccaattttaaaacaatttattacttatagaattaatattagaagcattaccatcatattacaaagtttggctgccaattaatacctatgaatacatgcaagctttaatgttttattaaagagacattacttaaaattttatctttaattctactttctaggataagaatcacattaattattatctcaactagaagtatctttagagacccagcctcttggcctgccttatgccacgtgttggaaggactttaaacttgagttatcaattttaaggctaaccatctgttaccaatgtaacaactattaatcttaactaataacttatgagctgattgtgaaaacactcagagcatattaccaattaaaaaaaaaaaaaaacaaaggaagcagttacatttagaccaatcagagaacattaatttttctagctataatcatagaataaaaagtactttatcatttgccaaacacattaatcacgaatgtagagaaccctctaagaaaaaaaaaaagtttatcagcttttttaccccaaaactaagaggctgtagactctccttttttcctataaggaacagcttttccagcaggggccctcttgccgtgtgcctgtttcctggttgaagcatgtggccgctctcggctttgcagataaagtttttttttttttagccatctttattatccaacataaaacatagaacattcattcattcagactggacacgaacatacatgaaattgaacaaatgaacagattggtgcaccagacattagacaaagacacaaaaggggcagagtacttctgctgtaaagcccagagagaacaaagcagggcacccctgaaatttctctctgctttttgggacattttcctcccgcatgatgcagtttttaactgcggccatctgcctgattagtaatttccttttaataaaccctttcttttctcacgcctaactgggagctacggctaaccacctgttacgttcctagcccctaataaacctcactggtgaacctaagtgaattagcgtgcaggtttaacgctgtttcaacttagcccataccgactttctccggtatgaatttcctttaattattttcttcttctatggagctccaaaccagcagtgcttcttccaaatgtcctctgttgtttctcagtcccgcgttgggtcgccagatctgttgcggctggccagcggctcacatgtctgggttctagtctgagaagcatcttggaacctggaagagaagatggggctaggcgatgcgagagagacggagctaagacaaccaggttctaatcaaagctcaattttactatttcgtgcaccgagttatgaaggaaggggaaagggcccattcccgccaaatcatcctggagtcagcttcaggtgaccacgtcggaacagcaaggcggcaggctccagcagtgggagtggcagaacgatagggtgacaggctccaccctgatgctctcttcttgctaacagtgaaacctgagctggggggggggggttagaacctgggttcaattcccagcacctgcatgacagctcacagctgtctgtaactcctgtactgggagatctgacactctcacacagataaatacagaagcaaaactctaacacataaaaataaatgtattttgttttctcatgtgtgtatggtttgtgtgtgctggtgctcacggggcggggaggggggtgtcagaagaggggatcagatccccttgagctggggttgcatgtgcttgtgagccccggtcctgggtcctgggtcctctgcaagaacagggagggctctcaaccactgtaacactctcctctgccacacacttcccattgtctgcagcccttggcagagcaggaggaggggacagtctaaggcttgcaaatcctccttccaaaatgtactcctcaccccaaggtttagcatggtctcctggaacaacagctgatctgtagaaatatgcaaatatccagtcttaaatggtatcacttatagcattcaccccctagaaccatgggattgatctacaaacaaaaatcacacactcacacaccttcgattttttcatgtaagtttacaattttgtgttgggccaaattcataactgtcctcctgtggcttgtggaccacagtttggattccagaagaggattaaaatgcaggagacagcttagattttttttctctctctctccaaagctccggtgtctccgttcagtagtgacccagagatctgtttgactggattcatagaaaccaactaaacaatttcaaaaggtgtctaaaagagaagcgaattctttggattgcatgatgcctttgccttgtcatgtcccctctgtaggacaaggaccctttccaggcatcatcgatgtttatggtgttggaggaggcctgttggaataccgagccggccttgtggctggccatggctttgccacattggctctggctttttatgactttgaggatctccccaaagagctcaacgtcatagaagtggactactttgaagaagcagtgcggtacatgcttcgacatccaaaggttctccttgtgtgctttacttaatccgtgtccctggaattatctctacagaggtggtctcctgctccagctgtactgaggctgttctgtcctttgttcgtgaggaagtttcttggggagattttcttggctttgagcatctaacacttcccctttctctgttgcatagcttcataaacatttaataaaatgaaatttcatctcatatactagtaaaattcctcttgccatacagactagatatcttcccaagctggctttataacctttcattttcctctcaaatttcgccacaatttgcccaccctttccaaaggctaacaactactaagttggacactggactctgtttctatgaagttaatcattttctaggattgcctcgatggagttggacaaatgattcacatcttgggccactgattaagccacatgggtcaacacactgtcaaataaagccatgggtcagattcactggaaatgaggtccttgcccgacaggctcccgagactcagcattgataaccagtccctaaatgtgactgtttggctttgtctgccataaaagatttatttacgtttattttgtgtgtatgggtattttgcctgcatttgtggccatgcaccagatgcatgcgttgaccacagaggccaggagagggcaacagatcccctgggggttatggacagttgtatgtgggtactgggaatcgaaccaggatcctttggaagagcggctagtgctcttaacaactgagtcatctctccagcccctctagcaacatcctttggtgctcggtaacttcttttttttttttactaacttttttttggctatacatgatccacacaggtggagacaaggacaacttgcaagagtcagttctcctctttcaccttgtgaggaattgaacccaggtcctcagattttgctgcaagcacctttacccactgagccatctccttagcttttttttttttttctctttctctttggatttttgaaattgctttgccttgccttgaactctctatgtagctgtctgactttgaacccctggccctcctgcttccacctccctagtgctagatataggcatgttctatctctgactcttacctcatcttttttttttctttctttctttctaggtaaaaggcccagacattgggcttctgggtctttccctaggagctgatgtctgtctgatcatggcttccttcttgaataatgtctcagccacagtttccatcaatggctctgcattcagtggaaacagacatatcaagtacaagcagaccatgattccgccgttgggccatgacctgaggagaatgaaggtggctttctctggcattctggacattgtggatatacggaatgatgctgtaggaggctgtgagaaccccagcatgataccaatagagaaggccaaggggcccatcctctttgtggctggccaggatgatcattgctggaggagtgagttatatactcagatagcctcggaccggttacaggctcatggaaaggaaaggccccaggtactctcttaccctgggactgggcattacatcgaaccaccttactttcccatgtgcccagcttccctgcacaaaatagtgaacgaagctgtgatttggggaggggaggtcaaggctcactccaaagcccagatagatgcatggaagcaaattctattcttctttggcaaacacctgggcagtacccacagcagagcctcctgtagactgtagtgggtttgcctgtaacagacatggtagattcaaggtcaaattttaatgatcagtaactatgtgaatcagttttctgctggatgacatgaaattcatgtttagggcattaatggcttataagtcactgtactgaataagttattaatcaatatggttattctactaccagcctgtgcttgttacagattcggctatatgtgatacaatgagtaaagtttaaaaacagtgacctcttattaaaaggtatgatttcttctaagttcagcatttcagtggtagttgcagctgtttttgttccatttgttgttttgttttgttgcttttggggacaggacctcagttctggccatcctggaacttgccatgtaaaggaagctggccttgaactcacagggattgtcatgcttttgcctcctgcgtgataggattaaaggctcggccctacctagttaatactttaactcctggctcagctttaaagacagtggctgcagctgctgctgcctcatttcatgtcaacttgacagaagctggagtcatgtgagaggagggagcctgatgtgtgtgcacacacacctgaatatacatgtgtgtaccttacacacacacaaaacaacaaccaaaaaatgataattttgccatttcaatggagtagatccagcctttaaataatttttcaaataacatttctgaaaatgcttctcacctgtgttgattaaacagcaaagaaacaaaaagttgtgttttctattcaaggtcacttggagccttattattttgtcccatttaagctacaaggaaatgttaagagtgactccctaaaattgagactaaaaaggcaataaacaaaggaaaagaaacttttagaactaaattaatatggagattgttttaaattaaaaattggtccacagccttcaaaacattatctacatgctcctttgtctcattttgcaagaaatacaactagattagcttctctttagtcaacccagtgtgtgtgtgtctctgtgtgagtcagtgtgtgtgtgtatgtatgtgagtgtgagtcagtgtgtgtgtgtgtatgtatgtgagtgtgtgtctgtctgtgtgtgtgtgtatgtatgtgagtgtgtgtctgtgtatgtgtgagtgtctgtgtgtgtctgtgtgtgttgtatgccatcagagcacaatttctgggagtcagttctccctagcatgtgttccagtgattgcccctgtgtgtaaggatggtgtgtaaggctggtgtgtaaggctggtatgtaaggctggtgtgtaaggctgctgtgttctgtgcttttgcccactgagctgactcattggcccctcttgtctagagactagaattctaaaatggaagctgtagaatttgggcatatgtgtttgtgtgtggtttgtatatgtatgttatattttgtgtccacatggtaaaaatctactaagaaattctgttctaatgagcttatgaataaaggggccatcatataaataaactttagattacagtaattgctaggcagtgggagtgcacacctttaatctcaacactctggaggcagatgcaggtgaatctctgagttcaaggccagtctagtctgtagagtaagttccaggacagccagggctatagggaaaactctgtcttgcaaaacaataacaacaaagattatggtaattaacccagatcacttctagttcacatgccttaagtaaaccgttgttaaacaagctttaacaaaaatgatgttctcctaactgttagcaaacattattttaaagatttatttattattatacataaattcactgtagctgacttcagacacaccagaagagggcgtcagatctcattatgggtgcttgtgagccaccatgtggttgctgggaattgaactcaggacctttggaagagcagtcagtgcccttacctgctgagccatctcaccagcctgcaaacattttttacaagtgcaattttaattacatttaatgttggggcggggtggtcacaggacaacttgaaggagtcagatgcccttctatcacagtagaaagttctcaggcttggtggcaagcagcttagtcagtggcgccatctcagcagcactttagtggccaggcaggtaatgcttgtctgtaagattgctttggcctcttggtgacaaatcaccacttagaacaatttgaaagactcatggctttaagagtttcaatccattctggcagggaaggcctgacactcacaggagcagcagcttgtgaggaagacttctcacttccaatggcacagggacacaagctttagtccccttactcgggaggcagaggcaggaggatctctgagttcgaggccagcctggtctacagagaaagttccaggtcagccagggctacacagagaaaccctgtctcaaaaaaaaaaaaaaccaaaaaacaaaaaaaaaacaaaaaacaaaaaacccaaccaaatagacttctcacttcatggtagaccaggactcagaaagaggtaggctggagccagagagtcttcctcgatggccttttaccctcctcctcctcctcctcctcctcctcctcctcctcctcttcctcctcctcctccttctccttctcctcctcctcctcctccttttcctcctcctcttcctcttcttcctcctcctccttctctctctcttccctttccccctcctcttcctctctcctcttcttcctccccttcctcctcatcctctccttcctcctcctcttacaatatctcttgggacaatgtagcccttggctggcctgagcttgctatatagacaaggctggcctccaattataggatccattttacttctgtctcctgagtgcagggattaaaggtatgctgtgtgctacaccacatcacaccacaccacaccacaccacaccacaccacaccacaccacaccacagtattggagccaggttttctcaacaaattttcttttcctagttaaacacacacacacacacacacacacacacacacacacacacaaaggttttgataggtgatcctgaaacctgttctcattctcctgtctatgttctaacagctttcctacattacagtgtcccctaactgatctctgtctgtctgtctgtatctctgtctctttatcatgcactcctttgagtttttttttcttttactctgattctgcctttcctactgtaacagacaccaaaaatgtttgtcttcatggcatagatgactctccttcctgtgctgaatgagaggaaaccacaggattccacatgtcttcaccatctccaagagtcccaccctcagtgctcaaggctctggctttcttgttgccattcttccctatcaggatgacacatgcatatttcaaaatatgtgtaaaatgtctgccttccatgttctccagcctgactgtgagtaaaacaagtgcttccaatggggctgtgtattctccagacatcacggaccctcagtgaaaactcttggctaccttggtgtaatctcagaacttgggaggcagaagcagaaatattcctaagaggttgagactgtccgggctagactgagatccctcaaaatagacaaagagcattaacaaaaacccacaaaacaaaatttgccatggtttggttacctagaaacgtttctaaagctaagattactgtttggtgagtcaagactcttgcaacacctctggggataattaagcagaatttgataaaactaaacccatgaagaaactggtttacattgtctttagaaaagctggtgtgatggtagagagagagagaaaaagaagacaagagttttgcttggttctattctgtgctgttttgtttccttccttgctgtcactgcacagccctggctagcctgacagttgctatatgccacagccactccagtggagtctgcatgacaagtccaaaagcttagccacaatcctgaggcaaaaggtttcatggaaactggtctcctggagtctttggtgtcctgtaacatggaagcgggccagatttgtccttgtgatagtgtggagggtcttgcatgctttctttcagtattgttttattatacatgcccccaaggaatgatttgacaaatagttaagttagattgaacattgcttcctggcctccattggtgtctcaatatcctaggcaattgatgagccgaccttgggcttggaatttcataagaatgctactcattcagatgaaatgcctccagtgttgatagtgaaagaaatcaggcattgcagtttactggataagagctagaaatctcagggctagttcaacaaagtaaacttagaattctcattacagtcatgtatggcagactacatcacataatagtagaaagaaggtgggttgtggtttaaggaggacctagagtattgtattatccatgaaaagattagtagaacagaacccccctggtgcctgtttttcactaggccagaggaataccttacttaggtatttactaaggaacccctggtggtggattatacaagagactagaattgcacctgggttgtatagccctctcacctggctcctaagaatagctgattttagatatggctgatcttatctcagttgtaaacactgcctggttcctgctagcttttatgtatgcatttctctgttttgtgtaaagaatcattatgcattggataacttcgatgtgccttggctaatgtatcacctaacttccttgttttcttctgtaatataagtctgatgctcgctttgagaaattacattcagacccaatactcccttgtgttaatgtctgtttgtcactcgccgattccttgcccacctgagtaccgggaccctgatttctcccccgggttgggactcggactgagtcagctagtggcagctatagaccaggctggactcaaattcaggataataccccttgttctgtctcctgagaggtgggattactagaatgtaccgtaacaaccattatattatagaagcatacatttctaagaaaaaacataatatacccatcattagattctatctttattgatatgtgtgtgtgtaaaattatctacctgtagactaacccatcctaaattattctgggctcctccaatcctctttctctgacaaattactaacagtaggaacttctccttcctaaagccctataagcagagttagaaagaggaagcagattttaaagacaggtctcacatctgaagttaagcagctctctgatgccattaatagagacaattacattgccaactggagggaacacactgaatattaattaagatgcagatcctggcaagagacagggcagctgtcagggactcacctgcaaacaagcctctcacattcaccctccctagaactaggggagggagggtgtactggctagttttgtgtcaacttgacacagctggagttatcacagagaaaggagcttcagttggggaaatgcctccacgagatccaactgcaaggcattttctcaattagtgatcaaggggggaggtccccttgtggtggtgccatctctgggctggtagtcttgggttctataagagagtaggctgagcaagccaggggaagcaggcaagccagtaaagaacagcagtatggaagacagagggcatgctccttggattttaccttggaatgttttacactttgtcttagtcagggtttctattcctgcacaaacatcatgaccaagaagcaagttggggaggaaagggtttatttggcttacacttccatactgctgttcatcaccaaaggaaatcaggactggaactcaagcaggtcagaaagcaggagctgatgcagaagccacggagggatgttctttactggcttgcctcccctggcttgctcagcctgctctcttatagaacccaagactaccagcccagatatggtcccacccacaaggggcctttcccccttgatcactaattgagaaaatgccttagagttggatctcatggaggcatttcctcaactgaagctcctttctctgtgataaccccagctgtgtcaagttgacacaaaactagccagtacacacttcaacctcagaaaccacaggaaatattcaattatcccatttagtaaagtgttccaggagaaaggcaggacacaatagccagtctgaatttgagagcagagcttcttacaggatcttgactatgattttttttttttttttgagacagggtttctctgtgtagccctggctgtcctggaactcactttgtagaccaggctggcctcaaactcagaaatctgcctgcctctgcctcccgagtactgggattaaaggcatgtggcaccatgcctggcttgactatgatttttaaagactttttttcttattttacttactactggtaccagagatggactacatagcttgttcttgctagccaaatcctgtactgctgagacacaccccagcccttagataggaccagagctagatgttctgttcttctgtttcatgaatatggaggctttcttgaccttaattatgagaagttggagaaaaactctgcagatgacctcattttagtaaatacaaaaaataatctgtgagtttgaggccaccgcggtttgtatgttctaggccatcaaggaccacatggtgagaccctgcttcaaaaataaaaacaaacacaaaacccacaaataaatatttattattttccaaatacttaaatattccctaggtggttagaggaagagatatcagagagaaagaatgttgtcggtagtggatcgcggtcatgtgtttctataaatccatgtctcctaaggctccgagacagttccatatcccagttctgtgggaatgcttattgatcattcaataaaattataaaagcaatcagtggtccatgaagcatttaatctctcagcctgagcatcagctgcaactaagggaaaggtcatggtgagcacccaatcaggtgagttaaagatcagtgttttgaggaatcaagaggggtgggaccaatgtgtcactaggatgacaagactttgcacacaggggcatcggtcgttttgaaaaaccctgccttccatttcagttaattatccttagaacaaggcaaccttccagttatgtttgactctcaaaagtcctccaaaggctacatgctaaacacttggtttccagtctgcggcgctactgggaggtcatacggaccttaggaggtagggcctgatggaagaggttcagaccacagggagcatgcccttgaaggagatttcacccctccccctctgcttccagctgccaggaagggggcagctctgctctgccacaggtgtcctgtaatggtgttctgtctgaccacagacccagggcaataaagccgagctgctgtagactggggcctctgaagccaggagctaagagaagcctttctcccttgtagtaataagctgggtagctcaggtggtttgtcacaggcaggcaaacctgattcttacatctcccttaaagagttgtgtgagggcttttaaagagccattttcagtacacagagcacaagccaggctaccacaagctatctaccttcgagcctcctcctctacaaaacaccaaaagataggataaaattcagctccaagagtgactaaaccaccataagagggatctgaacctctattttttgaaaaaatttttacagctacacaaatttccaaaaccagcagaggtgcttacacattcaccagggaccaaatacaaaaagttcggaaagtgacatgaggctattgaccatgggatatatttgatatatttgatatattgaccatgggctatatttgaaattacctgactgcaacctttgggagaatgtttcttcaagagttacaaagaatggaaacgcaggagcgtccctgtgagtgcaaccagcgctgtggcaatggggagtgggggggggggctgtctccctgacttatcagaaacttgaagaatgaaattcactgacaacgcttgaggaataattttattactacaggtagaaagctgacagaataaagatgaaatacagcagaaagcagaattccggagaggttccccaagagaagaaaatcaaattctttgagcttatctagggacttcttataggactcaacacagacagtggaccaacactgaggtagattatctgagtatgggaaagttgaacattggaaggcacatagtctatgcacagtcacctggtccaatcagggagctcaaaagctgtttatgcttgcctggttagggctggttgaagcccttctctgtccatctctgacttctgccgttattagctcttgaccttgtctgtctgctggtaagtgttgcactactccaaccttgcacggtctggctagtcttggagctttctggggtcggctagtcatgttatttatcctctctttggttctgccttatgtcattagctctagcgtgaccacgggcctttttccttttctgtctatggagagttaacagttatcacagctaccaagacatagctgtggtttttcttggttacctcatatttagcttatagtaggtgcagtctggaataggattaggtcatgttttttttggttttgggtttttgttttttggggttttttggtttgtttctttctttcttttttttttttttttagaagccacccttaaaacttagtcagctacaattagctccattagaagcaagactctgttaatgagccacaaggccttgtttgtctttcttggggaaggagcttcggagaagcctgtctacctgccaaccctgacccaacttagctgtctctcgcccagctgcaagcccttttctccctctattcccaactctaacatgcctgctctctctttctacagagcagttgcccttgcttttgtaacacgtctatttacgaaacctttccaaaaaacccagtttgcttgaactttctctctcagctgagctggaaaacaccaactccctgcccattgactcattctaggaaaccttttcagttaaggacaaatggttacacatcttgacaaggaaccggacgagcgcagagctggtggtgcaggcaggccctgattcccaacatttggaaggtgggggcaggaaattcaggccatccttagctacatagaaaattcaaggtcaacttgagagtgaggaaaccttatctcaaaacaaccaccaccaccggcaccgctacctggaatgtaattaaggagcagaatcagtctggtttcagcagaagtggctccaggttccacaaagactagaaagaggcttggaaggggcgtaaggagagtaagggaataagggcttgtttggcatggatcagtagaatgacagttccctgatatgctttggcacaatccagacttttgtagcggtatctttcccaatctttctttttaaacacgatttcaacacgtaccaagttgtaagacaagattaatcattatgcatctcccgtacttaacaaacgctaacgggcttatcacagaggctctctctaagagaaccaggaacactttaagctgtaacagcaagtccagggaggcctaaaagccacaaagccagagccacaatcagaaccaatgcacgcatttaccacccagaacccgaaccggatggcacctactgtgatcctggagcccgcgggtggttgcctttgtgaccagccggtgcacatcgctgtgcgcggcctggccccggagcagcccgtcacgctgcgctctgtcctgcgcgacgagaagggcgcgctcttccgagcccacgcgcgctaccgcgcggactcccacggcgagctggacctggcgcgcacgcccgcgctgggcggcagcttctcggggctcgagcccatggggctgctctgggccatggagcccgatcggcctttctggcgcctgatcaagcgcgacgtgcagacgccctttgtggtggagctggaggt

SEQ ID NO: 252 - DNA, 18772 bp, Mus musculus
caaagggatgaaccttaattttaatcagaacatcaacagggttttccttgggttctataaaagcatttaacatttatgtagaagcaattctaaatatttccatttcacgagcagcattttatctctgaaaaacactgatgtagaacagttgtgccagatgctaaaactctggaccaagctgatggaatagcgtgaaaggctacatggcattgacacagcaagtttgtagaccaggaggccaagacgtataaaagccattcaagacccacgctgtttgttggttgtgttttgacacagggtttcattatgtactcctggctgttctggaactctctttgtagactaggctggccttagactcacagagttccacctgtttgtcttcagcgtgctgggctcaaagccgtgtgcaaccaagcccggtccattctgaggtaaagcacaggaaagatggcatttccatgcagggcagagagacggtgtttaatcaatgctgttactgtaattggtcgttgacttgaaaaataacatcaaccacaagtaaaatctcgagtggatcagccctgatctaaaacataaaaaaacagaacagaattaggcaaaaatcgacataagctcaagataggaggagtggggattgtggagtgcaatgcagaaaagctagaattcatcaggaagaaacataaatctgccgataacaataaaacataaaatagcctttgcacactcttaacggatggactattagctctttgcaactgatgagtttaaaatggcatgcactgtagtgctgggtaatatacagactgagctgcgaagctgagccctgctaataaacaggttaaaatgtagcaaggaacacttccctaaaacaagactctggagcaaatttagagctggttttctgggaaactctggctgcagaccctgaggtttccttgggtcaaagaaacttaggtctttaagaaaagttgacatttgagaaagtatttgtctatggaagacactttttatctgcacaccagagctttattcattagacaactcctccctcgccctgccttaagttgtcactgccctgcccccactctttctcatagctcaggattccattgggctttaaccaaagtggggtggctcctgcctgtgattctatcactcaggagactaagacagaagtgttatgagtttgatgccaccatcccactccactagtgggtgccatttttaattcatcagttgcaaacctgagctacatagtgcgttctaggccagcctggactacaatgtgaaaccttgccttatgtatatgcctatgtgtatatatgcgtgtatgtatgtatatataacatgtagtgtgtaacatataacagaacataatatataatgcatgcatgttatatatgtatgtatgtgcacatatatacatacatgtacatatgcatattgctttaaccacccaactcttaaatctagtgttctgtgggacatgcatagttatgaacataattacaaagtttgccatttgttgactctttactgtccatttcagagacttaattatcaagccttcagcaagtagaaggcaaatttttactatcgtgtggaaagacgttttgatctgcctgctagggaaatacaaggtacaacaacaaacacgctcacactccttaccgatcattttgaaagatttcaattgcttgatgagcccaggacctaggaagctacagaagagatggaggggggcttgctttagctgaagaaagcacacagtactggcttcagggccagacatgtgtggaatttaacccaggcaatgtactggtggaggccagacttcaagggacatgtgtccacagtgtccatacacctgttggaaaaaagttagaactactgttgatttatgggatgcctgtaacattaacttccaaaggtggaccagagaaatggtttggcgttaaaggggcctgccaccaaataggatggcctgagttcaatacccagagcccaggttgtgaataagagaaataacttcctcctttgttctgacttctacatacctaccacagtatatgtgtgtgcatgcacatgttacacacacacacacacacacacacacatgcacacacatacaaagtaagtaaatgtaataaaaagatacatttcaaaaaattcaaaattaaagggctagagtgatgacccaacagtcaagagaatctagagaatgcctagttcccccacccccacatcggacagctcaaactgcccacagccccagctcaggaaaatctgatgactcctgcctctgtgggtacttgatctctcgtgtgcagacacacctagatgtaatttaaaaataaaaataaatcttttttaaaaagcaagtgaccctccttagaagtgggaacaaaacacccttggaaggagttacagagacaaagtttggagctgagatgaaaggatggaccatgtagagactgccatatccagggatccaccccataatcagcatccaaatgctgacaccattgcatacactagcaagattttatcgaaaggacccagatgtagctgtctcttgtgagactatgcgggggcctagcaaacacagaagtggatgctcacagtcagctaatggatggatcacagggctcccaatggaggagctagagaaagtacccaaggagctaaagggatctgcaaccctataggtggaacaacattatgaactaaccagtaccccggagctcttgactctagctgcatatgtatcaaaagatggcctagtcggccatcactgcaaagagaggcccattggacacgcaaactttatatgccccagtacaggggaatgccagggtcaaaaagggtgagtgggtgggtaggggagtgggagtgggtgggtatgggggacttttggtatagcattggaaatgtaaatgagctaaatacctaataaaaaattaaaaaaaaaaagaacataaaaaaaaaagcaagtgaaaggtaatgttatagactcctaataaaattcatctaaatagaatctattgtgtagtcaggtcaggactaagtgattcattgtgtgcagttagctttctcactactgtgttaagatacccagctaaagcaacagaggggaggggagatgtatttcaattcacactttaaggggtacaggcatcaggcagccatccatcagttctagacaccagactggagtggtggaaacctgaagcatgagttccttacagccctgtaggtcaagaagctgtgtgctatacctctatagctctgcccagatgtagctctgcccagatgtagctctgcccagatggtacttggtcctatgccaactagacctctggctgtaaaagttccagagccaacgtaagttgcaccactgtctgaggactgagtcatacaaggagggtgggacaggggtccacattttacattcaaaccataacacacagcgattctcatggtgtgttatatacaatgatccagtgtttcatggaaccagtcatcaaaggtccccatggcagatatgtttagctaaagcacatgtttgacactccaaggagtcaaacttcaagtttgtgcttgccaacaatctagtattatgtatattggtcccatttttaaagatgaaagaaaaagaaaaagaggaagggagggagggaggagggagggagggaggatatcaaaaccatgcattgtggcacacacctataattctagcaatgagtgggcggtaggggagggtctggtggaggcaagactatcaggaactcaggaacagcccaggacacatgagatcttgtctgaaaataaaagttgggggagagagaagggagaagaaatcagcacacacagtatctcacagaaacacacgagactgcctgacactttctttgttttaatcaactgctttggttgcaaagatcgcagctcacaagcacgacccattgcaattcccaggaattccgacttagttggtatgcgggtgtagccttggcatcagacttttacaagctccctgagacgttataatgtgaagcaaagcctaagaattattggcataaataactttggtctgaaggccacttttggcaaataacccccgaaagctgtttttgcaattctctctcaggccactagatggcggattgtccacacgatagcatttcaataccaggtgttttccaataactgttccgtgggcaagcaggaagctaggagagagagcagagcagattccagagcaagtattctgcaggcttggcctcaccgcgttggctggcatcaagttctgaggggcccacaaaggtgaaaggaaaggtacaaacccatcggattgttttaaccctggctttttctgcggtcaaagcgagacggttcctttcttcttcctggcctacatctttttcttgggtgtaaattacagcaaggcgttctttatggaaaggccgcaccctttattcggagtgaggctttttggaaaccttttaattaaaagtagctagttcgccttgttgcaaataggcaagaggcactatgtatttatcgctgactttggctcatccgggaatcaaactcggggcctcttgcaagctaagtgaatcgctctaccaccgagcaacacgcccagcctcagaagagcaatatttaaaccctatttatagattcagattagtgtgggagtaaatggggcgggtaggagaaaattgtgaaatcaagaagatttctgtcaccctaacacacaagagtgtgatttttccggaaaacaagcacctctgggcttaatttttctccctttgatctgaaaataaacaccagcctccacacttcttggtcgtgcactgttggttcattaaagagccatctgctgattccctgtaagaactcaacatgcaacgattatgggcaaagtccagagaaacaacttcaagacaatttttgtataaaaattagctctaaaacgaagcgtaatcactctatcggtgtttctgccatttggattttttttccccatcgaaatttataacatattcattttggcagattgtgtaacttctgtattctgaagtcagagcactcctgactgatgtaggctccatctccaagccggagagcaacaagcaggacacgagacaatcttcatggctgtctgttcactggttagcctgaaccttaaggcctggtggacctttctaccaaaatccaattagacaggattctccagagaaaacagaaccagtagaatgtgaataattaattgattgcaaggattggataatggatttatggaagctgaggagtccacaaggccgtaagcaaattggagactcaagccggctgctggtgcgggttccgtcaggaaaaccagcaaggctaagcttcagcctagctccaatcagtgggtgatggctgggtggtgagttagctccctcttgctcaggtcaagtcaccaatgcactggttggcaacccaatagcattgtcccaatgtctgccacagaattctagttccctgggatgttaataaaggcaagttgctaccaaaagtcccagtgtcaaataagtctggaatttcctgggtgagactgttaaacaaaagccttttcccgtaggactttctcagagcctcgaggtcacacaaaagagggtgatgctttgcaaagctttccaaacttaccatgttgctcagtgtttcgatgctgcaataaaataattgaaagaaagacttaaggaagggagaattctctctggctactggacccagttttaactcacagttggatggttctgttgtttgggggcccatcacaaagcagggaacagtagaagacagtggatctccttgtagtattcaggaagcagagagtaacacagaaagccactctcagaaggtatgtccccaacaccccacttcctccagcaggaccattttctgcagtctaccatttccttatgagttattaaaactccgagtctatgcacagatgaaaccacccagtaggtcacagcccttaggctctgcttgtctctgagccctttgcaaacacacccaggagtgagagctacaaatctcataggtgcatatcagtctaatcaagttgaccagactaaccatcacactcatgtgacacaattccttgttcaactttcagcgccccttctccagatactggccttgtggctttatcaagaacttctgagcagagaatgtctttagcctgattttgtacctagcccccagcttgggaatgtaaaatgcacggagtcaagtgatgtttgaaggtcagttaaaagcaatggcaaaccacagatgaaaacgcaacagaaagacggtgaggctataaaatcaagtgtgagcaagactagctggagtctgtctaccacagcacattcggccactgcctctgaggtccaaacgatgccaaatggactttggggacctcagactggaacctgggctttcaccatgctagatgctccagtgagcagaagagagactcatttctcctaagagacagggtgaatgctgtgcctgccgtgtcctgtcccttgctcctccaccatgcaggtgcaggtgctttcaaggctcccgttggctatggtacttctgtctgcttcaccagctctgagagcagcccacaggccctctagagttgaagtctgtgagtgctaatgctaatcagcaacttgacagactttagaagctcctgaaagaccagcgggtgagaatgcccgaggggattgtcttgattacatcagctgtagaaagaccactccttgggtatgcatcccagactgtacagaaaggagagagtggagtcagggagatagctcagtggttaaagcgcttcccacacacgtgtgcagatctgagtccggatccctagaaagctttgtaaatacctggcctgcctgtaatcccagccttagaaggtggatgcaaaagatgctcagagcaacctgcctaccgagaggagccttatctgggagctgttgatttgactgagagccctgcctcaatggataagaagatgattccctggcatcagggtctacatgtacaggtctccacacctgtacatgtagacccacacataagcaagcacacaaaatacgtgcacacacatgcaactggaagacctaagcaccatcatccatcactcccttctgattccagactccagatgcattgtgaacagctgcatcaagctcctgaagtcaggactacctcaccacagaggaccaataccctcaaccagtgagcagaagtagccctttgaccttcaggctgaatgtttatcccagcaacagaaaaaaaaaaaaaaatgagctaagacagagtttctctctctctctctctctctctctccctctccctctccctctccctctccctctccctcttcctctcccccccacccccttcttatctgtaaccctaggtagttctctgggatggagtttgcagtggcaatgtttaaatggtctgcggtggtgacttgacaataccttagcgtcttactgcccctgtgcccttccttagcaccctgtcagtggcttcagagattacacaaactactaggatcaggggctctggctctgggatgactaaggccccattagtttcttctgtggactctcctatcttgactccatcccagatgtgctgagtctgggaaaaccctctacatcttttctctgaggtctcaaacaggaaactacagttctttagtaacttctctttgtgtctctttcattcactcatttgaacttaggggagattgtgaggtgtcctgctattctgccaggtaccatgtttgtaggtgtgcatgtgtacatgtgtacatgtgtgtgtgtgtgtgtacatgtctctcaggtgaatgagctaggcttggaacttgcctccatgaagtttccagtctattaggggagacacacacagcacatcaccaccacgtggaacaacttgtgagaatattctgtgttctcaggttgcactcagcccccccccagtctccaagtacctgctctgccagtgagcttccctcctcaaggaggctctgtaatggaaactggtaagtagccccaggggctgtgaagaacagcaggaggggttctccagtcagaggagtgagagccacctccaccccaactgaattctgtgaggagggaaaaagaactagatggatgtggaggtagagcaaggaagagagactcagccagtggggaagaaagagagatgcaggcaacccaaacagcctaggcaaaggcttggcagacagatggagaaattgctctttcaatgccagaatctgataggttgtggaaagagaggtgaggagacaggccctcctcctaacccacagaaatgtggtccttaagtagagatgcatggatccctaaggagcacccatgtcccgggcaggtcagccctccaccacctttcctggatgtttcgacaactctgctgtcgtttgataggaccccagcctctgaagttcagttagatcacaaggcttactttgggcagacatgctaagctgccctccccaggaaagggtacaacactaacaacactaacggtgagagctgccctcttctcctctctgccacagcaatggtcacgagggtgcaattctgtcaggagcaccaggatgaccctagctagctctcggtcatctcgtgacataaggcagatagatataaaagcctgctgtttgcatccattgggagttgaggggttctgttgtactgcggtccagcccattccgcagaataaacctattaaagctgcttcaggaaagccacacagaagcaggactgctgcctggttagctacactccctgcagggccccacactccctgctgggacccacggagttcctttgactcctagcctctgtcacttcctacagaggtgctgggtctcactcctgcttttttttcatcgagaaaaatagcaatgactgtattcactgtgaaaattacataggttaattcatggaagaagcttggaaagttgccaggcacggagtaagtgctcaataaatattagctttattattaatatttctccgaaaacaaacaacagttgggtgccgcaggtggcctggatccctccttaggaaacatattatccagagaaaagtccccctgcatctgccttgggggagaagggtattgtgtcaagggacgcaagctcaaacgtactgactggaggcaccggggagccacattaacgtgagcagctttctttcacttactcctatgtttgttaaaggactgatttagagaaaatgacctcttcttccataaaacaagggggcacatagaatgatctgtgacagccatactggctggagatgaggtggccacagaatgtgtgtcccagctacaggggcagctggaaccttccccagtgctgatgtcctgttagatttcagcggtgtgtttttaaaaagtaggagatgctgagttaaaaaaaaagatatttattcatgtattttatgcatatgagtgctctgttttctacacaccagaagagggcatcggatcccattatagatggatgtggtcctagggaactgaactcaggacctctgaaagagcagtcagtgctcttaacacctgggccatttctccagcctgagatgctggagcgatttttaattgatttgttttaagatactcttgagagcacctgatcatatcttctagacaagacatgaccctgtcttagttagggttttactgctgtgaacagataccatgaccaatgcaagtcttataaaagacaacatttaattgggactggcttatagattcagaggttcagtccatcatcatcaaggcaggaacatggcagcatccaggcaggaatggtacaggcagagctgagagttctacatcttcatctgaagcctgctagtggaagactgacttccaagcagctaagatgagggtcttaaagaccatgcctacagtgatacacctactccaacaaggccacacctccaaatatgccactctctgggccaagccttttcaaaccatgcagaccctcacacgtataaactttcagcagctattgctacctgcagaagactgagcctgctaacattccattatggatatggaggggaccataagatcccatccctccatgaggagccaatggctggtgtgggtgggtgggtagggggggaatcataagagagtgttcttgtgccaaaaataatcatacacacactcatgctcacaaaaacaactctaattaaacaaagtgtgtcaaaactccctgaagcaggaggaatttgttagaaagaagagggaggagtgggagaaagaaacggagggtgtttctttttaaaataagggcctgggaagatggcccatccagtaaagtgtttgctttaaaaacatatgggccttaatttgatctctaatacacacagctttaaaaaaaaatggccaggcatggtagcacatgcctttaatcccagcacttaggaggcagaggcaggcagatttctgagtttgaggccagcctggtctacagagtgagttccaggacagccaggactacacagagaaaccctgtcttgaaaaaccaaaaaaaaaaaaagtaaataataataataataattaaaattaaaaaaaaatgggggactgtagagatggttcagcagttaagagcactggctgctctttcagaggtcctgagttcaattcccagcaaccacatgatggtcacaaccatctgtaatgagatctggcaccctcttctggcatcaggcgcccatgcaaacagaacactcagatagatagatagatagatagatagatagatagatagatagatcttttttttttttaatctaggcttagcagtggtatagctgtcactccagctctggggcggggacactggcagatactggggacttcctgtttatttattctagctggattagcaagatcacttgacagaccctgcctcagaaaccacagtggggagcaattgaggcagactcctggcatcaacctctggccttcacatgcgcacactcaaacagaacaaatttaaccaagggctggagagatgactcagaggttaagagcaatccatgctcttcagggagactcaagttcaaatcccagcatctataccaagcagctcacagccacctgtaacacagttccaagggaatccaacagtctctttggctctccgggcatacatgcacacatgcagcaagcacacacacatataaatagattataaaataaatatttaaaaattagctgacctataattgtgctgtatatctatggggtacaatttgatgtattgacacgtatttacatcctatgctcatccaaccaagtttgttagcacctgtcacctcacacatttgtgatttgtgatatgtgcactcgaaaacgtctctcctaggtatcttgaaatgtacaataaaaagcgagcggtgggtagtacatatctgtcatctcagcactaaggaggctgaggcaggagaatagctgcatgtttgaggacaccctatgttgcactgcaagtgtctttataatatgggtgatgcattagtgacagtctggtttgcccactacgggacccaacactgaattcacgccttgctcgctgtctctattgcacacttgcacctgttgctcctcacacccctccccctagcagggacctttgggaaaccggctacagctctaacatttatcgcctctccacagacacccccttctaattctaaggagttagaatccgttcttctgcctgctttcaccagtggccacatcggccactggtgggcggcccttcagctcttgttttgttgttgttaatatttatttggttatttagttagttcattttttttaagtcttactatgtagccaagggtggtcttgagttcacgattctcctgcctctgtctcctgaatgctggggtcacaggtgtgttccccatgcttcccttcttgaagattttcctatctccggtctctgcagagttcctttcaggctcccacttttctccgtgcagtgagttaggaagatgtgctcctctcttctgctaacctgagtcaggggatcccatgaactcgtcggtcagagcaggacggcggggggccttcaaaaccgtccccagtaactctggagttgacaccaggcagagctgtaaaagcagcggttctcagcccacggactccgaccccacagggtttgcatatcagcgctcctgcatatcaggcgtttatgccgagattcagaacagtagcagaatcacagttacgaagtagcaacaaaataattttgtggttggggtcaccacaacctgaggaactgtattagagggtcgaggcattaggaaggttgagaaaaaactgctttattttttttccctctcccgtgagtcagcctcttatctgtactgtaggtcgactagccaagaccctattcagagagtcacgtgtggcccaatccatcagcattccctaatccctgtgatctctctcagggaggatccacataccagcagccagcaccatagactcacgtccacaaatatctcaaacctctggtagcagccgaatagggaaagtgactctgaaggacgagattttaaacaactccacacaatggtgtgtgaacacttcacaggcctgccagggtttctggctgcctctgtctttccacctgactttcgccaaatggaactggcagacgtccccccttctcctacccgcccccaattccagtctcaatcctggtctaatttcttgcatgtggtctgagtacttagccgcacacgaatacaagggaacgagttggtttttaataacatgggagaggcaggaggcttctctgggtaatgagacgcggacagcctagcactctggaagaacagaaccttaaccagagattcttcccctctgactcgggctcattaatatagaaaacacttcctgccatcatgaaatgatgaagctttgtaatatgcacgtaacagcacagaacaaattaatgtagtttaggtggagtgacggaggccgtgggcaaagctcttgccagcaggtagggtatctctgggactgggaacactttgggctctaacagtccatgatgaagacttgcaccaaggcatgggggatcaatcacttcttaatgggttcccccaagaacccatttgagcaaaaggcagtgtagagggacaggcaagcatttgcccatgtgtgtttgcaaacttctgtggcacccagcagggcttcagccaacagaagatgggaagcccagcccactctgggcacctttgctttcttacagaagttgtgcctgtaacccaggcacccaccgggatagcaccggctgtaccaagactggtcttggtcacatgggttgactcagtgtctcttcccataagttgatgccttggcctatttgagatttggaatgtggccttgactggggttctgggaagaggcaagcaggtcttggccatcttgcttgggtcttggccatcttgcttggtcttcacaatagtcttgttgtggagggctggtatttcacccattttttaaaatgaggataaaattcagattgcaggattaatcactaatggtaaagagtactaccatttctacaggggaggaaactaagactcctgccagtcaatgactggaaaggcagagctctcctcctggacagctctggtagtctgaggtaggctggctcactcaccctgtgttcccagaactagaaatgaatagttgctcaataaacaataactgagtggatgaaatctagagtgactgacagaacaccccatcccttcaattgaaggagcccatcccttcagtttcataacacttcctggtggaggtgaacctccttccggtttctcagggcttgtctctagaccctgacaatcaagcctgtgactcagagcaaatttgagaagcgtgcctcacacagaggacctgttgagacaccggtgtctctttcctgtaggcatgtctgtggggcattttcttgattaagggcctagctcactggttcagtgctccctctgggcaggtggtccggggtcatataaaaaagtcagctgagcaaaacagctcagcgttcctccctctctgcttctgtttctagcttaggttcctgccttgagtttctgcctgactttatgtagtgctggactgtaagatgtaaaatgaaatgagccctttcatccccatgctggttttgttctgtgttttatcacagcaatggaaaccaacctaggacacccactgtggcttctgtgtaaactctgtccacccctaagagtaccctctatcagactttccacgggggaagccactgtcagctgccctcattgtgtgtctgtggccaagtcacttctctgagtctaattctgtcatctgtttttttttaaaaaaagagacaataataaggctcattgtgtgactggaccagaccaagtctgtgtaaaaatggtttgatgatgctgtcattagagcgtaactgcagacagtgtcttccatggtgtgtacataagcattcacactgtactaggctctcattgtgtgtttaaaatgggatacatacattttttttaataaaagaactcaagtagatactgcaatgagtaataaagaccaatttctttaaaaaaaatctattcattgttgttgttgttgttgttctcctcctcctcctcctcctcctcctcctcctcctcctcctccatcttcattatcagcagcagcaccatcaggttcacttctgccatggcctgaggcaaaagacttagttcctttccctctaccagggatcaaactcaggtggtcaagatttcagggcaagtcctttatcagctgagccgccctctcccaggctatgaagatgtctttgtgagggaaagacataatacccccaggggctctgtgtagctctgggagggacagggagggccctgtggtggaggaggcagagaagtcaaatcttcctgttcacagaagtgtggcaagatccctgccactgggagttaaactggagctcccccaatggatccacatcacccacaaggcagcccactgtggggaatccagatgcctgggtactggtacgaacttcctcatttctaacgtttctggtaacctccatctttatttccgtttacccacccaccgctttttaagttttccctgttggctgccaacagggtccatggtaacatggtcctatgggcactttttctcctgggtcattcatttttactcccaaatacttaagccacgtttagtgtcccattcctaccttctcaggcaagggtcctctggatgcctccagcaggactccaggaagttccagggtcactagatatttcccaggtggcccgtgtgctaagagttggccaggtgccttggcccctctcagccaggccaactgtgagaagacaacacagaccatgtacgccatttgctaagcttgtttctgtaactaggtgcaatctgtcattcagctgagtgaagttcccagcaacatcacaacatagtgatcatccataaatgatatataaaagatgatttttaaactccaagtaagtgatttctatattgattccaccttgagtagactatcccataggaatgcattcattaacagactgtgaggtatcatctaccacacatcttagctcacccagccctgctacccagggttgggcatgaccacatgcaactccacatgggaggaagctggcaaggatggacctgggataccagggtaggtcagcctgaccataccatccctacagagtctttaatctaagcctcagagtctctattttccaaactgtgggcatgccttgtggttcattcaaagacaaccacaagtagctactgatgggccaagtcaggatggcttcatgatcaacaccatggccttcagcatcacactggctggcttcaatcccccaggcgacttgcccactagtgatctgtgggtgtcctgcctcgtacacgcaggaaattctggacagcactatatccagaatgtaacgatttttgcccttggacttgagacctagtgcgagaggtcagtccctcttggagaaggcaggagtgccttctatgaccgtccatcaacaaactcagagcaggctcttgctctctgtcctgggcagattatttgtaatatgcacaatagagactctgcctgaggtctgattggtacagatctaaacatctctcctgttatccacctctgcctccaggcacttctctcagccgcatgctgcactctctgggattctacatttgaccttcctttgggttctgaatgctcctgtaacaaatagccagacagcgtattgacctacaccctgcctagcctctctgccacggtgtcagcattgtgttgagatgtggatatgtgttttctctggagggggttggctggcatgccctacacagggagacaccagagaatgactcatcagcccaacagcaccaacctttcaagcctcaggaatctcttgagctggtggctaagtgattgacagatgaaaatcagccgtgacagggatgttttcagcaggggcagtagatgctaggatacagggcttttcctgttggcatgcagattaagtaccagccagtacatcactaggtacatggctctggctttagccagctgatttcactggacaccaggagtctcaggtaaaggatccaaaaggcagtgacaagccaggatctgccactgcagcagcatctggatacattggcaacatctgtgggagcagggaacggtgctcaggggtgctggaaccagctgctatttcctagtatctctgactaggtcttccttcagcttgatttcctttgtttcctgcccagtttttaaagcctcttctgccttcttgtcagttccaaactgtccctttctgccctgctagccagaaccagttcctactaagagtctctgccttgtagagatgcttaattatttgatagtacatctggacatagagaaccctcccattttgcttccttaagacgaagggctatgctcatttgcatagtaaacctatatggagtacctacaggctgtgtgctatggcagacctagtgtcaggacatgtagctgactaggaaaagcatgtctctgtccttgggaacttattgaactaaaagaaggccaacatcaaacaactaattatggaattaattcttcactgggtcctcccatcagcactgggtgacgccaaactataggtaaatatttgaatcccacagaggatacaaaggaaacatggaaaccggagacaccgctcatgtctcccttccaaagtcatcagttcagctggcaatagagccgagagcttatgtaactaagaaaccatcccacgcaagttcccacaccagagggacacgggggtcgttagtgtccaattcgggggatcagggaagactttgtgggggatttattcacggccttgacagtggatcacaaagagctcagcaatgaaggaagaaagcatccctgtaaaattagccacctaaagttccgccacccaccaaggcccacagtttagtgctgccatgagtcccctctgaacagccacaggacaagatccacttatacacgctgttgactccctgctgtgtccatttaacagtgtgtggtggatatttggcctctgacaattattcctagtctacatcccatttaagcagccaaagacgattccattacatgggtgtacagtaaacgaatcaaatccctattaatgaacatttagggtttgggtcaagggtatatacactctggaaccccaaggcctgagcctgaatccagttagtgacctggctgggtggtaggaggaaggctgtgtttctgaaggcgtggtccttccccgtagcagaggtacctgcagatggtaatgatgtgggatattcagaacagtggttagcacccagggagcgctcaatcaaggctcggatcggacaggctataagcactctgtcatcctgaccaaagtgttggtttgctcccctctgtttcatcactcaaaacacccaaagtgcacacagtcaaaaagcacatacatgagcgcaatcatctagtcaccactgtgatcggtaagaggtagtgaacgaggagagcctctgactccttcctggaacccatcaggaccctcccgttatccacaaaccatctagtgaggtttcttgatttgccttctgggtggccttctggaatctaaagcaagaggagcattcataacaagtcaagtcagacgctttcactacgatttcaaggaggggaagctggagtcgaggccatgtttgaaaatataggtcaaatcttggtttctgtggttactgaacactgtcagccactgtgactccctctgtgtgggtgatgccaaggttcagaggtctgacagccctgtctagctcctctacaagtgtcacctctctcgcccctccccaaggtctgaggcttctctcagccctactgacccccaggcccgagggtcctgagcttgggcaacacccaggagtaagctactgcaggtaccttgctcttcatgcctgaggttgggggcggggtgctgggactgctgctgctgaagttcgggatgtctccatacccctgcagttctacccactagtctgctgctgcatgtggggactgccggggagcagggag

SEQ ID NO: 253 - DNA, 216561 bp, Mus musculus
atatttaaaattttaatgataccagaaaaatttatattctacataaatatgtagaatacatatatacatatgtatatatgtatacatatatgtctgcatatatatatatatttgcactgcatatatatatgtctacatacatgtgctgcatatacgtgtgtgtgtgtgtgtgtgtgtgtgtgtgtgtgtatgtgtataaaatgtactttaggctaaaaaaaatgacagcttgactttcagatctaagtagttttcatgtcaaaagttactctttctcctgttaacaggtgaggccactcacctctgcttctgagtatttttgcttctgcctctgattctgagtattgtgctcatttaattgagggaatttcaccaatcaaggaaagctacccttgaattgtcatctataaacaagaggctgacagctctaatagttcaagtgagggtgattgatgctgctgcccctgcctgagaagtaggccatctatgtgtcatcaggcatctgcataacctgccgaagctgagtgtgcttccttctccctcctctgctctctttggacccagaaagtggggcagcactggtgttgctgaaaataggaggctcctaaggcttgatgttcattgtctttgaaaatccaaggtctttgtcttgcaaataagaagattcttccatcagttcttaggaaagagacgctgggagaagagaaaggcaaaactaactcttaaaaagcttgtttaatttaaggaaccccctttaataaaaataatgcagccgtgaatctacaaattaactatagtagtataggaggctataaatagaaacttctataactagacactttaaaacactgaaaaataccaaaaccatcacaaaatccagaaacctatttcagtatattttccttaactgcctgatatactttttcatattttatgactatatattctttaattgctgcttcatagtataataacattgccatgtaattttctcttgagagaatacaaaagtataatagctgtttgtgcaaatctgcacgtaagaatggagttccttattgctattgattgcttaaatgattttcttttagctttaccacccattaaaggaaacataaaattttagtgtggatgtcagacttcttttatattagtgctgtctcaattttctagcaatataaggtcctaattttatgaattttcaaccttttttctcctgctaacacatttcctagtcctttggctctataatttgtcatgcaaggtaatgtttctaaatgcttctttataccggaatgacaaatgttagctgggcattgtaactacaccttacataaatatattcattaataccaagctaaacacattttttaaaatgtcttatgatctccaaatcaatgagaacaaaagctacaaagggtcagaaaggaaggcagaggatgcggtgtttcaatcaattatgattaaaaatcttgctagtataaattttgcaaaatgtatggctgagttctatgcaactaataggtctaaaacttaagaggactgatggctcattggtggattctcatctgcctgaaatttgatttaattggcataattggaaatgtggcttaggggaaccaataaaggttgtaacctgctctgagccttcttacccggccctgacggttctcctacatttcccaacaacttctagaaagtgaccatcaaaaagttaagcatgcagctcctaccaaatgtatttaataatggaatgagtgtatgcagtgtaaaggaaaaaaaaatacacggacatgaacagatatgattatcaacacagtgtgcttgggtcatgacaggactgctacactcttgaattcacagtagttataattacctgcataagactggaaaaagaccaagctagtcctcactctatctcagagtgggagaaagtttaagagtgcaccctccactccccactgaggatctatggacaactgatgacttctaggggaaagacaacttacttgaagggtgccagcaacttgataggtgggccatgctccagtggatgggactaccataaataaatgggcagcacatattggagaatcattattatacagataattattattgacaggctagtgaggtagagatgggtctgggtgtcaaaaagaatttggatagagatatgaaaatacacttcttagttcatattgttgttcctcctatagggttacagacccctttaagctccttgggtactttctctagctccttcattaggggccctgtattccatccaatagttgactgtgagcatccacttctgtatttgccaggcactggcataacctcacaagaaatagctatatcagggtcctgtcagcaaaatcttgctggcatatgcaatagtgtctgggtttggtggttgtatatgggatggatccccaagtggggcagtgtctggatggtccttccttccatctcagcaccaaactttgtctctgtaactccttccatggggattttgttccctattctaaggaggaacaaaaagaaggaggtcttccttcttcttgagtttcatgtgttttgaaaattgtatcttgagtattctaagtttctgtgctaatatccacttatcagtgagtgaatatcatgtgtgctcatttgtgactgagttacctcactcaggatgtgtctctagttgcaggatggcctagtcagccatcaatgggaagagaggcccttgatcttgtgaagatcatttgccccagtacaggggaatgccagggccaggaagcaggagtgggtgggattgggatcagggcgagggaagagtataggggactttcggggtagcatttgaaatgtaaatgaagaaaatatctaagaaaagaaaaaagaaagaaaatacactataaggaattctcaaagaactaataaaaataattttggaagtatgaggaaatgtggtgccagtgacgctggctagtttaaatataataaaaaatataaataaatttataaaaacaagatatgttaaacataactgattaaaataacctatctttatactttgtcttttgagcctttataccttttgttttcgctagaaagcagaagttacaggaataactctctgcgtattcatttacacacgggaattatgtatctatgggtgcaagacctttggcccaggtagaaacacaccatctggatccgtcctgtaagaaatctacatcatgagacagatgtgtgaattcaaattcatgtaacaagagaaaaatacataaaattatcaaaacaactaaaagaatatataggtgaacatttgggttatatatatgacagaagaaaacaaaatgaaaaaaaaaatccaaagattaagtacatcataattaagcataattacatgtactatcatcagccaaatcaacaagtcaaagtaaggtgagagaatgtacaccgtgtgtaaatattgattgtcaaattgatgagatttagactcaccaaaaaggcatacctctgggtgtgtattggagtgttgtcttggttaagttaattggttctggactgtataagaaaaatgagaaagctggctaagcatctgcatttcttactttctccctcctgtggattcagtgtggccagcagcctcacgtacctgctaccttgtcttccccatcatcttggacttccttcatactctaagccaaaaggaacccttcctgtcttaagttgctttgatcagaattttgtcacagcaatgataaaagcaactgatgcacagaataaatataatttatatctcaaagattatataaattatttgagaaaaaaatgtatcagtagaaaaataggcaaaggttaccagtgtataattcactaaagaaactatgatggcaggtaggtgaatgtttattcaaaataatagaaattaaataaacaaagctgagttatatcatatttttacttaataatatataaaggtctttcatcttaaaggtataaatttgttccgatggaggtgtgttgaaaggactgctaatgcgtacttccagagctattcatttgtggtgggttgaattgtgcaagtcacagttgttgatttccataagcaaatatttctagttttcaaactctcctgaaagatagagattttaaataaagaaaaggagataaagttgatagtatctttatttataaagaccaaatagtagatattaactatgtatccaacaatagagaatctaataaattataatacctataaagaaatattttgaagttataaatttcttagtctctattgcaataaagctaagcctaaagtataatatagttaaaaataaaaataaactaaaaattaaataaataaaaactaaaataaaaatacaatttgaaaaattaaaaaatagttaaaggtacttttaaataaacagcatatatgtatgtattcaagcttattaaaaatgcaagattattagggtgttcatataagaattttaaaaggttctcaatagtcacaaataatataaaatatcttggcgtgactctaactaaggaggtgaaagatctgtatgataaaaacttcaaatctctgaagaaagaaattaaagaagatctcagaagatggaaagatctcccatgctcatggattggcaggatcaacattgtaaaaatggctatcttgccaaaagcaatctacagattcaatgcaatccccatcaaaattccaactcaattcttcaacgaattagaaggagcaatttgcaaattcatctggaataacaaaaaacctaggatagcaaaaagtcttctcaaggataaaagaacctctggtggaatcaccatgcctgacctaaagctttactacagagcaattgtgataaaaactgcatggtactggtatagagacagacaagtagaccaatggaatagaattgaagacccagaaatgaacctacacatctatggtcacttgatcttcgacaagggagctaaaaccatacagtggaagaaagacagcattttcaacaattggtgctggcacaactggttgttatcatgtagaagaatgcgaatcgatccatacttatctccttgtactaaggtcaaatctaaatggatcaaagaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacaccgtcaataagacaaagagaccaccaacagattgggaaaggatctttacctatcccaaatcggacaggggactaatatccaacatatataaagaactcaagaaggtgaacttcagaaaatcaaataaccccattaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtcagaatggctaagatcaaaaattcaggtgacagcagatgctggcgtggatgtggagaaagaggagcactcctccattgttggtgggattgcaggcttgtacaaccactctggaaatcagtctggcggttcctcagaaaattggacatagtactaccagaggatcccgcaatacctctcctgggcatatatccagaagatgccccaaccggtaagtagaacacatgctccactatgttcatagcagtcttatttataatagccagaagctggaaagaacccagatgcccctcaacagaggaatggatacagaaaatgtgatacatctacacaatggagtactactcagctattaaaaagaatgaattcatgaaattcctagccaaatggatggacctggagggcatcatcctgagtgaggtaacacattcacaaaggaactcacacaatatgtactcactgataagtggatactagccctaaacctaagatacccaagatataagatacaatttgctaaacacatgaaactcaagaagaatgaagactgaagtgtggacactatgcccctccttagagttgggaacaaaacacccatggaaggagttacagagacaaagtttggggctgagatgaaaggaaggaccatgtagagactgccatatccagggatccaccccatattcagcatccaaatgctgacaccattgcatacactagtaagattttatcgaaaggacccagatgtagctgtctcttgtgagactgtgtcggggcctagcaaacactgaagtggatgctcacagtcagctaatggatggatcacagggctcccaatggtggagctagagaaagtacccaaggagctaaagggatctgcaaccctataggtggaacaacattatgaactaaccagtaccctggagctcttgactctagctgcatatgtatcaaaagatggcctagtcggccatcactggaaagagaggcccattggacacgcaaactttataagccccagtacaggggaatgccagggccaaaaaggggaagtgggtgggtaggggagtgggggtgggtgggtatgggggacttttgttatagcattggaaatgtaaatgagctaaatacctaataaaaatggaaaaaaaagaattttaaaaggtagacaaaatgaaaattgtatcagtaaataaattataaaacatcacatgataagatactgtgaagttctaccagtgattaagtaatttgctcatctttcttaataatgcaactctaattctatttgaaacacccatataaaatgttatattctctaactcttctttactagtacgtactacattctagtaaacaagaaaaacatacagtatattgaggggtgcgtctgaggctatttctttgtaggtcagatagcaagtagaaggtattctatttgtgcttctgtggaggacgtaggcctcagggatctaaagaacatctcagaccctgttaaaactctgaagacagaaagtacacagtaagtctggtaggacagaagtatgaaaagatcttgcatctctaatagccatggacatattcaatacggatggggtgggctctttttatgtttcttaaaagtgaaggagaaatctcttatttaggtcatcaacctgagctctctgttgtatgtatcaaaacttacctaaaacaatggcactttaaaaagaagttggtgacatttataacagaagaaagtgaaacaaatcttcccacttggaaaaaagtacaaaagttatttttttttcaatttacttgaatctatataaagaagggaagtgattaagcacatagggtaaaaatttgagaagaatgttgatggctgtggatggcagctgagaggctgagagcctaaatcatgctttacagaaaattttagagttgagggattaaatatgaaacataagccttccatgttttatactgggaatataaaaacctataccttaatcgtaaagataaatcaaatataccaactttctcaaagggaacaaaaagataagattccaacaatttcaaagcctgaaattagattaaggttatcacagattgtgtccttagttatttcccagaagcaaatgtaggctttggtgatgaaaaataccattatcatagttgacaaattatttccatagttattgcttgcttatatacagcatcttgtgttcagtcaaaaataagttggcacacacacacacacacacacacacacacacacacacacacgcgaaacaaacctgaagcaaaacagagagggaatagctgatgggggccaaatgttcaaatatctttataatggaattattaaaaataaatgttgagtcaaataactagaaaatgggtttattgagaacaatagtgaataggtacaagaaaatagacttcaagattcaaaattgtttttataaaagagaacccactggaaattataaaaatgaatcaaatcaaaattctcaaaagcaaaaaatacaaaaagcaagttgtaatttagaatgaaattgcagctatcaagcaataagaagtaaacataatgggctgtactcctagaccctggcaagaaaactactcaggtttctaaaaagcctggtgatttccaaagttttaaggatgctaggtgaatctttttctaatgttcaatctctgttctccttccagagacaggcttcacaggcgtctagataagattggggaagggggaagaatttctgatttaacatttgaccttgtaaccattattcctggctcagcattcctaacactgtgggatgtcttggttaatgagatgttatatgttttatgttagtaagatgactattggttttaaaaggtagccaagaaagtagggggcgggggggtggggtaggggtagtagtcaagacaccaaatacctagtaatgaagattagaaattccctcctctagttctccatccccactgttatacccctctattcaatttcctgaccctctacttctcactgcccctgtctcctcccacacctgatcctgccccccatttgccctctccctcctttcttcctcccaggtcccttcctccctttacctcccatgattattttgttcccccttctatgtaagactggagcatccactttggtttccttcttgagctttgtatggtctgtgagttgtatcgtgggtactacaaacttttttcctaatatccacttatcagtgagtacatgccatgtatcttcttttgtgactgggctatctcactcagtatgatatcttctagttccatccatttgcctgcaaatttcatgaagtcactgtttttagtagctgagtagtacttcactgtgtaaatgtaccacattttctgtctccattcttctgttgagtaacatctgggttgtttccagcttctagctactataaccaagactgctataaacatagaggagcatgtgtccatgtaatatgttgaaacatcttttgagtatatgcccaggagtggtatgggagcaccctcatagaagcaggggaaagggtggatgggatagagggtttgcagaggggaaatcggggaagagagataacatttgcaatgtaaatatataaaataaccaattaaaaaaaaaagaggttcccatccccttcctctggagaaagaagagggctaaaggttggtatgatcaccaggaatcaatcacataattaactgtatttatttaatgaagcatccactgcaaactaaaagattgtgtttggctgagctttgcagatatttgaaaacatggaggatagcatgtatagagagggcatgaagctgttacctttccacatgcttggtgctaagtatctgtagggacttgttgttcagctgtattttctgtcatgacttgtataacatactagcaaataaaatgaagtgtttccctgacaaaagagcatgggagcttcctgatttattgctggctatgagcttagctcacaaatggctggttttgattgacataaaaaaatgtgagatatgaattggggagattgctcgttggctaaaacactggccactaaagcttaaggaccttagctcaaatccccagaactccctttaaagtcagatgtggtagtacatgtctgcctctctgtgctgctatagcaatataggaggtggagacaggagaactcccaggagtttgcaggactaatatatttatcagtaaacagcaaaagaaaccctacctcaaaaaaaaaaaaaaaagggcaggcaagggctaacaactgagattgccctttgacctccatatgagtttcatgcaaactgcactcacacaaacacacattcagacatgtctaccatatatgcatataaacgtgggaagtcttgtgagactaagaattcaactcatgggatctgatattgtctttcagattgatagtatcaggattgacttagatagggcactcaattgctaccttctagcaattgaaaattaaattgttgctttgatagaggaatcaacatatatttagtcattaatgattgggggactatttgtactgagtggcttatgagaaaagggaaaactcaatttttgctggtttgtaatatcacagaaaagttgaagaattagtgaattgaggaaaacttaaaagtttttcagaggaaaacattcagactgaagcatatactttcaaaagcatgagaaatattaaagtaaaagagtgagatttagatgaatcagagaggttgacaatttctagactgtcaaagaaaatagaaatagagatcatataatattagtgagtcataggtttttttattcaagtagaatatttcaaaagaaaacaaaaatatctttttttaaaaagtgctttcaaaggaaaacaaacaaacaaaaaatctcttaaaaaaggtgctacatagctcaggattgctctgaacttgtagctattttcctgactcttacctcccaagtattggtactataggcatatgccataatatccatgatatttccaaaatatgttcatctaaataagaccttcaggacggcaccactagttgacatgccaagatgggtggaggaaatcccacaagatcccacccatataagggggcactataggcaactggtggctgccaagaagagtagaatcagtcttctagagagagaagtcccctggaaggttatgcaaccacaggtaaccatcccaagtaaatcacacatacaaacaacactgaatggacacagtggattatacttatacatttgtgtgtctgtatgtacatatgtaacaatgctaatttaaaaagtggagatcattaatttgagaggaactgggagatatacgggagaaattggaggggtggaaaggatgtaaattcagtacttatgtgtactcataacattctttttgaaatataaattaaattaaaaattaatttgaatctttaaataaaaattatcttgcaaaatatattcaagcctaggttattttatacaaattgtttaaggaatgaaaaactgaagcgtataaaatatcttccagagagtagaaaatgttcacacactttgactcatttttagaggctagtatgtttgataatgaacctaatgcaaaggaaaatttatacttcagtgtgtcttctcatcacaaatgaaaacaaaacctaaattaactatttaaaaaataaatattgctatcataagaataatacctcaatattggttgggtattctatattacttgaataaagaaaaattcaatgcatacagagaaaatatgttacattcaaaatctgctcacaataaaagctcataacaagttaagaataaaaaccttggggctggagagatggctcagctgttaaaagcactgattgctcttccaaaggtcctgagttcaaatcccagcaaccacatggtggctcacaaccacccaaaatgagatctgacactctcttctagtgcgtctgaagacagctacaagtgtacttacatataataaataaataaataaataaataaatctttttaaaaaaataataaaaaactttgaaaaattatcaaaaatttagcagatatcctacctgaagtccagtggaaatatactacctgtaacaaaatgtatttctattaatgttaatttagtcagtatataatatataataaggaagatataaatattgaaagaaaatataagaaagccaaaacaacctacagttaactttaatatcattatgcaagtcagtattttcatgtaagcatccatagatgaatcatacatggatggatggatggatggatggatggactgggtgatttaactcaagaagaatatagaactacaaagcagtgaggaagtaattatcattctaattagttttgagtcatctaggtagagatatcctaaaataaaatattttaattatacaaaaattacatatatatgacaaacctaggctctaagcacaagaacaatgaaccataaaagaatatctctagtttttggaggcaaataaaaatttctcaaccacaatcaccccccttgtagaggaactctatttaagtgaggggttgtgttcgtgcacatgcacacatgtgccccctccccccattcctacttacctctcccacctgttcacttccctttcacactttagcctcatgtgttccactaactctttaccttaagatatttctccccagcctaacaatgccctctttttagtttcctggcttttagaagtttaaaagtactcttttattttattctataatgtgtgatgtctgtaacattctctaaaacaattattgtttagaaatcttaaaagtactttttaaattttatagaaactatactttgtctatgtataaggatgcagggtatttgtatcttctaaaagggaaaagattatggcatttaaaactaaaaacaatacaatcatcatcccagcacccagaaatgatagtatttttcaaaacatatgtttgtcctttaagtgcccattctgggcattgaggggggaaaacacccacaatcactactttatccatctgaataaacaagttttaacctttagtgacagtatatagttaaaacggtaattacagaggcaaaatttaagtgtttatataaaacaatacaacctcctctcttctatacccagcaaatcctgaattatgtgtatgagcaacaatcaaattatatgcaggacagtagtttctttgtttgctttttattattgtgtaatattatagcagacaaatacagaacaaaatttgtatttgtattgtttccaaggttggagcaattgtaaatcacactgctttgaccaatagctatgcatacatctcactttgaaatatacctaagcattagctttccttataaggcaccactatctatatatccagctttacataccctgtaattccaaatcgacaattctgaaccgacaggctatgtgtggtatacaatgcttagtgttactagtcttgttttaacgttgataattcttagagatttttattttcactgccttgatatgccttaatacttagcactttttcaggtggacttcttcttgtgtggtgtctaatggtctgtgacaatacactcatttggaggatcttttgatgattagaagttcatacatttaatgttgactccttttatactttatggattctcgttgagaaactttgtatttttgcatccaagaactcaagatactgttccagagtttcttttcatcttttgttggtagtcttatctagcttgaatgctatgaactaaaataatgactcttaaggtaaaatatgcccatgagggcaatagtggtacaatcattatgtcagtaaccaaacacttttgaattggatataagtcccaatacacaagaggaaactcatcccagattcacgctgagtaatacatttctgatcaggaacctgtggctggagcatcatatgcctgaaggaagaacctactataaatactttgctccgtgaacatgatatctctctactcacagattaacaacagttctcagacctgaagcttctttatgcaactaatagcattttgtgcagaggctcacacctgattaaatgtaaagagaatcagtgcctgagaagtgctcagccataaattgaatatgtcttcagaaaggctcagtgaacatcacagaataggggacagaaagactgtaagatccagagtgttgggagccgcccccacattcgccgtcacaagatggcgctgacatcctgtgttctaagtggtaaacaaataatctgcgcatgtgccaagggtattttacgactacttgtactctgcctttcccgtgaacgtcagctcggccatgggctgcagccaatcagggagtgatgcgtcctagacgaaatataactctcctaaataggaaaggggtttcggtttcgttattggggtggctttcgcttttggggctgggggtttgcgctcctagctcctgaagatgtaagcaataaagttttgccgcagaagattctggtctgtggtgttcttcctggccgggcgtgagaacgctattaagaattggtgctgaaacccgggacgagaaaaaatccgggacgaaaaaatacaagaaaactcgggaccggcgcaaggaagatccctcattccagaaccagaactgcgggtcgcggtaataaaggttcccgtaaagcagactgttgagaaggattcaactgcatgaattcagaacttttcagctggggaacgagagtaccagtgagtacagctttacgaggtaagtctggtcttgaactttctaaggaaattcaagacagtctatcagaagtaaagtggaaaatgtttggccttgaattttttctagtgttaggagcccttttgttccttttcacatgttatcaagtggttaaggcagggcggattctagatgaaattcaggacaatctatcagaagtaaagcggggagagagagtaggagcaaagagaaaatatggtacacaaaataagtatacaggcctttccacgggtcttgaacctgaggaaaagtttaggtcaggtaagaatacctggggagagattggaaggaaggagaagaaaaaagaaaagaaaaaagatcaattagagaagccagttcttagtagttctgaatcagatgaaaaggctattagggcctggaagacgctctcccgagcaggtgaagccactggacaataatgacagaggcaggctcttgcagcctacaaggtcttattgtctaccctggagttgtagatcaagattgtaaaggggaacttcaggttctctgttcttgtcctcaagttgtcttttctatatcacaaggggacagaatagctcaactaataattttgccaagcctacatggctgttttttcttcctctagtattcctagagctgcaagagggattggttctactgaaaatgattctgattacttaataatgcctttagattgttgtcaaattttatctactcacgtaggggtaaaccctcgtggcgtcaggccattacaggtctgacaaatggatgtcacgcatatttcctcctttgagagaaatcaatatttatatgtttagataagaagagatcacctccataccttaaatgattttcaaaagctgttgggagatattaattggctcagaccttttttaaagattccttccgctgagttaaggcctttgtttggtattttagaaggagatcctcatatctcctcccctaggactcttactctagctgctaaccaggccttacaaaaggtggaaaaagccttacagaatgcacaattacaacgtattgaggattcgcagcctttcagtttgtgtgtctttaagacagcacaattgccaaccgcagttttgtggcaaaatgggccattgttgtggatccatccaaacgtatccccagctaaaataatagattggtatcctgatgcaattgcacagcttgcccttaaaggcctaaaagcagcaatcacccactttgggcgaagtccatatcttttaattgtaccttataccgctgcacaggttcaaaccttggcagccacatctaatgattgggcagttttagttacctccttttcaagacaaatagataaccattatccaaaacatccaattttacagtttgcccaaaatcaatctgttgtgtttccacaaataacagtaagaaacccacttaaaaatgggattgtggtatatactgatggatcaaaaactggcataggtgcctatgtggctaatggtaaagtggtatccaaacaatataatgaaaattcacctcaagtggtagaatgtttagtggttttagaagttttaaaaacctttttagaaccccttaatattgtgtcagattcctgttatgtggttaatgcagtaaatcttttagaagtggctggagtgattaagccttccagtagagttgccaatatttttcaacagatacaattagttttgttatctagaagatttcctgtttatattactcatgttagagcccattcaggcctacctggccccatggctctgggaaatgatttggcagataaggccactaaagtggtggctgctgccctatcatccccggtagaggctgcaaaaaattttcataacaattttcatgtgacggctgaaacattacgcagtcgtttctccttgacaagaaaagaagcccgtgacattgttactcaatgtcaaagctgctgtgagttcttgccagttcctcatgtgggaattaacccacgcggtattcgacctctacaggtctggcaaatggatgttacacatgtttcttcctttggaaaacttcaatatctccatgtgtccattgacacatgttctggcatcatgtttgcttctccgttaaccggagaaaaagcctcacatgtgattcaacattgccttgaggcatggagtgcttgggggaaacccaaactccttaagactgataatggaccagcttatacgtctcaaaaattccagcagttctgccgtcagatggatataacccacctgactggacttccatacaaccctcaaggacagggtattgttgagcgtgcgcatcgcaccctcaaagcctatcttataaagcaaaagaggggaattgaagagattttaccccgagcaccaagagtgtctgtgtctatggcactctttacactcaattttttaaatattgatgctcatggccatactgcggctgaacgtcattgttcagagccagataggcccaatgagatggttaaatggaaaaatgtccttgataataaatggtatggcccggatcctattttgataagatccaggggagcggtttgtgttttcccacagaatgaagacaacccattttggataccagaaagactcacccgaaaaatccagactgaccaagggaatactgatgtccctcgtcttggtgatgtccagggcgtcaataataaagagagagcagcgttggggaataatgtcgacatttccactcccaatgacggtgatgtataatgctcaagtattctcctgcttttttaccactaactaggaactgggtttagccttgattcagacagccttggctctgtctggacaggtccagacgactgacaccattaacactttgtcagcctcagtgactacagtcatagataaacaggcctcagctaatgtcatgatacagagaggtctcatgctggttaatcaactcatagatcttgtctaggaacaactagatgtattatggcaaatagctcagctggggtgtaaacaaaagtttccgggattgtgtgttacttccattcagtatgttaaatttactagggcagctaatttgtcaaaaagtctttttcagtatatgttacagaattggacggctgaatttgaacagatccttcgggaattgagacttcaggtcaactccacgcgcttggacctgtccctgaccaaaggattacccaattggatctcctcagcattttctttctttaaagaatgggtgggattgatattatttggagatacactttgctgtggattagtgttgcttctttgattggtttgtaggcttaaggcccaaactaggagagacaaggtggttattgcccaggcgcttgcaggactagaacatggagcttcccctgatatatctatgcttaggcaataggtcgctggccactcagctcttatatcccatgaggctagtctcattgcacgggatagagtgagtgtgcttcagcagcccgagagagttgcacggctaagcactgcaatagaagggctctgcggcataaaatgagcctattctagggagacatgtcatctttcaagaaggttgagtgttcaagtgtccttcccccaggaaaaacaacacgggaccagaccaggacccctctgggtgatgagcctgggaggaggttatgtgtacggctcctttacctacacactggggatttgacctctatctccactctcattaatatgggtggcctatttgctcttattaaaagaaaagggggagatgttgggagccgcccccacattcgccgtcacaagatggcgctgacatcctgtgttctaagtggtaaacaaataatctgcgcatgtgccaagggtattttacgactacttgtactctgcctttcccgtgaacgtcagctcggccatgggctgcagccaatcagggagtgatgcgtcctaggcgaaatataactctcctaaataggaaaggggtttcggtttcgttattggggtggctttcgcttttggggctgggggtttgcgctcctagctcctgaagatgtaagcaataaagttttgccgcagaagattctggtctgtggtgttcttcctggccgggcgtgagaacgctattaagaccagagatcaagaaggactgtggcaagaccttgttctggacatgttctggactattatagttatgcattcacagcagttgtggttgtctgtacaatacatggacatcaagccagctgagcatgggcaatgcaaaagtaagtaagcaattggccctatctggaactattgactgttaatggctgctaggggaaggagagtcagcttgctttagagctcctggccaggctctagtggatagccccaaccccatgagcataggcacaacaataattagatagagtgggttatcttttttaaatgacatactgttgaaagggagacataatggaaaactctggaaagtgttcgactgaattagtgaagatggatataatcaaaccacattgtgtgcacataaaaaaatctcaaagaataaacaaaaaagattattattatttttaaatgaacgggttagggtaaaaattaatcttctccatagcttaatttcacaatgactgaggtggaaaactgaggcatcaacagaggcaaaaatacagtcagggtagaaggtatggatttggatcttagaaagctcaccaagacataacggtcactatctactgcatatgagcaaaacagaaaaatttgtgaggagataagttgtaaatatgtgtctcaaccattgccaagcatcaggatttttgatcttctaattgtctgaagaagtctttcttgtcatagctttacattttaaaaatatctattgactgtggaaatatatattagatgaaataaatataatgagacactagatagatgaaatggattaattttttaatgacatgcagttgagaaggagacataatagaagaatctagaagatgttagattcatctccaaattgcttctgaaataagacttggattagttaaacaaatgctcactgataattcaacccagaaggagaagagtaaattaatcagtgtcagaatcggggcaacaaagttctcaataagccagaacaatagaaccaaattccaagacaaggcattagggataactatatctaccaatacaaacataaacagtttaggaaaattctcaatgcacataaagaatgggggaaggaagcgcattacacacatatgcacacacatacacacacacacacacacacatacacacacaacctaaaggtttgaaattatgtgtagccaggtacaaattaatgaagcatatgtgacagcagaaatgtaggtcatgtctaggctataagtgctgcatcctgaacaggaaagctaatagttccatcagacattttactggccagaataaaatggaatattgcaattgaccatggatgattgtcaaggattagtgaccaagatggtgagatgtctggaaatcatgatttatggttcttggaaaagaagaaatctaaagagagtcagcaggactgttgattatctatgaaacattgtattccaaataaaagataagtgctgaatattgatatactataaaataacaaagaagtacatccaaatgtaggacagattatattttgaattttcagtgagaaatattttatgttgataagagaaaagcacaatacacacatacacatacatgcacacataaacaaacacacacatatatacacacatatgagcacacattacatcaccctgaagtccattatttgtataattactaaacaattgaataaaaagaaatttaataagatggtacattaaacatatttcaacagtttaaacaaaattaacaatgacccttagactaagcccaaaagaaattaaatattcaagtaatttaaaagctgtttgagaaagaaatatcttaaattaatatgggtagttttacaatctatatacattttcctaactagtgcattatataatattatgccatataatgattaataatttatacttttgtgtttcatgtttgctttctctaatatgagttgcatgtggtatatgtagacatttgtatgggcgtgtgaacatgtgtattccggtacacacatgtacatatgtgccttttcctgggatggctagaggtcaacgtctagtatcattttctatctctctccactgtacttttggagagctctctcactgatcctgaagctcactgatgggttaggctggctgactagtgcctcccaggactcgggttacagatatcttacagatatctgccacctcagtcagattttatgtaagtgctaggaatccagattcaggtccttgtgtgtgaccgtcatttcagccccttggtgtgaggttttctgattcatccatgctgacagatataagaataatttgttggtcttctccagagtgcaggctttcacatgtttggaactaaaatcatttatccactcagggatgtacactgaattgcttctggccacataagatgcttacacaggctagctagtacacacgggtttattaaagtaacttcctcttcactaggaaatgttcagcaggtcaaaatggctgggcccatttatctttccttctgcactggatcagagcctattgcttcaagctatggccattacttgtttggtatttagactttgaagttgccaatatggtctgcatgaaacaaagaaacatatctaattgtcagttgtacctgcctctcccttcaaagagatgaatttcagtagtccacatatgttaaaaaggtatttattattcattttctgcagatgagtttatttttgttgttgtataagttactatggttttttttttctgttaatacccagacactaatctttttgttttgcttgtttggttgttctataatgatcttttataaattcttgtatatttgcatgagtattataattgctgatttaatatctttaaatattaatttagtatcacctgtccatcatttacagtttattttctcagtctctttctttatggtctgcctttgtataactttttatataatttcttttctgccatgatttaggaaaaccatgtcttcaagttttcttgagttttggttttaccacatttctttatatctatctatctatctatctatctatctatctatctatctatctatcattgctttgtgtgtaagtgcccagatgtacatgcatgttgaggtcagaagacaactcacaggggccattccttcccttatatggattacagggatgaaagttgtgtcatcaggcttgactgcaagtgtctttccccactgagctatgtttgcagccccacttatcttttattcattttatacctacccttgtttaaagtataaggtcatgtcttgatttttcattgttagtctctggtattaggaccatcattcaatatttttttctttaaaaaaagtacacatacacacatacacacacacacacacactcacacacacacacacacacacacacacactacaatgtctataatgttgatcagacttaatgtggcaagagataagcgcacacacacacacaggcactcatttttcatcttaatccagagtttttggattatctaggtttactctggattatctattttaaactcattttgccaaattaaattaaaaactcaagataatcccccaaatttaggagtttttcatataggttcttataatctataagtttgaagagaactgaccagtttacaccactaatcttcttacctaaaagcattatgtcagtgttttttgtaattttgcttttttaaatagtaaaacattttttattatagaggtgttctaagtggcatttcataagcttaacgtgccctggggccagtaaaataactcagattcatcttggtttcttatccttgagtgctttctctcctatctgtcataactactatttaatatcccattccagagagccaggggtggtggttcatacctgtaatcccagcactgggaaggcttaagatgggagggtcacacactcaagacctgccttggctaaatagtataatagtataaataggctaattgacactttgttaattaaaaacaaaacaagcaaatagacaaaaaaaaaaaaaactagattcttaaaatttgtaactgtaacaacagcctcactccaagttctgttttcacgttaacttgagataaaagagtatttcaaaataaagttgtcttcctattgccaatgtgtaaacatacaacttacctttttttaatatccccaattgtatttgagttttaaatggtaagtgctttgctgataatatccgctttaatacttatagaatcagttaaatagttatgttattacactgaataataaagtttaatacattgacttttgtatctagcattgaaagacacatatacctagggaaaaaaattctacagaatttttagaatattttatatagacaagtcttgatttctcaatattaaaaggtatactttcaacatttcacattaaatatgattcttggtataacatttttaaagattttacattagttaaaatataatctctcttattctcatttgttagttttattttagatgaagtcagctcttcaaaatgcattttgtgtttattatttgatattgtatttcctcctttaatctgatgtgatggaatatatatatatttacatacatatgtatatatttatataaattaatagttgtaatatcactgaaatagcccaccctgatcatgttagcattttttgataatacttgattttatttgcttatattgtgtagcaataaacggcctgttatgttaatggtttgcctggcactccacataaagctaatatcaatttcattagagagtcagagaatgatttagtgttttcctgagaagtttgtgtgactttagaattatctttgaaaatttaacagcttctcataaggcctctgaacctagtgtccctttctggaaagactttttcccctctaatttaactttcttaatgatcatacagtgagggacacactataattcttgggttaatttcagaatttgtatttttttctaattacttatgtttttcacccaagttttagtcattgtgccttgaagttatttataataccttctaagttccatacttgggtcatgtttttcaattctaatgtttatttctaattttcactagtttggtctaggttaatcttgtcaaaggtttgtctaacttattaacactttgaagaaccaaccacttgatttaccgattcttattttctatgatagtgctttcttccttttaccttcttagggttattttattgtttatttttttcacgttggatgcttaagatgtttggcttattaattctgagacattcttatttaggctacgcatgtttctctaataatgctttgatgtccataacagttttgatcttagggttttttttttattaccataatccttggtcaatgtgtaccttaatcttaattttgtatcttaatcgttggtcatgcgtttctgttttaaagggtcaatgatctctaagctactgtgaccagatatgtggtatttaggctgttgatcctttgaaacttgtttcgactaaatttaggggagttgcctttgatcaatatgctacatggttggaaagatgtatgttggccaatgatggagtgcagctttctctgtagattagctagaacacattcactgattctgcttctcacattccctatacatatagacatatatcaatagctgagagatatattatcatccttaagtgtatttcatgtacatttatccttgtgttctttatgattgagagtcaaggttttgaatcatcttaattacttttataaaaattgagagtttttcaatattctggtgaacccgtggcttcttcctttcagtgactcatagtctccttgtctttaatatactttaggtgattttgacattactaacagaattcttttagttaggatagttattggctgtgtggaggtttctctggacaagagagtcttgtttttcacttaaagttcaaataggttaaattggaagcccaagttcagatacatcaggaactgtggctcatctctgtattccctaaatttcacttcattgtgtttactatgtacccaaatagaatgagcacagaattgaacttaaatgagtacttagtgttgagtggacaggtagcaagaacaggggtgatgctctggtggaatcgtaaaggtgattaaatccagacacagatttttgagttttatggcaaacatgttctgacaaatcaggattttagagtgcttgtaatttcatcaatattcaggagaaaaggcaaatttagactattcaggaagatccttgccctaaaaatctgctttaatgcaatatatatctaaatcaaaggatagcaaggagagagaaaagacaggactaagatttgaaaaaaattatacaccaaaatgaatcaatagatttaggaaatatagaaaatgatagagtccaagtactgattacttttatgtctacagaacacaacagcgtcatcatttttaggtagaaatcataaagtttaaacagtcttggtaaagatggagggaaaatactatgcttaaacagaaattcttctaattctaaatcatgtgcaacaagaggccaagatgtacagagccctgttattctgagctactgcgtctcattttataagcaaaagatcatgtattgaaatgcttattgaatttttcttttaggctctgtgcttttcaaacacatctgctctttttggacactaagtgtcactttttccagagttttaaagtaaaaaaaaaaaaaaaaagcattaatgtattgctgtgacattcttataactaatatgaggaaaaattattccataaacaaacttagccaaacaagaaagctttgttggaccacctacttactctggctttttctttaatgtccttgtattaaatacataaaaattattgtctgagaccttttaaatgctgtataatcctccccttaaagtaccaacaaagttcaactatattaaattcacaaacactaaaatctacgcattagaaatcatatcaacttgtgcaatcagcagcacaagttcctcattagtctgtgtacttggtcacaatgaactctaagaaaagaagagaagactctgagaacattatccttagaaactaacaaaagaaactgtgctcaatccactgtacattttgttactgttactaaatttgattatttttttttttgttgtcccatctagatttagtcaaaatggctgagatcttttgtaacataatgtgactttggcagggtcactgttaatgttgtagggccagtacaacagccttaagtatgactcttgtagtaagtttcaataaggttctaaaaaccacccccaaagagtcagtattcatccaaagaaaatatacactggacccttcaatgacatcctgcaggaatcactgtgttgtttttaaaacaaaacaaaacataaattgtagaatggttaggtgctctgaaatcacaaatgcaaatcctagagaggaccactgagcttttgctccagagtccatttgtgggatagaatgttacccactatggggaactgttgcatgagatagttagataaatccagatcacatgaaatgtccatttgaaaagactgcacaccacttctgctctcagtaaaggctcattacatcctgagatcaagccaacttggctctgagagcaggaatacgtaattttaggctgataataaacaacaagcttctttatttaatgtctgaaaaaatgtatgacaagtctagaacacatggtgtgctctacaaatcttttccaataaggaaaataccaagaaagggacatcagaatattttctgaagggtattatttacgttcaattcatttcttcatttttaattaattttaactagctttcaaggttttaggtttcatggtggcattttcaaatgaaattggtttgttgaccacactccattttcctcccgtcccccacccaccttgtatccttcctctccagccatttctcatgtcacatggatcctactgctctgctctcttttgctcttaagtgagaagggtggaaccctgcagctgttcatcttatgtgtctcctcttggtgttcccatgcttttatttcagaatgaacgaggcataaatgtaaccagttgcaatattcttctccctttttatctcagttactgtcttcatgtgttgctcacctctgcttagattatgcttgtctccatcctcttaaagataagacttgatcatttttcatcagtcagctaaactcttacttcatcaagaaaccgcctttataaagtctgcctcagccaagttcaatgttatcatattattcaatattatcatttattttttatctggtcaggcatctcctgtctactatgttattttattgctttatgacacaacacttacctatatttcttccctggagttcctcacatacagaccaacttagtggtgtctgtagtcccagcacccagtttaagtctagtaagaatttgttaagttctgacaagttctctgaatttggagatctgacaaacttttttcacatggcataggcacacaaaaagacctttttactattaagaagttcaataggttgcatccatccccccatttaataaagacatttactatttgctgtatgtctgccagtgaaggcacgaagggcagcacaaggaacaagagaaaattagttcctgttggccatccagattgtacaaacatttgcctgcagtcatgatggcatgagttctactcccagctcccacaaggtaataaaaaagaactaacttctgaaaggtgtcctctgccatccacacaccacacaccatgtacacactggcctccagcatacacacacacacacacacacacacacacacacacacacacacacacacacatacacacacacaaaactgatcagttaattactcttaagcaggcatggtggcgcatgcctttaatcccagcactcgggaggcagaggcaggcagatttctgagttcgaagccagcctggtctacaaagtgacttagttccaggacagccagagctatacagagaaaccctgtcttgaaaaacaaacaaacaaacaaacaaacaaaaaagtattactcttggagcctaaataatactatggaacatgtttttaaaaagcaaaccaaagcaagcagtctataatgatttcaaatggaattaatactaaatgatcatgaaaaaaatcagtcagaggcatagagagaaagatactgtgtggagaggagctggggtctaggaaaatgggtgttaggagtagagatgcactttctggactgaatgatgtgaaagtagcctgtggaggcaagagctttgtgccaggaaactggcaaggttctgataattaatacatttgttgggtgtggagaccggcaaacagccagtgactcaagcagtgagtgagggctggcccagaggactctggcctaaagggttctaacctcccagagccttgcagccttctggacatgtggcgtggaagaaacatcatgccagagaagaagctcttcttggagatcctggtcaagcattctgtgctctagcttgggttgtacaggaaacactttggttgttcaggagaataaacgtaagtgaattttacaataatctggaactgcactggtagtgagcagtaggtatatttcagatcaactttgaagacagagccaatagaatttggcacttattcctggggtgctataagctcattacaaaataaatcactatcaagctaatcctgtgactaatcacaacacgtgtgtgaacactcatcgtgagcagataaagccagtgacgcaacgtgcatgaagcccttggtttaatctgatctggggctgaggcactatctgaagatgcagtggaattctgactcagaactcacctcagccaagctccccatgagtcatatctggctacctctacccagctcactagcctacagttggtcatttccctaacatgccatcctgtataagcctgattgccagagctcctataggcagtgacctccatcctgctgccatgacaaaaccttggaatcttgactcacttatagctaagcaatggcatttaacctctgaacctgttctctcaagtgtgtaatgagagcattttgcaaatttaaagacatttagagctactgtttcccttccatccatcaggcttcataacctcattaagagtcattgcaagacaagttcattatcaacgaaacgccaatgagacctctaaatggggtgcccatggcatgttcagtacccacagctacacttggtgtgaaaacatgcgtctgttctccaaactgttagtatgagtcacttcccatcagtggtatctgtagaagttctcatagtccctcccagagtccaaagatggctggagattctgagctgtcaactcagagacctacagagtcaagcaatatcctttaaaaggagaatgcaagtaagacacccttcaaggtcaggaacactttaactttgcactattcttttggttatcaaaagggtgatggccactggagttacatttatttgtaagtagtattttggaataactgctaaaactgatccagttggaggtggggggaggagggcgggaggatgcaggcgtgagtaaagggtaagagtttagcactgtttcactacaaacagtgaaagtcaacagcagaccctgacagcaaatcattccatgtacagaaataatactccaataaaaaagactgatagatgctctcacagctgttattaggaaaacataatggtatttgttccaagtaaatgacggggcagcataaggttcagtatgacaggctttcagaacttgccaacaatagagaggggaaaaaagcaccaaataacgctatgaagtaatgagagagaaagagcaaagattgagctcttggttggtatgatgcagaaaatgatgcaagaggcttcaaaagaagcttgccttcagataactaggtttaatttctaaacgaacaataggttaacacgtggtctttaggcaatcctagatctgtgcaccattgcactttcactgttttggattgaaattcaggactatagaataattggaactagaagtgagctttcccgggcaaaacattgtactccagatctctagacacccagtcacaggtcatacaacctcatgtattctgacccagtgtgctttagaatgtgctactttgatatagatgatagatagatagatagatagatagatagatagatagatagatagatagatctccatccaataatgattaaaaagaaagctccaaaatgtctgtttcttctgttgcttctgttgacataattgtttcatgtgacacttcatcaaaatgtggtcatctcttctctagaaaggatacaatagcatttcattttgataacctatgaaatcagagagaagaccatccccttgatttatttgttgtttcaacctgaaatctggctttggaaagccaacagaacagcttaacgtgctatggaagactggatatttttaagcagtgtctatggtgtgggttttatctgaaaatataggtcctacaactactattcaagttccgctggcattaccaaccaatcattctaagtcaagacatgccactcaaagcccagctatcatgctcaggctgtccctcctgcaaagtgtatgtagttgagactccatagcacacttaaaaatgtcttcttttttatctcagccattctgactggtgcaagataaaatttcaaagtacctttgagttgtattttcctgatcactaaggatgttgaacattttttaagtgtctctcaaccatttgagtctccttttctgagaattctctatttagacttgtaccctattttagttgggttatttgttttcttgatgttcagtttttttttttttgagttctctatttgttttagatattagccctctatttgatgtgtagttattaagaaaacaaacttttccctattatgttgtctgccactttttctaaatgatggtgacctttgccatagagaagcttcaagacatcccagttattaattgttgttctcagtgcctgtgctaatggtgttctgttcagaaagtttttccttgtgccaatgagttcaagactattccctactttattgtctatcatggttactgtatctggtcttgttttgaaatctttcatccacttggagttgagttttatgcaaggtgacgaaataacagctcttctggcaaaaacaaggagtagggggagattcattcattgttggtgtgtttaaatttgtacagtcactatggaaatcagtatggtgattccttagggagaatcactatggaaatcagtatggtgattccttagggagctgtgaatagatctacccaagatccagctatactactcttgagcatatacccaaaggactctacagcctactagaagcatactttctcaaatatgtttatttctgctttattcataataaccaaaaaatggaaccagagtatatttctgtcaattgaatggataactgtggtacatttatacaatgaaataacactccgctgctaagaaatgaaatttgcaggtaaatcggtataactagataaaatcatcctgatttcattctggagtaacacaaacaccaaaaggcaaatataatattatttacttatatattaatgttagctgttaattctttaataaccaagctataatccatgtaactgcagaggttaagaataaagtaatggactagggagaaggattgggtcaccctaagaagaagaaatagaatggataattatgggtggatggggaaggaaagacaagagaggattaaacaagtagaatgagggggagggaaggctgaagaagagactatgagagaggacatttaaaaataagacctacttgagaggccatatggaaaccttagacagttcaagaagctttctaaaatgttcacgtatagaaatataatttaaatgggttttgctaaataatagggtagacaaagtcccaacagaacatatcttgtcaccaaatgaagcctctagtttctggaattggcttcatctaatcatgttgtgggacaaaggggtaccatagacacccatacacaacccaagacattgccaaggctattgctctctggaaactgatagcacttgtgacgacactgccttcaataagaattcatggtaatggaagggactgtgcatgctacaaaaaagagaaaagtaaataccatcccccagctaccaaaccttccttctacagtgacgaactgcctgcaagattcactaatgcaatagtgtcacaaagcttgtgggattaaccaatatctgattggacttgaggtccactccatgagatggaatccataccagtaactgccttgagtggctaagactctgttattcaataggccaggatcatagggtaaagtcataaactactgttcttctaaaggaacatagtggtaacctaacaaacaagcaaacaaacaaaaagtgactcctaatgaaattctgctataccccatagatcaattcctactctgccatcaccagaggagctttgtccagcagcagctgtgaataaacagagacccatgctggaccgtgtacaacgagtgagagacgttggaatactcagtcctaaatgggatatcttcaacaggtccccttcttcagggctcagggaagcccctcaaaaaggaggcagaaaaattgtaaaagccagaggtggtaaaggacaccaaaggaataaggccttctaaacagagcaggaccaatacacttatgaacttacagagaccatggcagcaagcacagagtttgcacagatctgagcctggtgggatgcaaagacagagagggggattatacacctgaaaagctaagttccattgataaccactcactcacgaaaaagtcatccttttcgacagagtctccctttataaaccacacttaagaccacgtccacgcccaatcatagagaaccaacacaaaaggaactctgtctggaggttctttgcctcataattctttttcatctctctctctacctttttttaactttacaggtcctttgcatatatattatgttttccatttttgtatttttatatgattccagtgtgtgaatgtgtgtatctctgcatctttctttgttaattgatcatccccccacctttgttttgttttgttgtattctagtttgtttttattttatctaattttattttattattactttgtagatgcttgtctatatccgtgtgtgtgtgtgtgtgtgtgtgtgtgtgtgagagagagagagagagagagagagagagagagagagagagagaaggcaaatgtgtgcattgggatgcgtaaagaaggggaaggacctgagagacagaggacacaggagatcataattagaatatattgcattcaactctatcatcaataaaaataaattaaaaatataaaatatactctacctacaaaaaaattagtcttctttgtagtgagtctgagactctaccaggaatggaggagttaatcgagttgaaagcatagagactcgtagtctcatttgctccttttctttcaacaaaaataggccttgagaaagtttgactgacatttatgataattacgtttggagattaaaataatttaaggtttcacaaggcttaaaatttatacaccatattgggctttgtgtgattatggcttccttcatatcatttcagtagggtgttgaaatccatttgatgtgaatgtaatagtcattttaatggatattgttaattccttgttttcggcataatagataaagggggttttaattaaattcattgtgcaagtacttatcaggggtaaaaaggttcagaaaattattatttttctggcatgacatgtcacaagcattgcaaaggcaggaaagagagcaatatcagagtgtggatgccattagaagacagaccagcttcatttccctgcagatgacatgacaggcttcagaccagaccaagagtggtgccaggttatagttaaagcactgcactttgaagctccactttctaagacaccagcgtaccgggaaaactctgtccttactcttcctaacctaatgaacagaattcctgaagaccagattacaagttctccaaaagtcttaatggagaactaagttctggatcctataaattccagctaaacttatgataagaaatgtgaactttgttccagcatttctggttcttgggccagatcagaagaaactaagcatccatgctatttggaggttcattggtatccctagttatagttcctggttaactatgtggttttaaaactttttccctattataaagtggctatgaaattattgagagtagcagcctccagataaaacatccaacacacatcactggggttctacgtgaattttagtggaagaggaaaactctgactcatgaaattgttaggatttatatctcgaaaggatcccattttgattgattgcttctgcttggttcattcaactcaaaacctctgcccttggtttacttttcacaagcttttgttatcaattctttagcgttgcgagacggcattccaacagcaaaatcatttaatgtaagaaagtactagagcaccaccaaaaaaggacccataagaatttccgaccaatatgacagtgctgtaaatcaacccactttattcctattgatctttcaacattaagcacagatgaaacggctaagtaatacaataatacaatacatactatacatagttacatgtatataaatacatataattacacatgcatataaaacatagtagaactgtgcaaattattacctttgggtgaagaaatccatttgactttacctgatctttcacacgattatattacaattgtaacgagtacaaatccttttgttttctaaatttgcaaagcgatttgagtattacgttgggggaggcaagtataatcaaaactcatcatatgaaaacccccaaaaaacaaagtaaacacatagaaagaccaaaggtaactgggtgatttatatgtaaaagtcttttgtagaattcaagatgactcccaggcacctgagttggacagtgaggatgtgtctgactagaaaacaacagaggaagaagtttgcagggttaagtttgatttcagatacattaaggttgaaatctattgggctggagagatggctctggaagagcaccgactgctcttccagaggtcctgaattcaattcccagcaaccacatggtggctcacaacaatctgtaatgaaatccgaggccctcttctggtgtgtctgaagacagctacaatgtcctcataaataaaataaataaatctttaaaaaaaattgaaatatatcaagtaggcataaaagatgccagctaggtgactgatatctgtaagtataaaagaaatgttttgatcatatgatttcataaaaatatacatacaagtaacatattaagtcagcaagtcatatttaagaatatacatatacatgtgtgtgtgtctatgcatgcatttagtaactattagtgagtaaaaaaaaggccatgaatttgaaggacactgaagaagggtatattgaaatgtttagagggagaaatggtataattaaattgcagtcatacaaaaaaaaaaagataatacataggacagttgaagaaaatgagtgaaaaataagagaaaactacactaaaagtcttggagacatgagcatttaaatggtaaagagacccaacaaagaagtgttggccatgtgtacaaagccaccagcatagcaatcattacttgtctcattaccatcgaaaaggtattccatgaaaatctgcttctcagacttacaataatcccaaaacctttaaagagtcagcttgttatctaaagtcctcaataagaccctcccaatatgatttaaagctccgcttcccttcataaccctccagcacagccctcagtttaagccaatcaaaatgacctattttcttcagattttgcatgccacattcaactcctctgtcttcattctcactgtttactcttccatgaattcccacatccccatgcaaagcatcttcaccagacatcattcatcatcattattcgtggtttataagaagcagaaaatagtcccaactggagtcactaacatcaagaagaataaaagggaagggggattatgattatttttttcagggtctacgagtaatctagaactcaacttgacagggagtgtctatgaataaatctcatttaatctcaaagcaaccacataagatccctttaagaaatcacgattgtggggcccattcatttacttagtaaatatttaccaaatgtggattatttgcagccactttgctagatgctaaacaatggtgaaacaaacaaaacccatggtttgcccctacgaagaaccaataataataggagaggcaaatacccaaaatataattgtgtaagcaaatatataatgggtttgagaaagggccagaatataaaaggatggtcaattaactcagagtgggggtctgtctttaaggctgggccttcaaagacgtgtagccatattaaataaggggaaaatataggaaatgaggggaattcatgaatgaccaatgtttcccaaagtaaataagcaaatgggtaaaataggagatccatgtggttgaacttcagaaaatcaggggctctccatctatgcatccttgttgaccatgtacaaagctttgggtttacgtataaagaaaaaatagttaagaaaactagtattggaaaactagtatttgatactacttagaaaagttaaatatataatttcactcaagtcataaatgggagactaaaagatcacacagcatgtctcacagaggtaaatatggagataaagtgcagagcagagactgaaggaaaggccatccagagactgtcccacctggggattcatcccagatacagtcaccaaacccagacactattgtggatgccaaggagtacatgctgaaaggcgcctgtcatggctgtctcctgagaggccctgccagagccttacaaatgcagaagcaggcagatgctcgcagattggactgagcgcagggtcccctatggaggagttagagaaaggactgaaggagttgaagaggttttcaaccccattggaagaacaacaatatcaaccaaccagacctcctagagcttccagggactaagccatcacccaaggagtacacatagctccagctggtaggtagcagaggatggccttgtcaggcatcaatgggaggagaggtccttggtcctatgaaagctctataggtgccccagtgtaggggaatcgaaagcggggatggggggggggagaatgggagtgggtaggtgggtggaggaacatcttcatagaagcagggggagggaggatggaagagggggtttccaggagggaggaaattgggaaaggggataacatttgagatgtaaataaagaaaatatccaattaaaaaatctatccaaaaaaaaaaaaaaaagagttacaagacccagtttctcaaggaaaacattcgagtctcaaattaaaaaaaaaaaaaaaagattaagaatgaacttaaataacaaatgacactggaaagccttgtcagctattgctatgcatggatctcatttgaattctgattcagacgattagaaattatttgacaaatactaactttgaatggtgaccgaacacttgaaaatattttttaaaacaactgtttgattttctcctataatcgtagtactttgtctttatgtctttaaaaaactttccatactttacaaaactatactaaaattatgaagtggaattttcctcaaaataattcaaagcctaaagtaaaaggtctcataaggtatacaggttgctgagtcatcacttctagaactcatcaggtaataactgtttatttgtaatataatcaaaattttaaactaattaatgtatatatgcatatttcagtaaaatctcaggagattgccttcaagattttattcacagtgtgaaatatgcttgatatataaaatttttaaagtataagaatacttgaatgtaaaatatgtatgtgcttctttaggtcatatttatatttgtaaatttaatgtatgcctcattagaataacagtgtgcatcaatctttaaataaacacattgtgtgcatataaataaataaataaataagatattcaagaaaactagaattagttactacttagaaaagttcaaataatgctctctgttcaaattcaaagtcttagctgatcatctctgagagaacataacctttggcccatatggaaccctggaagatttcaagtgaggagtgccttttttatcagccatcggtaacggtaagcccattttcatttgaattttctattgtctcctgtgataaatggagttcagcaaaatgtttggaatggtggtgtcgttaacatcaggactctattttgcatttactagaaatgaatcttagataaccagagattttatgaggtagtaaggcaagattacctagattctagatctgactctactctcaatgactacacaattctgggctagatactttaggactatcttttcatctataaaatgaggatagtgtgactcaggactatgtaaagatttggcgaggtaatgtgtatatacatgtataaaacaatggcaatagtaagcaggacagagttaatgctacaaaatgatttttgttaatgttatcatttctatgaaactattcagaacttatactctctctctctctctctctctctctctctctctctctctcctctctctctcctctcccccccccccgtgtgtgtgtgtgtgtgtgtgtgtgtgtgtgtgtgtgctgagattcaagcctgtaatcatcacttgagaggctgagacaataaccagcttgaaaacagcctgggatacacaagaatacattgaagcaagaagcaggtaccagaaggaaaagaaaataaggacatcatgaaaaggaacaggagagaaagaggggctggagaggagatggctcagtggttaagagcactgattgctcttccgaaggtcctgagttcaaaccccaccaactacatggtggttcactgatgccctcttcttgtgtctgaagacagctaactgtatttacatataataataactaaatctttttttaaaaaatcacctgtaattgctgttaccaatagactggatttttaggtatagaggccaaaccagtgatgtggtttttctgtatacctgctgaaatacacaaagtttatgttcaccaaaggcttcaagaccacttctatgctctctccctatgtgagtgataggaaaggcctggcagatgggttgtttccctctagaacctcataattttgtataagatacatgttcaaagcactaactataaaagcaccaactataaaagcacagtggttaccagggtcttaaagccaaccgacatcttctaagaatactgcctgcattaagtcctcagccaccaataaggagcagacacaagcccttgagacaaagtcagatttgatactttgttactgtggcaagctcttaggcagtaacttcctacagaagttacctaagagtcctgacaactgcttcccactcctgaatattgaaacagagaatcctgtaagaggaggggcttccccattcgcttactccactgaaaacacataatgattaaatacatgaaagtttagtcactggtgcatattttgcatatttaaaatattttattttataaaactatttgatgagaataaaatgttattagatgaagcattcctatcaattagaagatatttcataattccagaaatagtaagacagagggcaaagtctggcacacagacaataaaagagtgtcgcacactgttttgatcagcctaacaacaagcaccaaggtaccatgaatcttcttgaaacccttttaaaacctgaatggagctttctagaagaagcagagtccttggctcatttctccctgctgtctttatgtgaagccactcccttcagacatttcgaagggattgatgaggtcatttccttcaaggtttatttggaaatctgatacaagttagagacaaaaccaccaagctgaaaaagaaccatgagcatattcatactacactccctgctcctttggaaaacacgagctgaaaatacccaaggattcaacccattgcttgattcatttgctaactttaaattgggaagcattttgaaattcatcaatcaaactcttaatttttactacccatttagaccacagagtggcatgtgtttttggtgttagctttggaacacaattaagggaaaaaattgaaaaccttctggaacagttttccccatttattcatagttaaccttttgaagttcatgctcattatactttacacagatatatctgcatgacctaaatgaaactggaattctactgtagacaatgaactaaatttcatcaagtagtcctaagtaattgtataaagctttactcttttacaacacagactctcatcaacgataataatacaactatgcaattatgattcattattaccattaaattgtttgcaactgtgagaaagcacttggcactttagcattttggggggatcacatggctgttactttagagcaatcacatatacggtaaattattagattagaggatatagacattttaagacattaatatatatgcataacttgtgaccaagatcatgctagtttgcttcctgcttaatgaaggcttatattggttaaataagaaaatgtaaaaccttacagtttcagcaactcaaaataacaatttctgctcttagctggaatcaaattaaaaagaggagaataatacaaataaagagaagatacagtttaccttttcttaaattaagtgggtagtttatatgattcaaaagcatttgattctccaatggtcctccctgcaagaacatctcctgtcttatattcatggtctttaaaaaaaagaaaatgattatggaagaccacagtaagtgcaaatgactccaaacactgtaagcccaatcctcttgtttgatctttgtgtttgcttgcttgcttgcttgcttgcttgttttaatcagaaaatattaaggctcacaaatcctgacgtaaatatctacagaaacccttatcacttcacagctttaaaaattcacattttagtttcaaaataagaaaaaagagggaaaaatctgcctataaaaaatcgactgagttgtctaagctttgtcatttccctccgtattcatggttaccatggccctcttgtcaatggatccatctattagagcagccattgcatatctctttgccctcattgttttcatatcttttccagatcttctctgaagatccatctttcctgattccctgcttttagcactactttgtgatttgcatttcaccaggcagtagaggtggggtggcaaaaagcttagaatgaaagttgtcaggaggaaaaggtagaggtttttctaataccccgatgaataactaccataattgactcaaatacatgagcccaagccatgagcactgaacatgtgtgggcactgaaatgtgtcatgagcagaggggattaatctaatgagtcatagcaccatgcggtttgaatagaactcaatggatttttacctttttgcttcagaaaattcacctgcttcctatgtagaaattaagcattgatattttaatgtgggatgtgagtatatgtacagaatcatttcatctattcagtatttaatgttcactgtaaaggttctctttggaatgagtatctggacactaaatggcatttgttaacaatgtcatgtgccgttaactcttgtgaagagtgtattctagaagcaagggcccctgtttctcaaggtttatctcatgtgcttcaagactgtttgtgctgcagaactatggagtaaagagaagaatgctaaaaacaatgtacccttgagaacagctacaaaataacccatttcaactaaggtcactattatttattccagcatacaaagtgcttgtggtaggaatgacaagcatcacatgtggattggttattctgtccagaactataactggggactctggctgtactatgttaaccaagcttccccagttgtttctgctgaatgctgtaaatacccaattggatgatcttctatttatctgctgattactatttattcttttgcttttgtttcttatgtgctaataaatgcacttatttgaacccaaaggctattatggataatcctatgaacagatggcaggccatttatgaaactacagactgaccaaaagttcaaagtggccttgtatgagataaaaagtatttcaagagaagacaaggaattctttcttctttatatttttatagaaataacagatatttgtcgaagaaactaagctagcaatgctgaagttagctatagcatcacaaaaaagaaaatatagaataagatattttaatctatgaaattattgagaaatgagggaaggtaaaacgtgtattattttattgataaagcccagtttcgattcaatgttctgaatctgtgttaccatgatacacaaatgaactgtgtaaaatctgtggggcccaatatgcaaatgttgcttccaaatatcaatcatatcaatttagtgccagaagttattcaaaggtgacaattcatgtaaacaattaaaggtaaataggaatcattaaaatattcattgacttcaaacactgccatcatcatgtttgctaagataatgctgatttgattcttttgtatgagtagaaaataaagttagagaagatgagaatttccctagactccttattattcgaaatccatcatgccagtccatttctgttagccagtgataattctggaatgaacatccgaaggaattctagacagtgagacaaagcaattgcattctcggaggaggattcccaagaagaatgctttgtaggctgattaaaaataaatacaaaagaaggaattcccaccctgtgcttgtatgctactcagtgaggctgaagaaacaaacttgggaacacaaggaaagagccttgagaacacaagctaccaagccaagtgtgacatgatacaaagacaatccctaagcttggaagacatcccataatactgagtgactcttgaaatatcccatctttggattttttttctttagtaagacaatccgttctttcattttattatttaaactgcctttaaatgagtatgccattacttgcatctgagctcatcgtaaatggaatacctgatcggacataagcttctaggaagagactgatactctatgtctgcttaggttctagcttagtccctgtcacagttagcttcaattgtccttgttggtatacttaggaatagcgagcctcaattgggtaattgtttccatctgattgactagtgggcagatctgtggagcattttcctgctttgatacaggagatgtaatgcaggacagcccagcccactgtgggactcaggtttatgagaaaaaggatcggccaagggtggtggtacacatccttaatcttagcactctggcagcagagcaagcagatctcttgaagcatagcaagttctatgccaaccctgtatatatagcaagttccatgccagccaaaactatagaatgagactgtgtcttaaacaaacaaatagacaaaaccagctaaacaaacagaagggaagggaagggaagggaagggaagggaagggaagggaagggaagggaagggaaggaaaggaaaggaaaggaaaggaaaggaaaggaaaggaaaaaggaaaagagaaaggaaaggaaaaaggaaaggagaaaggaaaggagaaaggaaaggagaaaggaaaggagaaaggaaaggagaaaggaaaggagaaaggaaaggagaaaggaaaggagaaaggaaaggagaaaggaaaggagaaaggaaaggagaaaggaaaggagaaaggaaaggagaaaggaacggaacagataggagaggaaaagaaaaaaggaaaggaaaggaaaggaaaggaaaggacaggaaaggaaaggaaaggaaaggaaaggaaaggaaaggaaaggaaaggaaaggaaaggaaaggaaaggaaaggaaaggaaggcagctgaatgtgagcctgtgcacagccagtgagcatccttcctccattgactacaggtcagttcttggactcctgccttaggttgttttgatgatgaactatataacccataagtaaaacaaacaaacaaacaaacaaacaaaaataccaccttttttctccaagtcagttttggtcattgttcatcacagcaacaaaaagcaaactagaaaaggtcccttcctattgctattttctgtgttcatttaatctagtatatttctttctttctcctctgagtgcctgggtcaacgtctctttctctgtaatggttcctactctagctatgaattgctccattatctgtgtttccacataatcaactattatcattgtcattgctattacaatctgatttcagaacattgtataagttcttcgcgtcacacattgtgtttagtgctccacgtaatttacatgcatctcagctggtggtaatttgcttagttataaatatttgctttctcctcagttgtatcatgaacctgtctattgattttgatgttttgcaatgtacctagatttgcctaaagaatctgagtgacagacacacatgacatcaaacagaagctttgaatggccttggagaattaaattgtttcctcttcaccatgacaacagcatgtctcagaaaaacctcctttaaaacacattctagaatgagaggacacatagaacctagtgcaatctaagaaagtctaattaaacttcagataatttatagtcatcatataacaagaacaagaaacatgaattagcttcactaaatccatgggatgatcggcacaaactcaattaaattacagttgaacctgaatctcataacagtgagaaatcagaacgataatgacaaaatttactatgattattaaacattggaagaaatcatcttcaattatagggttgatattgcccttctcgcataatagatatctatgtctctttcatcacacttaactccataagtgataaagagtttatagttttccttctctaatatgtaacacattgtcttctagaagtatgctctcagaaggaggacttataatttactaaactattttcactactcatatttaagaaactgtggtataaactgtttagatgaaccactctttgcttctgtaaatgaccttctattgtaagtataaaaaaaaaatcctgttattacctatagggtagaattatgtcttgacttcaccattttaaaaaacaaacaacaacaaaaaaaaaccactccaaatttaaaaaaaatacatatttactatgaagtatgaaattttagaaaaccgtttcccaaaataatacattgttttctgaacatttaaaataactttaatcctataaaatctaacatgtaaagatgacacaaagcttaaatcaaactcacaaagcttaatggcttcttgaataaagatagagaagaaagaatcgttgtatatagatatgatatattggaattttctaggtaacagagagggaatatagagaggaggaagaagggaaagatgtagagacagaaacagacactacactgtgaagtcccaaaacttgttttctattgagctccattttggccctggtttgggccttgaagacaagcctgagtctgggtcgagtttctgcgtccttgtgggagagcctaagcctggctcaagttttgagacttgtctcaatcacttccatcgggatgactcagcaagacctgtttggccctgcctctgccccacggttgctgatgtagagctttgccattggtcttgtctgtcactccataccctcggtcacccttgcctgcctcctgcattatcttaacccaccaaaaatcccccttcctatgttccaaacttatataagcgagaggctgatgccaaaaaattgagttgctgctttgacagactcccaacctggctgtgtttctttttgggccatagacactcaccttcccactcagccccaaagagaccccggagggatcaggacctctctcctcgtgcctggacctgccggcaaggagccagcaacttttaataaatattgctccctcaagttcaagtccaaaggcctaagagccagaagaaccaatggtataagttctaattcaataaaacagggctttaaaatcccatctaaaatcgcatgctataaaacaccagtttcagctcaattggtcaggcaggaagcatttctgtccatttagacttttggttctacgcaaggcttctattaattaggtgaggctcactgacattacaaatatgctttaagattgattctatcttagctgcgaaccaaaaccttctcataaaatatgcagaacaatgtttgacaaacatctaggcccagtcaagtcaatatgtaaaacttaacatcatttaagagttcttcattccttagccgagcagtggtggcacacacctttaatcccagcacttcggaggcagaagcaggcagatttctgagttcgaggccatcctggtctacaaagtaagttccaggacagccagggctatacagagaaaccctgtctccaaatacaaaaacaattgctctgaaaaagatcttcattccttaaccaagaagctatcgccaattgacatctgcttacaaagggaaaattattttttctccactggggtaaaaagacactgttatattaatgacacttaagggtaggaccgtgctcagcagtagatgttcaacataaaactgaactcaagggtatttttgtagactttttgtctcatattgctttgtttgggcattttatttatttatttatttatttatttatttatttatttagtcttatgtgttttgcttatatattagagtttatgattttatgaggattgggggggggtgattgtgtgtgccactgtctctgtatgtgtgatttttgtgctttctctttgttatatattttttcaaagtcatgtttatttatttttgtttgcctgtttatttgtttttcctaaaaagagagagaaaaaggaggaagaaaaagtcaagttggcagggtggggaagtagggatggtctagaaggagttggtcagaatgtattgtacaaaaagaatttttttcaattaaaagaaaatatttcatttatcaagcacatgcttgatgtgctcaacaccttctgcatgcttgagataaatcatttcaacctccctgtagcaattcaatttccatctttcataaaaaggattttaaaactaatcctagaagttatttttccaactgaatcatttgtacagatgagaaaaataaggtttaaaaacattaagtgatttgcctctagcaaggcacttgtacaggtaaaagcagatttgcagccaaggtcaagagcatatgctctttccactgcactgcactgtcctcctatctgtgtcccagcccctgaagtagaaaaggaattaacagatatacatgcatacataagccttatggagtgtttatcttgtcacagatgcatacacacaagcatttatggacaacagggagagataaaaagctttattatagctcccaagccatagtaaaacacatttgaggcataagaaacaagattcccatacataaaacatgcaatgcaccctttctggtatttcttccattagagagaaatataataaagcactcaatttctactcctgaatgaagacttgaaggagtttaatttttcttgctaacatccaagtaacccaatgatgtttgtctaaaaatgagggcacaaggtattaaattcatcagcatataaatgacttttctaggatgtggaggtgggccacagcaaaagaagtccatgacttcaaacagtattacttaccaaaggcagggggtggggggaggttagaatatcactgcagactgttgcactaaaatgttcttgatattatcattttctgctgcacgattttcccctagagaaactatatagaaaataaggtatatgacccaatattctcagaatcttcacatttttgtctctcattgtttctctaaacaatgctgttagaaaagaaaatattggtaattgacctccataaacttcagacgtagcagctcagggtgaatttaaaatggccacattttgtgttccatagcaaatatgattccatcaaggaaagacatcccactaaggagaaatgccatcaaatgtttgtatacttctattttttttaattaatttattttttacactccatattccattccccgccccacaatccactcttggactgatccacatgccacacctcctcccctcccacccctgtctccacgtggatgcccccaccgccaccccacctgacctctaaactccctggggcctccagtctcttgaaggttaggtgcatcatctctgaatggacacagacccagaagtcctctactgtatgtctgctgggggcctcatatcagctggtgtatgctgcctgtttggtggaccagtgtttgagagatctcaggggtccagattaattaggattgttggccctcctatagaatcaccagattacagccataccaccctgaatgcccaatctcatctgatctcggaagctaagctgggtcgggcctggttagtacttggatgggaggccgcctgggaacactaggtgcagtatccttctattttatatgctttcatttcagtgcaaagacagttccataataatgcttttgtcttgtcttcagacaactattaaatatatttaccagtcagaaatctttcatttaatttgaccaatagtcaattgttcattacgtcatcaattcttttagcaaacatctatgattggccctgcaagggttagaagctgatccttgaggcagctgtattagatgctgatttcttaagtttactgatgaatggaacaagggctgatggagagatacacaaataaatggtcatttctattatatttctatgtatcaaattaattatcgcaagggcatccttatatgctcctgaagtataactagataagaaaactcattctggttgtcatattagaatcagagatcatcacccatcccaaagcaatgaggtactgtggttgaattccgctgtgtacagggaagaatatcttccgcacttacagtgctttctttttcagagacaactatggacagattcaacacaatgaacctggatgtcactgtattccataacacagtgattacaaaaatggttacacaaatacgtcattaattatgccatgctatttggcagtttctgcaacgtataatgatgtgtaacgctgataactaattggtagaagtgatcacgtgagttatgaagccctaaaagtaaactgacatgcagatatgccttcagtgcttttaattttaatcctgggattcagtgaagactagagtgttgtcataactattagttagctggcttggtcgtgtacaagtcttgtgttgtaaaccacagatactacaagttcatgtttagagtagccattacatatccagacgaatgcattttgccacaccccttctaatcgttcagattttatatatcttcaagcctttcttcaatgttccctgaggctttggttgagtaggcagtggtacaaataaattttccatctactgttgttcacagtcaattattagaccaatacattgtatacatctatacaatgaaaatatatacattttaaaaagttattagtcaattcatgattggctcattttgaatttttgatgtatctgaataggctagcacaggaaacaaattgctaacatacagagaattgtgcaagagaatttatacataattctttagaaaaataaggttttttttctttctttcttttttttgttttttgttttttgttttttgtttttcgaggcagggtttctctgtgtagccatggcagtcctggaactcactctgtagaccaggctggctttgaacaaaataagttttcttgattaactagttttaccattcttcagttaaggtattgttaattgttcttctcaatttcttaaaaggtctttgaaaaaaagtacaatgtagtgctatgtagactttgaagacaccaaactttatatagcattcaaatttaacatgtttgtctcttagttgtaatcaggaagtttttatattattcatatttatctgttatttgacatgcccaattatttcttacacagtagacagtactagataaatatctaagtagccataaccaacaactttgcccatttgagattttaatatattttgaattttttattcctcataaaaacaggctacccaaattatttacatcatcaaaataattgtgaattacctcaaaagaaggaaacttttaattctgtcaagacaactgttaacttattcatggtgagcactgaaatccttttgctactgattgccaataaaacaattgtcaaacccaggtttaaaagccactattttatccatgaataaacaaaagaaggaaaaaattaaatgtagggatgaaaaaatatagaaaaaaaatgaaaccagaatattgactcagtcaaagcagagatatccaggtatttaataaggaccattgagaagccatttcagaaactatactagttgatgtatttatagtgaaggtctaaatgtatctcttcttgattcttatattggagtctagtcacacaaagtgactaaattagaaagtggggctttctctggatgatcattccttcagtcttagctctgaactttgtctctataactccttccatgggtattttgttcccccttctaagaagggacaaaatattcacactttggtcttccttcttgagattcatgagttttgcaaattgtatgttggatattctaagtttctgggctaagatccacttatcagtgagtgcatagcatgtgtgttcttttatgattgggttatctcactcaggatgatatcctccagatccatccatttgtctaagaatttcataaattcattgtttttaatagctgagcattactccattgtttaaatgtaccacattttctgtatccattcctctgttgagggacatctgggttctttccagcttctggctattataaataaggctgctatgaacatagtggagcatgtgtccttattagaagttggaacatcttctggtatatgcccaggattggtactgctggatcttcaggtagtactatgtccaattttctaaggaactgcgaaactgatttccagagtggttgtaccagcttgcaatcccaccagcaatggaggaatgttcctctttctccacattcttatcagcatctgctgtcacctgaatttttttaatttatttttaattaggtattttcctcatttacatttcaaatgctaccccaaaagtcccccagagccccccccccactcccctacccacccactcccacttcttggccctggcgttcccccgtactgaggcatataaagttttctagaccaaggggcctctcttccctgccattctgactggtgtgagatggaatctcagggttgttttgatttgcatttccctgatgattaaggatgttgaacattttttttttaggtgcttctcagccactcggtattcctcagttgagaattctttgtttagctctgtaccccatgggatctattccataaacaaccaccaaacccagacactattgcatataccaacaagattttgctgacaggaccctgatagagctgtctcctgtgaggctatgccagtgcctggccaatacagaagtgaatgctgacagtcatctattggagggaacacagggtccccaatgaaggagctagataaagtacccaaggagctaaaggggtctgcagccctataggaggaacaacaatatgaactaaccagagctcatgtctcaagctgcatattcaacagaggatggcctagttggccatcaatgggaggagaggcccttggtcttgcgaagattctatgccccagtatgggggaataccagggccaggaagtgggagtgggtgggttggggatcagagggagaggggcgcggagcatatagaagatttttggagaggaaactaggaaaggtgataacttttgaaatgtaaatgaagaaaacatctaagggaaaaaaaaaaaaggaagtggggctttggagggtattgacaccatggaaactccattttcatgaacagaatttcacttgtcataagacaaaccaacgtctaaaataaaaaagactgaaaaaataataacagaatggttatatcaatgaagatgagaagcaagcaggacatacaagtactgatggcagggagtgaactgaaataatcactttggacacaagtttgagagaagatcctatgatgaatatatatttactctatgatttagccaaactatatctgggaataaattcaatagtgatatgtctgtatgataactcaaaatgactggttataaaagtcacctcacaattacaatgaaatagacatttcctaagtgttcattaacagtagattggttcagtccactgtatcatatttgagcaataaaatatacacaatgaaactgaattatgtataattatatgcaacaatatggatggctggcgagcaaatggcatgaaaaagtcagatccaagagtatatatccagctgctttattacatacagtaacgtgtaaaaagtaaaagcaatggatacttcatctgaggtggaattcaggacagcagtgacccacagcaaagagcaacagaaagaggaatgatatattcctactgtacaggagattctcagtttcttgatgataatgttgattatgaagagtaagtatggtttgtgaaaaacacaccaagatatataattattacctatatacacttacttttttactctcttaatatgtgttcatctctataagtgtttgtgtatttgtgcatgtctatgctggcccagaggctaaaggagggcatcaaatttttctctatgattctccatctatttctttgagtcaaggtctctccctgaagttagggctctcgttttcttgcctagactacagactaaagagccacaatatcctctcccttttgctctaactcagaggtggggattacaggtatgtgtgatgacatcaggtttgatacatggataatggcatcttaacttctatcctcaattacatagcaaggactcttgactgatgagccatctctctaaccctgtcatctgtacattattaaaactagactttatttttagttcatggaaagaaaattaatctcaagtagacaaatttcccattatatatatatatatatatatatatatatatttctattttcaacaaccctaaccagaacagcatatttcttacaagtgacaaacttacattgacacataattgtctaccaaaacctatttatactagcatttgctttagtttgtgtgctccaaggatttgactagacatatataataggatatgctcagtactataatagtgttttttaaaaaggaaaaaagaaaacatttccagtgccctagaaggccttttccaagtaacttctctgctccctctaaatcctgacttaatgttttgcattttcaagagtgttaaagtgttaggaccgtatagtacacataactttctcaagctggttttctttacttggtaatatacattgatgtcttctctctgtgccttttaatgctatttaccatttacttacttgttggttggtttgttggtgtgtttgttttgtgtgtgcatgtatggaggtgcagatgccatggtgtgaatgggggagtcagagaacaactatcagtagtgtactgctctgttcttctctttcaccatatgggtcccaggcattgaactcaggacatcaggtgtggtagcaagcgccttcacctgctgtggcatcttaccagcccccttcgatatctctttttgtttttaagtttggtagctcacttcttttaacattacattatgttaaattattttggttgcaattcatcaagttagttaaacttatcttggctgactgtgactttctacttgtgaatgaaaactgctgtgtggatgcaatcatgagcgtgcttgtgtatgcacacaaatgttcacctttggagttaattatgaaatattgtgactgctgtgtcatctcaaaagaatgtacttagttttctaagaaacagtcaaactgactttcaaagtgactctagttgccttgtgtttctaccaaccgtgaatgacagttactgctctttaacacactcacgagcctttggtttagccttggttttgcacattggaattattgtgaagtagcaccttattttagcttgcatttccttgctggtatatgatgggttatttaacatctaaataccttttttaaggaggtgtccattaaggtatttaacccattttaaaattaggtaaattgtcttattcttttagttttaaaattctttacatattttagataacaatcctttgccagctgtcttctacaaatattttctcccagtctatgtccttgggctcttagatataagcatttttcagtatgtatgtatatatcatatatatgtaaacaacccattatatttagttacattcttttgtaagtggacatatcataaaggttatgatttaaccaatttaatatacagttcagtagcattcagtatttacacaccatcaggcaacaaccaccactacctagatccttcctattcccccttcttctcctacttgtcaggggtccctaactgaccaggctgcctataagaagacctaactgatgctagttccttgtgtatagtctcttttcagttataacaatgaattcatggcttagtcacacaatattttgtgttataatgccatagcatttgaaactgaatgctatgccattgtgtcccatcgattttaagtaccacataagtacttaaatacttttggctcttacaccaaagccattgaaccaaatatcagccaactagttgataatttatgtgacagtatgagcaaactggccaaaattatgttcacattacctccataataatgtttggaagatcttaagacgttctgtgtgttctaaaatatctcccatcctcacttacaacctattatatataaccctacaaagaggtttttttttttttttccatttttaaacccaacagcttttggggaatagtaatattaaagcataaacactttggggtaggctaaatctcttattttcttttataagcgaggcctcaatgtgaatggaatggaaccattactggtatatctagccccttgtgtgcacaaacaccaagttactaacgtaggactgccatcctcttcatgatgagaaaatagaggctgaggcttgctgagcagatgaaagccagtgaacaacgagacaatgaactggactatgtttccagaaggaaagctttttggcaaattacctcagtgtttgaattctgactttcaaggttttgtcttttccatttagtgctcactgagctagtctttaagaatatttcttgtaaaccagggcaggggagagatcttagaccataaagtacttgccaagccaccaggactacccaagttcagatacctagcacccacctagaaggccaggaatggtatctcaggcttggaatcccagcacttgggagacagaagtgaatggagcttagtggattgctggctagctagtaatccccaggacccactgagagactgtctcaaaaagcaaggaggacagatcctgaggtataccgactattgacctctgtttcaatacatgtgctctcgaacatacctgagtacatgcatgtgtgtgtgtgtgtgtgtgcacacatgtgtacagggagagagagagagagagagagagaaagagagagagagagtgtgtgtctcagaaaccagagatgctcagtatccaagatacttcaagtactataatattctctttgagctctctttccccaggtgaaataaactcaatttcttctctgctatcttctaaaataaaattttctccgaatttaataagaaatgtcaaaactcagaaaaagaccatttatctgaggtcctacagcgtgaagttatgatttataattgtcaagtacacctgccaatatcaagcataaacatggaagtagtagtatgtgtttagtagatattaaactgaaatgtcttcagctagtcaatgaaaggtggcccgtatctgttatcccagaacatggaagactgagggaggtggattcttacaagtctgaggtcaacttggactagagaatgagaccatgtctcaaaattagtcaattaattagtaataacctacactaattcttgttaaaatatgggaagacctagttatattatctagatctcagatgctcaaagtccactaccacagaactctaattttacagactgaataacttggaagagaagaagtatagacaaaaggggaagagaaaaaaacatgaaattagattaacatagactctattgggggactaatatgaaacacatgctaaaatcattaggaataacatgcctggaaaacagtcatatgccttttagatgatatttcacaggtgatctcttgcttagcagtgctattgatacagaatttgcattgcacagttcactcgtgtgaagtctataatttagaagatcttagtagacgtacagaattgtgcaatcatcaccattgtctaattttagaacattttctcactgcacaaagcaacttcatacactcagcaggtgctgccattctctcttcccagccccaggaaatccccaatctgagtgcgtgttttggttgattagttcatcctgagcatttcatatcaatggaattcagaatgttttctgacaggcttctttgtaataaaggttttacatttgaagttcatctaggctgtgacattctctttgcattttttaagatttattttatttctctttctctgcatgtgtgcatgtacttggtgtgtgttgtgtgtgccgtgtgagtacagatgttcacggaggcccaaactggttatccgatcccctgagctggaatcacaggcagctgtgtgctgcccaacaagggtgttgaaaaacaagctccagccctccacaataacagaaaatattcaaaaccactgagccatctcaccaatgctttctttatgagtttcaccaaattgcactcctttattttgctacattataattagtttttcattcatgtactagtaaatatttaggttgtttctctccttttgcctaatataaataatacggacacaaaaacttgtgtgtgtgtgagtgtttgtgtgaaatgttcatttgtgcgtgtgtgtgcatgtgtgtgtgtgtgtatgtgtgtgtgtgtatgtgtgccatgcaatatttaaaatgaaatttggggaccctatgataattctatgcttaagcttttgagcaactgaaacccttcactagaatgtctgaaagtgttaccaaccaagcaaagtgtgagttcggacttactcttgtgctcactaacaactgtgtctcctttgtctcttctattatagccgttcagttagtgtgaagtagaatgtcattgtggttttcacttatatttcccctaatgacgaatggtgcgaagcatcttttcatgtggttttttcatcattcccagattcctttgaagaactgcctattcagatcctctgccaagtttttgactgggttgcttgttgagttgtaagagttcttcatacacccggcagtaaagttcctttcctgttacatgacagctgaatagtccctcccattctgcggtcacctttttgttggttccctttcagcataaaagcctggactgatgctaaagtttagtttacccacgttctggtttgttatgatgccttcaacctgattcctaagaagccatcgccaacccaacgccacagaggtttacacgtgttttacttttacgcttgagtctgctgtcacttatttttatggtgtatatcacattatatatgtgcttaaatctgcattttcgcatgaatatcaagttatacctgaatcatttattttacaatgattatttttttctccattgaatcaacttgctttctctgtcaaaattaaatgaacaacagaacaccacaatggttttctagacgcttaattctattactttgatctatatacaattatcctgtgtcagtaccattctggcttgattattaccgctcagtagtgggtttaaaataagggaaaatgagacttgtaagcacatatatctttctcaagattgttttagctagtatagggctctgacatttccatatgaattttaggatcagcttgtcagtttcctaagataaagccagatttgatctttatgttacatttgttgaccatgtaagagtttatcaagagtatttcttccataatgtaaaataactacagttataattattcaatagacagctagttatttctagacttgaggaggagaagttgatgacataattgcataagtagtcaatagcagatgtatagacactattcataaaagcaattaactgtcaaatgtaggtatagaataaaacagttaggatttttaaaaatgttatttatcaatggaaaaattaggtaggccctccctgagtattaatgatataaagatttaactagctctaaatataaaaatataattgaagaacaagttcatatgcttttaatttaatctctacaaaatataagctcatgtcaactacttgaagttcaactcttctattattggattatatgtgatataataacaaaactccctcaaataggacaatgagcacataataatctagaattacaaagccaattccctcaaaactgctatgtcaagattattcttactgtgtgtggccatttcaatgtattaaaaaattactgaaaataactgtaagagaacaatagcagctgtgaactctgcagaatctgtctcttttctgtgtctctttgaaaaataagtcatatgttgcctttgttgtggtctagtacactacaatagagcaatcaagtaatattagaccacacaatagctcaagaaaatctatccccccttctgcaactttcaaaagcattttctttggggataaataaatatgctacagtacttgaccaagtcatctatccttaataaagggtccaattaattgtgagctagcccttgctagaggaatgtttcaattccacttgaaaagaaaaagaaatgctttattgagtaatccttctggtttatgttttatttactaaatatttatatattggttgccagaggatctttagcagcgattgtcctttgtaatgcaaacagtcactttaaagatcttcccaaaagcaacaataagtactataaattgaaagggttaaagggaacttccctacaacccctttagatacgccataaatgtttaaataatggtcattgtgctcagtaaagacatttttacaaaatgctaattattatctgttacattttttcagttaagaatgttgtgttagcaagatttacagaaggtcatatttttggtctagaagcagttgagtataaaacagtaacgataatcctcaatgctaagaaaaaagcattggcaaagatggggtgattgcttccttcccaattcagctcacatttcctaattttggggtacactggaaattcaagccaaatggagagaatgcgtattttgatgttctttatccaataaatgtttcagtagtcctctgacaccttactctgtgagctgaaacttaagttgatgtgcaaattgaatttaaaaactgaagctcagaatctaatatatctatactgctcataacacaaatacttggttttgggaaaagatgcatttaccagtatataaatggttgtgtcttaacaaactggaatgttgttatcctcttaatacttaaatgatggcaatttttaaacagtattttagtttcctgcattagtttgtcagctctaattgttactatgaatactcaaatcatacattatcttatctgattatttgcattgaaaacatgaattaaaacacctgaaaacttccttgactgttacaaattactgtgtagtgaaagaaagagagtaaataaacacttatcaaggaccatctgtccttacacatactgtagaactactggattcttgctgagagcaactgactgtcaagaatcaagcacgctaccatcacaatgggagttaatttcaacacatgacttagaagtggcactaaaatttacatagcattatctacaccaaaacattggtaaagtaacattttattgaaatttttaaagggaagataaaggatttaaattacaattttctaccacaaattttcttttaccagtttccatcagatacaccttttctaactcactaccttttactctctaccacggcaagctacccaacttagctgacattttctctacacagctttcccagaaccttcttttccttgaccatattaaatagctgaagatttcagattgccttaggaccatgtatcagttacttacatatgcaaaccaaatacccgactcaaacaagaggggaacatttcactttggctcatccactcagaggtttcactccacaatggcaggggaggcatggtagcattaatgatcctaatggcatgtgatagaggtaactcgagtcacagcagaccaggacacagaaaaagagggaccaaaaccaggatctacgctattgtcccaatggctgtcttctagggatgtcttcagtcagctcctatcttctaaaggctccacagcctcccaacatggcaccaccatctgggtagcaaaagttaagtctggaatcagagaggagtcacacttcacatttatacaattacagatggttcctggtatccaaacctcatcatttttgaaaaaaaagaaactttcttatttataagatctatctactatgaaaaacaaagaaaatgtaatggtagtctttgaataaacttggcaaaccagactcattgctcatgaaaaataacaatggttgctagtactacctgtctgtttatgctatgcctgcctgtctctatggcaacactagtcatttctaccttagactgagcatcacccttcacttcaagccttgaccctctggtctgacttggaattgactctgtttttgaaaaaaaaatccagcaacaattggtacagctctatttatttggcatttgtatgctcttggcagtatattgtgtactttacaaataatcacattttatttaaacctccaagtcttagaagtgaacactcttttccacatctgcttcttggcttcgccttgtcacgacaaaaggtgttcacatcctcatggtaggagagtgcagtgtgctcaaccaagagtcaggaatgtgctgatgaacagtgtgagctgagctctaaatggtgtgaggagacaaaggaagttgtatgccatactgacatctaatgcattgtactttgcactgtggtcactaactccaaatgatgccacctgcataatcttcatagagaccctgaggagcaaatactgtttatgatgtcatttcattgttgcaagactgaggatcgaacttacatcctcacacatgctaggtaagcaccctgtccccaagctatagccccacctctgacttctttttcaaagaggaggaaaatggacccagacagagagaaagctgtttaaaaaaaaatctgctaacaaatgacccgcatgtgagttaactgagcccttatcatctcccccatacacactttatgtcattggaacaacaccatggatatgcactctgtgcatatcacacacaccttatgtgtatgtggttgcatacatgtaagtcagcacttcaaaactgaaaaggcataatcaattacagagaactgattctggaatctatattcataattaaattttagttttatcttttaaaaatcatatttttgtaaactagaggaatgtactttgggttttcatgatatttaaaaaatgcaatcctccaatccccagaggtattgtaggtgtggctgctgtgtcacgtgtgtgtcagtaggtggcagaaaggagagatgctatgtctctgctcaatgttctgacctatgaacatctatctaaatgatgttcctgaaaaaaaatgcaagcctaaaacaaccatgagtccagtgcctgtcaggcctggaacgacttccaggactaaaatcacactgagcctgaagatgacccttgcaaggagacactcaggaagggaagccatcagtgcagcaccatgcaggccttgatgagcagaccatgcctgagatcattcctgcctggcaccataatgtggaagcaaggcatagtactcctgagtccaatgctaagacgaccccagacactgagaccctgggttccactagaagcaacaagtaagtggtggagaaatggaagagaaagagcaacagaaggatgtgtgcacaatgaagagaggcagaccaggagacttgaggatagtgaggaacagcctgatgtgaatgccagtgatccacctagcaccatgaggtctggcttgtgataccaccaggagtcacatctgggtctgtggcctagtagcagcaggggtctgttactaccaaaactcaggcagatggtcctggagacatgttgatatctgaaggcggtgtagaattagctccttctcctcctcctcctcctcctcctcctcctccttctcctccttctcctcctcctcctcctcctcctcctcctcctcctcctccttctcctcctcctcctccttctccttctccttctcctccttctcctccttctcctcctccttcttcttctcctccttctcctccttctcctcctccttcttcttctcctccttctcctcctccttcttcttctcctccttctcctccttctcctccttctcctcttcctccttctccttactccccctccccctcctcctcctcctcctcctcctcccccctctcccctcaccatctgtggcaggtgggaaacctgaccctggggtcatgaaagcaggaaaaggccctgcccctcaccagctgcagccctcagcacaaggatgaagggatgaagacaagctaacactgagggcatgagcataggagagctggctgtgccacttgtctgccatgaggcgactggtgagggattctccccttttgacgtgtgccacctatagcaatcaggagagctggccctgaggtcatcagaactggaaaagctggccctgctcctcatcttctgcaacgctcaggagagcaagctctgcacctcacttgggcagcacagtggagctgaccctaaatgtgggtattgcttattgataatagccagaagctggaaagaacccagatgtccctcaacagaggaatggataccgaaaatgtggtacatctacacaatggagtactactcagctattaaaacaatgaatttatgaaattcttgggcaaatggacgtatctggaggatatcatccttagtgaggtaacccaatcacaaaagaactcacttgatatgcactcactgataagtggatcttagcccagaaacttagaatacccaagatacaatttgcaaaacacaagaaaatcaagaagaaggaagaccaacatgtggatacttcattccttcttagaatagggaacaaaatacccatggaaggagttacagagacaaagtttggagctaagatgaaaggatgaaccatccagagactaccccatccagggatccatctcagaatcagccaccaaacccagacactattgtatatgccagcaagattttgctgaaaggaccctcatatagctgtctcatgtgaggctatgccagtgcctggcaaatacagaagtgaatgctcacagtcatctattggatggaacacagggctcccaatggaggagctagagaaagtacccaaggagctgaaggggtctgcaaccctataggtgatacaacaatatgaactaaccagtatcacccggagctcgtgtccctagctgcatatgtagcagaagatggcctagtcggccatcattgggaagagaggcccctaggtcttgcaaactttatataccccagtacaggagaacgccagcgccaagaagtgggagtgggtgggtaggggaacagggcaggggggaaggtatagggaacttttgggatagcattttaaatgtaaataaagaaaatatcaaaaagaaaaaaaaaagaagataagatagcctgagtgtctaagcatagaagagccagccctaatgagggagggatgccctcctcgacaccctcatttctcaatatctatggcaggtaggagagctggcctgttgcgcccacctcagccggcaaggaagacacaacatggtcggattcttctcaacagcctttattgcaggaacgcctcaatgctgctacggggaccccaggaacccagggaggtctgcttttatgcaccccagcacagggaaaggcttcgtgtcctcctgggataggatgaaccgctctcacctaattagcatgtacctgctctggaggggttggcgccagactcgggcttacgcctgcgcagtggtgttgtttatgacaatggcacaccggaaacaagcgccatcttagagttggcttcctacactggccctaggtcatgagagtggaactactggctatgtccctcatcagctacaacacttgggagagcaggccttgcatgtcattcaggcagccagatagagctggtcctgtttggacctgagagtttgctggtgggtgtgagagctgggtggcaggcttatcatcacagacatctctcaggcccagattcaggactttgaatctgcccacctcaacatgtaccccattgattgactactgaagtgcatgaaggggctagtcctacagatccaaaactacaggaacttcatgacacaggaaaggaacaggatgtctgagaggagtcccagttaggttccggtactggtagcataacagaagccagaggccatctaccaggtcaaggagtcattgcaatgaacagttgcaagcaaagaagtgtgggcaaaagggtgtactgtgggatatacactgtgacccactaaagattccacaatgagaatttctttcttttgcggggagattgcaagggtggaagagacgtatgagggaagggagagatgagtgggattggggtgcctgatgtgaaattcctaaagaaccaacaaaaagctaaaaatgaaatcttatttaacttatatatgggcattgagactggggtcaccacaatgtttccagagatgagagcatctaaaattcttcttaatatacctcttaatattaaacactgttcagaaggagaaaatagaggaaaataactagaaaataagaatgtggttgcatgatggtatgactgagcgtcaatcactctaacatgttatattgtcaaggaaatatgagccacaatatataaattacactaaaataactttaaggaaatggtaataatcacatcaagtgaatatttaacacatgcaataggtcatgaactttgtgcacatttttcaaattccttttttatttcctgcagttatatgtatgggagatggttatgtgcacataagtgcagatgcttcaaagcccagaggtgtcaaatattcctcaagttggagttacaggcaattgagaattatgtgatatgagtgctaaactcaagtcctctgaccttaaccaatgagctctctctctctctccctctctctctctctctttctctctctctaatccatatataagcactgttatattcaatactcatgtgactccatgagatataattatcacctgtacttcacagggaggccagtgagatttaggaaggtatgagactatctcagagtcaccagtttataagtggtttgagccaaaatttctgatatgcggctaccaacagcatcactctctcaagtataagagaaagattagattgggagaaaatgaaacacagagctaccaatcttcgtgaattcacaaagcaaaaaaaaaaaattacagtattttcaagctgcaactttttaaaaaacaggagtagtttaacaaacaaggcagtcgagtgtgggcctataagaggaccatttaggaagtggaggcagaaagatcagtagctcaagtacacttagctatgtagagaatctaaagctatttttctcaaaataaataaatactgttatagtaagtcatggcaactcatacatttaaaaaattaggaagtcttagaacaatggcttagtaaaaagtagtaattatcagttatgaaataggtaatatgaatagtataacaaatttgtttaacttggttcttcctctgcaataggaaagatgaactgggagggggaggggaagtatcttgcaaaggaggtaaattgtctcttcctaaagacaaggcaaggagctctcgctgagagcagagaaaactcccgaaaaccatcaaagcctgaaatattcaggaaagcatttgaattgattgcttgaggtgagacttggaaagtcatttcctgtctcatctcttcttagaaagagcggaggacggctcaacagtgtgatctcaatcacgtcaagagacgtagagagagccgtatatcaagtcccttgcttcctaagccttgccctcgaggcttgctattcacatcacagttcttggattccagggtgcaccatccaagaactgtgcaatcatggctaagtggtacccacgctgcagagagtctgttttacccttgctccggtttccctatggagtgttgtatgggaattacatcctgcatagcaattgcattcagcccatcagatgattacaggcatctctcctagaaaatcttcaatcctgatacacccaacactattacccaacttttgaggcaatgaaagattcatgaagacaaagataccacagaggtgggaaatgtaaaatacacatgcggagatgaggttgtttttaatttctttctcaatcacagtttattctgtgcattagaaggtggcaagctgtgtgcataataaaaaaaatcatatctttatgaacttaggtaccttgtaccatagttaccatcactacagaaaggaacagagcattgtgtaacttaagtccaatgagaagcagataacacacccctcttcctgactagaaaacatatatttactcccaaaattcagaactaaagtgctatgaaaataatgctggatcttcatacagaatacttattttattgtattgtatatataaatgtgtattgtgtgcatggtgtgtgtgtgtgtgtgtgtgtgcatgctcacgtttgtacaaatgcacatatctgtgcctgcatgtggaggcctaaggttgatgtcaggtgtcttcctctattgaattctaccttatacactgagacagagtctcttgctaaatctagagctcatcattttggctagtctgtcttgtgtcccctttccacagactggggattataggtaggctgtcatgttcacacaccttttactaggttttggggatgtgaacattaagtcttcacacttctgcagtgagagctctacctgctgagccatctccccagacttcccactattggccagaattaacacagatgctaatcacatgtactcccatatgttcgttggatttaatgtgaaagccttcgttttccataaactaactgtatttcataattagggttcgtataaggatccaagttgccatctacataaaatttaaacacagaaaattccctggagtttaaagactttttttttttcataaaaccacattgtgagccaaccttcccctccaccgccccccacacccccccccagacaaaaactagctgttcctttaagaaaaaccaatactctgagctcctggaggttatacactgatctccacactaaagcttttctaggagttttttttttttcccatggaagctttaatttatttgattgcctgttttcacccacattcataacttctcagtaactcatatttctagcatctgggtgtaactgacatagaatgatagatagcctttgctaacttggtacaccgttataaagtcatcagtgttcttaatggagagcaaaggcatcaggtaagataaacaagagagttcctctgatgttctggtacaagagacacagggagcaaagtggtttagaaaaatcatgtgtgtaaagaactaagcatttaagtcacattttttccaaaactaaagactgagataaatatactgtttgtcaaaacaatatagtcattcaaaccacagttacatgggtcatattgggaaacaggaccacattggaatgcaggaccagaaacttttcacattccagtatcaagatggcatgttcaggccttggactcaaggaccaaggcaagttcagaaaagagtgggccactattacagttgtctgtctcttgctttgatcacaacgttctgacaaaaggcagctctgggataaaactggcttattttatttagtagaatagaattgtggttttccctaggttcatggtccatctagtattaggttcttggccacccaagcagtgtcaagtatgggttccatctcatggaatgggccttagatccaattatcgtgtggtggattggatacaacttcagtgccactctgccaccagcacatcatgcagacaggtcaccattatagatcacagggtttggaactagcttgatgcttagctttctcccctcattgcatgcagctcacccttcagtaccaagtaccactagtaggatggcgagagatgtctagtttaggctttgtctgcccaattatttggtgaatccatttgttcttctaaaggaacatgggaataaaattactcctgttggcattctattatacccatagatcagttcttgctcagccatcatcagagaagcctcctgttcaacaaaagggtttattccacttacagattacaatccatcattaaaggaaataagagcagaagcataaagcagaaactattgaggaatctgcttgctggatcatatttaactagcatattctctatagcccaggactacctgcccaggaaattgtccagctcacactgggttaggccctgctaaacaactaacaatcaagacaaccccctgacatgcccacaggccgacctcttcggagcaatcttctcagttgagactcctcactcaagtgactcaaggttgtgttatgttgaccaggggtgaagttaacctcaccctcctcaactcaacacacaaactcatcattttcaaaccataatcttctattccttaccccactgtactggctagttttgtgtgtcaacttgacataggctggagttatcacagagaaaggagcttcagttgaggaaatgcatccatgagatccaactgtaaggcattttctcaattagtgatgggggggggcggtccattgtgtgtggtgccatccctgggctggtagccttgggtactataagaaaacaagctgagcaaggcagaggaagcaagccagcaagtaccatacttccatggcctctgcatcagctcctgcttcctgacctgttttagtttcagtcctaacttcctttggtgatgaacagcagtaagcaagtgtaagatgaataagccctttcttccacaacttgcttcttggtcatgatgtttgtgcaggaatagaagacacccacccaaaatcacatgttaatatcctattataaaacatagtccaacttttaagtctcatagtctttaaaagtccaagttccccttaaaaaatccaaattcccaaactttgagtcctgtaaacacacacacacacacacacacacacaactaagctacatagtttagtatttcaaggggaataactgggggcatagtaacactcaaatttaagcaaaaccaaaatccagcaaatttaaatcctgtaaatttaaatcctgtagcttaatgctctgaacctggggctcactcattgaagagcctctggtttcataaagcttggccacgtatccttgcaatgtgatatgggagtgaaggagctcctataatgggcaaagagtgagactatttgttcttctataattcttaccaatggacaaagagtgagactatttgttcttctataattcttaccaaaagaaattaaaaaaacatggcagtcccccacccccaccatactaaaggaagcagatgggaaagaaaataaaacttgtgaagtgggaacttgagggctctttggaaagtcagttggttgactggtgccttgctaggataaacacatgaaggaacacatgtctgtttccctgaagcagacacaggtgaaaggatgctctgccagagcaagcttgtgaaaggacacgtgatgaaggattcttcactgatgacatacatgtattgatccgccttgcactgcatagtcgagctccatttgtcaggactccatagagaaaaaaaagcttctgccggtgtgcttccttgttttgctgcctcctccgactcaggccaattggcaggatgatgtcggctgagatagtcatgtgctgaggcaaaacaaatgctaaggcaagacacgtgctgaagcaaacctcgtggaggacatgtgatgtttggagggagtatgaatagaactccacggacagtgatggaggctgagctaggcttccttggcttgtttgcatatctaaacactccttggtctctcaattttactgatcttagcttctttgagagagccatagcagagaacctctcctggcattcctgttggccctggtctctcatgctgcctcttgctgacttgcctgaggcctggctctccctgataggttgtgccactgctgttgatttgtgtttgctttccctaccctactgaactggactgctggtgtacctgtgaagtgttttcaaggtgatcaagctgctgctgctgacctgtgaaccaaactgctgattttctgacaaagtaggtgggatctgctcgaaagaaccatttctaaacacgtccacttaccccatatcctttctttcccactacctctgataggtggtgggctaaaagggagggtaaagcatttaaaccccatcattaaaagaaacctttgaaaaacttaaagttacattgctgtaaaataggcattagggaaattgatgatttccttgtcactgttaaatactgtaaatgtacatcacagaagagtccattagtaagagagaagccatgactatgtaataaagatgaggaacgtccaggatggatggctgcttcctcaccctcctgatgatcagaggtaaaagcctgtgtcttatccaggtttctattgctgtgatgaaacaccacaaccaaaaagcaagttggggaggaaaggatttattaggcttccatttccagatcatagtccatcactggaggaaggcacgataggaactcaagcaggtctagaacttggggacaggagctgatgcagaggcatggaagggtgatgcttactggcttgcttcccatggcttgctcatcctgcttatagaatctaggaccacaagcccacatcctatgaggatgacatttgaatttttcctgtagttcagccagtcttataatgtgcttctgcttgatttcttgcaacttgagctctctggatgctggagaggagattctctttaaggacacacttagcaacctctagattattcattgaaatctggagctcatcaattttatcatcgtgccactcattcctttcctttatcaatttatccagagatactaaaagcaaacagcctgcaaagtcattttccttatttcccccaaactgtagaaagtttcgtatgcagggtcacctaatccatggccagtcccaaatgatagatcaaggtaatcgaaggtatttatttctttaagtttgaaagatagtttccaccgtgggccttcaagagaatatctgagctcccagaagaaagagtgactgaagagctttcagtagctgaaggtgctggtgggttagaaggtcctggaaaattactaagccaattccagatacgtaaaagattcgtttgtatccttccgtttctctagatccactccaggtaccagcttctgtattaataggtgttctctagtgtcacaaaacgtatggaatgtctctatatattaagggaaattattggacttacagtatgcaactaacccaacaatgggcagctgtgcttgagaagaccaagaatctagttagtagttgctcaggcccatgaggctgggtgttttagttgttcttctgtataagctggattcgtgaagaaatagatttcaacagatgtgcttgcaaagtaagtataagcagacaaagaagcccaagtccttccttttaccattgtcttcatgcaggcctccagaagaaggtatggcccagattaaaactgtgtcactggacctaagcttttctttacttgaaacttgctctgtcccaagcttggcttgagctcagagatctgcttccctctgtttccttggattcaacgtgtgtactaccttgtctgtgcttaagcttttcacggtcactatgcctcaagacccagatcaaaagtttctgtcatcccatttcaagatctgtatcaaaagcctgcatcttccagcctcaagataaggatcacaggtgtgcgctgcgctccatttctagattgtagctcattccggatgtagacaagtagaccactgagaatagccattgcaatcactaattgagaaaaatgccttacagctggatctcatagaggcctgttctcatctgaggctcctttctctctggtgagtctagcttgtgtcaggttgatgcacaaaaccatccaatacaatctggtagcttaaaacaagtacgtgtaagtttttgccaatagagacccttgctaatggactgaatcaagttcaagaccagatcaggacaagtttacacagtagtgacctaatcagccattctgtctttctttaaacttaacctaaattagggaaagaagacacttcaaggacattagaacctccctctcccagcccttacagagagtgagtgtccactctgcttcttggaaggtttttctttatgctcttgctgtgtgtgcagagaaagctttcctaacctaaggaagaagtgggcgtggagaaaagaaaagaaaaaaaaccttgagtagtgcattattctggttctggtacctgcaccacacacagctcatttgttcaaattaagctagatttaatttacatctgccactgtacttggtgggtgtcctgcagtcttatcatctctaatattcttgggtctccattgcacctgagcccgccccgcccctttaccaatggactcttctggatttgcctcggggacacagaccccgccacactgtaccagtcctctgtagctttttatgatgtctctaatattgcagctttcatcctttcaaaactaataccatatggatgactcttacaagttgtcaagtcctgctgccagcctgagatgtaatattggtttgctggaccacagctcctgtgtgctgactctgaggaaatactttctgattgtcccaaggaagcacataagagtttacctcaatggtgctgatctcttccaatcacagctgagtttacaacacacacacacacacacacacacacacacacacacactaaaccttcaagtcaagttttccaacctaaagtgccaaatgcttccacattccatccacaaaacagtccaaggcatctccgttgttttatgaacatgatgttttgtaattcaagatcgttatagtgtcctttatcccctctgtgccactcatattattaatcgcatgccaatacatgtttattgtttgagacaaataacctttcagtgaaacatctcttgtgaaataaaatgctagcttttttatctatgtatataaaagcctgggtgtttatgccacacgttggtcaaataaaggccacactctccatattgtgataaaagagcaaatattatacctgctgaaataattaaacatcttggtgttagaataaaaacaagaagtgatacagaatgatggcactatgataggctcagttctgagcaggctaactctgacattgtatttaattcatgggactctaagattctgtgagagcaaatcggttaccactaaagtcgtacagagtccaaacctagcttcttctgactttgaagaagtctttctgtacaaagacacagaagacatcttactacatctgaagagtgtgcaattatatttagtgttcaatattattttccccagatgcttaggagtccatttaagccccagataacagttattactgacattatgagctgaggtacagaaactgaggggaaatgataacatggtcaaggtgaactctagaacatgagtaattcccctataactaactcaggttgctgtatttctggaggagaatatggtttttattaaaagaaagatggtgaggtggttagaaaaatttgtctttataggtttatttctgaagactctcatccagaatgattaaggtctgagacagaaaatgtttgtgaaaccatacatcacaatcaaagagtaaagtcaagcctggaagacatcacaccaggtaaaatcacttaccactcgagtgtgattccctacattcattacctagaaccctcagtgaaaggagagagcccactctttagacccctacacactcatgccatggcatgcacacacctatcctttcatacacacatatactatgtgcacatacctgcacacaaaacaataattaaattaaattttaagagagttatatcaatcctgtttagtttccactttccaccaatataaatatttgttaatattatgaacaccatttttttcaatcattgctgtatagatacaaaaagcgtgtatgaactttagtatacctgaaacatggctataagctggggaaatctcagttcattcctataattcccagcagtgatggtttacataggtttgttcccataaactcatgtgtttgaatgcttggcccatgaggagaggccaatggggtgtggccttgttggagtaggagtagccttgttggaggaagtgtgttgctgtggggatgggctttgaggtctcctagtgctcaagttctgccctgtgtggaagagattccttctggctgcctttggatcaagacatacctcccatctccttccccagcaccatgtctgcctccaggctgccacacttcctgccatgatgataatggactgaacctttgaaactgtaatccagcctcaatttaatgtttgcctttataagagtttctatggccatggtgtctcttcacagcaataaactcctatctaagatgccaggtaacaatgaagcaacgctggtttccctgtttctcaagaacaatggactcatactctttgttttatggtaagaaaatgagatatcaacatagcctcttccatccctaattcttttctctaccagcatttcatttttaaaaaagggaataccaggtcagaaagcaagaaagaggaatcatctttcattttcaaatgtttttaaattctaaattttcttattaatttatttttttacactccatattttattccctgctgctccccatccaccctccgactgctgcacataccatacctccttttccccacccccttctccacttggatgtccccacccccagccccacctgacctctaaacgccctggggcctccagtctcttgagtgttaggtgcgccatctctgaatgaacacagacctagcagtcctctactgtatatgtgttggggctggtgtgttataagctggtgtatgcttcctgtttggtggtccagtgtttgagagatctcaggggtctagcttaattgagactgctggtcctcctaccgaatcgcccttctcctcagcttctttcagccttccctaattcaacaacaggggtgagctgcttctgtctattggttgggtgcaaatatctgcgtctgagtctttcagctgcttgttgggtctttcagaggacagtcatgatagggccctttttgtgagcactccatagtcttagtagtagtgtcaggccttccccccgccacctccgaactggatctcactttgggcctgttgctgaacctccttttcctcaggctcctctccatttccatctctgaagttctttcagacaggaacaattatgggtcagaaatatgactgtaggatggcaactccattcctcacttgatgtcctgtattcctgctgggctctataagttccctctccctactgtcaggcatttcatctaaggtccctccctttgagtcctgagaatctctcacctcccaggtctctggtgcattctggagggtccccccaacctcctatctcccaaggtcctgcttcttactatcaatattggtcatatagtgacattgaatatgtatgttttgtttacaagttataggtcagttaaagtgactctacccatgaagaatgaagtcaacattgatgtttgatagcatggatgctttgatagagatggtggtaatgatgttttctatttttgtatattcttgttttaagttttgcttttatttgtctcttgtgatatgaaggcttaaatctagggccttacacatgcaggacagatgcattatcattcgcctgtatccccagcccttttatgttatttttgaaacaagatctcattatatagtccagatggccttgaacttgtggccctcctgatttaggttggtgaacagttgagatcatagacccatgcctccatacctagctgaaagtttatagatgggagtttttgtatctttgttcaacagatataaaaaaaattgataataaataaatgaatgaaaacaagaaaacaaaaagagaaaagcatgtgtgtgctgaccatctatccttctgaaatgttaaacttcatcatttcttaaaatatttcacaaagcagaaagaaaagtttcctcttagtcccagagttgcaggaacatttgacctgggataagaaagaatgatggtactgcatggtcctccactgaattcttttctccacatgcacgtgcagacaaatcaccctccatctgcacctaaaaataagccttcatcttgtgactagtacataactcaacactgatgtctctaaaggttaactgtggagcaatgtttattagcatcatttctggtgagccaaaagtagtttgcaaggctactgctgatccatgaaatcattttaaaggtgactgtttgaaactcaatttctatttaaagtctattaagaaagaaagaaagagagagggagagagagagagagagagagagagagagagagagagagagaaagaaagaaagaaagagagagagaaggagagaaagagagaggaagagaggaaaggaagaaaggaagaaagagagagggagggagggagagaggagagagaggagagagagagagagagagagagagagagagagagagagagagaggaagaaagcacacttagctttaatgagacccagtggttttctaacagtagaattcatgagaatattttggaaaatccttgaaaatggagacttattttgtttttattttctactgagataaatttacaacaaaatgaggtcttttttttttttttttacattagagacactgattgagtaggtttgtagagatggcccctagaatctgtggttttcatagccatgtcaagccattctacagatgaagacaacatgtcaagaaacatagcaattcttagaatatcagacaagtttggcctggaattgaacaaaatccaagctttgggcaacaacctaaatacctacatagttttttgtcctagaactctaggctgtggtaaaaatttggaaatgtcactacaggataaatgagttctttcagtgagattttacgtcatgtaccctgactgaagtttcatgtgtttgtaaactttgatatgctatatcatagctatcgtgggatgtcagccacaggttactaaatttactaagttgcagttactaaactttcttactgagaatttcattacgccagaacacatgactagattgtttatcctttcttaagcaatcttcatttgcattaacattctgattcttaacatgcctcgactgagcaaaaccaaagaaaattcataggcaacgcagaaataacagaaacatgtcatcctggaatagacatgtgttccatttaacccgggtacctactttgcataatgagtaatgccggatgatctagggaaagatacagatgcatattacatctgcttcttgcagatgtaacagcaatgatacatcacaatagaatgttttcttctctgaccctgaaatgaccatcattgtgacctaatatttcaagaccccagctcataacgttactgtctctggatcctttcctgcactctctcataaaatatacaggaaacaaaagaaaaaacttgtccagtatattctccccatcaactctgggctaagacaattctacttgtaacagtttattctggttctcattaaaaacatggctggccgggcggtgatggcacacacctgtaatcctagcacttgggtggcagaggcaggtgcatttctgagtttgaggccagcctggtctacaaagtgagttccaggacagccagggctatacagagaaaccctgtcttggaaaaacaaaaacaaaaaacaaaaaacatggctggatgtttgatataaggctaagttttctgattacaggagtcaacggagaactcagtaattcacatttgaaaataatgaaaatcgtcactgtaatgttgatgctaaagcagatgtctgaaatctggacatgcaactgaaaatatttttggaaaacaacaaaattttgattactgttggtacaatataagcattaaaaacaactcatgaattatacactttcgaaagaaatatctagatcgtaactctagcatgttgactcattcactggacaggtatagagttatttctgctgttatatcagaggaaaaaatgtgggcattactctggcagagttggggaggagcaatgaataacataaatttgaataaacaaataaagtaatagaaaaatgtgaaaaaatatgaaaaaatagtcaaaataatgataatatctattgtagaggggtcagctgaattttctccaacaggtgaatgcttttgtaagtttttttttttttttctccttgagggatgtgaagaatatctattgctcttccgaagttctcaatgacaaatcaaagttttattctaccgaagttcaacccagtaaatttgtcaggcttccttgattagaatggataagagattactagcaagagccagggtgatatcagtggagtcctactggaaaatgtttgcctaggttaatatgagctttaaagagtttatctaatccctacctaaaagaatccctagaaaatacacaaacaggaatatacatgtaatcaaaattcagaaaataatgtttggcagtgccagagtagggtacttctgagtctcactacaatgactaccaagacttttctcttgatgactctgtattaatcttctgctctttgtttatttgttaaattttgtttcctgtgttaaggaagaggattgctagttttgccttttggagttaagtttcaatctccttctccagactggcagacagaatagaaaaacagctggtctccagacttttcaacccaagctgggtgtgaagtttggcttatttcaattaagtcttctttgtaattaaatatttacatataagctaagtgcatgcagatctacgagtaactgcaatgcttgccctttaaagaagcattgttaaatcatgttcatggttgtcttcccagcaatacatagccagatgttagtcttttaaagttatcaatttatagcaataaacttcattactatataatcttaaaagtctgacactttatagttttcccaggagaggaaacagtttacagagtacatattgtgcagtcccataagttacattactgtagaactatgtgtctagaacaatggactagaattctcctgcaatgtacagtctacggcagatgaggcaaaactctctctcaacttgcctctttctctcacctagaataattctcaaatctcagaaggcttctaaaatatcccatgtcaatccattttgctagcaaagaagtaataaatttgatggtcactgtaattctgtatacttccttagacttcatttagaaccacactcaaaaaaagaatatgggactctggacctctcttttagatttaaaacttgaacaacatatctctaagtctattattcaactacaaagattccctcatacagcaaacatctaagaatttgccactccttcaaaagagcacagttttctgcttgaagacagtacacaccatcatggaatggacaaaccacagtgccacacacattatctgagttttatagatttccacccctctttccctcaacttcatgtcatgacaattacaagtctcatagatgagaagtctttcaatagcatcttacagcttggaattgatctctcacctattctaccacaatagctgtaagagtccattgtgtacaccaactgtattggttactattctgttgctatgataaaacacaaatctcatacttccaaaatataatggcacagattgtacattaccattccaaagggtgctaatagagatatagtgaggaaatatttgagcaaaacaagaccaaactctagtagggcaaaaaccaaatcctttagttccatgtacaatgttaaagggcttagatagctccaccttccagctttgctgtctacaacatcttgggcaggtgtcactctctgtatgtaactctccttgacaggatctgacacctctgcatctccagtatcttgggattttcaacacatcccagggctcagcttcacagtttcctgtaatggcctctcgatgtctccacacagggattcccttgccacacactacctggctacagcagctccctgaatcacaaagggaaaatatacaagcccctcactcttgtgtctcaaaagaaagcacgccatagaggaccttgccaaattcccctgtcagtctaggatgtaccctactcaaccacatatactcacaccaatttagcagcaggctttgtttgcagttactttctttcatatatatatatatatatatatatatatatatatatatatatatatatattattacgtattttccacaattacatttagaatgctatcccaaaagtcccccataacctaccccccacttccctacccacccattcccattttttggccctggcatccccctgtattggggcatataaagtttgcgtgtccaatgggcctctctttccagtgatggcctactaggccatcttttaatacatatgcagctagagtcaagagctccggggtactgcttagttcataatgttgttgcacctacagggttgcagatctctttctttttttttttttttttttttttttttgtgtgtgatacaaacctattttattttattttttttttatttgtttttttttccattttttattaggtatttagctcatttacatttccaatgctataccaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcacaagagacagctacatctgggtcctttcgataaaatcttgctagtatatgcaatggtgtcagcgtttggatgctgattatggggtggatccctggatatggcagtctctacatggtccatcctttcatctcagctccaaactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccaattttctgaggaaccgccagactgatttccagagtggttgtacaagcctgcaatcccaccaacaacggaggagtgttcctctttctccacatcctcgccagcatctgctgtcacctgaatttttgatcttagccattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttggctcccttgtcgaagatcaagtgaccataggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctcggttttttgttattccagatgaatttgcaaattgctccttctaattcgttgaagaattgagttggaattttaatggggattgcattgaatctgtagattgcttttggcaagatagccatttttacaatgttggtcctgccaatccatgagcatgggagatctttccatcttctgagatcttctttaatttctttcttcagggacttgaagtttttatcatacagatctttcacttctttcgttagagtcacgccgagatattttatattatttgtggctattgagaagggtgttgtttccctaatttctttctcagcctgtttattctttgtgtagagaaaggccattgacttgtttgagttaattttatatccagctacttcaccgaagctgtttatcaggtttaggagttctctggtagaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattaaggatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccgtctggtcctgggctttttttggctgggagactattaataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccgttttttcttgaaggcactcatagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccatgtgaatgttggctttctgttatttattttgttattgaagatcagccttagtgcatggtgatctgataggatacatgggacaatttcaatatttttgaatctgttgaggcctgatttgtgacctattatgtggtcaattttggagaaggtaccatgaggtgctgagaagaaggtatatccttttgttttagggtaaaatgttctgtagatatctgtcagatccatttgtttcatcagttctgttagtttcagtgtgtccctgtttagtttctgtttccatgatctgtccattggtgaaagtggtgtgttgaagtctcccactattattgtgtgaggcgcaatgtgtgctttgagctttactaaagtttctttagtgaatgtggctgctcttgtatttggagcatagatattcagaattgagagttcctcttggaggattttacctttgatgagaatgaagtgtccctccttgtcttttttgatgactttgggttggaagtcaatcttatcagatattaggatggctactcctgcttgtttcttcataccatttgcttggaaaattgttttccagcctttcattctgaggtagtgtctatctttttctctgagatgagtttcctgtaagcagcaaaatgttgggtcttgtttgtgtagccagtttgttagtctatgtctttttattggcgagttgagaccattgatgttaagagatattaaggaaaagtaattgttgcttcctgttattttagttgttaaaggtggcattctgttcttgtggctgtcttcttttaggtttgttgagggattaccttcttgttttttctagggcgttgttcccgttcttgtattggtttttttctgttattatcctttgaagggctggattcgtggagagataatgcgtgaatttggttttgtcgtggaatactttggtttctccctctatgataattgagagtttggctgggtatagtagcctgggctgcagtttgtgttctcttagtgtctgtataacatctgtccaggctcttctggctttcatagtctctggtgaaaaatctggtgtaattctgataggcttgcctttatatgttacttgacctttttcccttactgcttttagtattctatctttatttagtgcatttgatgttctgattattatgtgtcgggaggaatttcttttctggtccagtctatttggagttctgtaggcttcttgtatgttcatatgcatctcattctttagatttgggaagtcttcttcaataattttgttgaagatgtttgctggacctttgagttgaaaatcttcattctcatccactcctattatccgtacgtttggtcttcttattgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctctagtgttgcctcgctttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgttggggttccctggactgggcgaagtgggtgtgctgggttctggtgatggtgagtggtcttggttcctgttagtaagattcctccgtttacctttcgccatctggtaatctctggagttagtagttatagttgactctgtttagagattgttcttctggtgattctgttaccgtctatcagcagacctgggagacagattctctcctctgagtttcagtgctcagagcactctctgctggcaagctctcttacagggaaggtgcgcagatatcttttatttggacctcctcctggccgaagaagaaggcccaaaacaggacctttctcagacactgtgttgctttggcagttcccaggtggtacagactctcacctaagcagactaaattcctaggttccttggagtcccgggaccaagatggcgaccgctgctgctgtggcttaggccgcctccccagccgggtgggcacctgtcctctggtccggaaggtggccggctgtccccggcccacacagggtgctgcctcagtgcctctgtgcttccgcctgttccagaagctgtcaggttctctggcgcaccctctcacctgttcagactaatttcctaagttcggcgggtcccggaccaagatggcgaccgctgctgctgtggcttaggccgcctcccctgccgggtgggcacctgtcctccggtccggaaggtggccggctgtccccggcccacacagggtgctgcctcagcgcctctgtgcttctgcctgttccagaagctgtcaggttctctggcgcaccctctcacctgttcagactaatttcctaagttcggagggtctcggaccaagatggcgaccgctgctgctgtggcttaggccgcctccccagccggacgggcacctgtcctccggtccggacggtggctggctgtccccggcccaccgcagatctctttctaagagcagaaaaaaaattcttgggatcttacatttcagaaattggaagcatagataggttagatcatatcctgagggcactcttccctttatttttgaatatgtaattatttattgctttaggctatttttacattcttttaaaaattattttatttatattccaactgtttccctacccccttcccattatagtggctagcaaaagccttaatggcattaatcaatctccttatctcttttagcacaagccttggcaagaacattttgtatttctctcttcactgtagacctgcatgaaagttactagtaaagaccatgccacagactgaatattagcctaccttgaaatttagtctcccaaagaaattagtccattattttttaatttagccttagatacagtatcagaacatgatagaaagcagacaaattatttgccaaaatactatacaaatgacctttggcacagtttctgtttaagtccatgcttcactctgccatgctttcagtgctactgtttctaggatcctactagaacacccctttacactctgcatatgacatttggatgcttttctagtccaaaattctatattgtccagattcctccaagaagtaacacaaacaaacaataaacaaaacagtgcagagttaggttcctcccaaggataccccactctctgtaccaatctctttagttacttctctgttgctgtgatagaacaccatgaccagaagcaacttacagaaggaagaatttatttggacttgtggttccagaggggaagaagttcatcattcaggggaaatatagcaacaagcagcaggcatggcagcagggacgggaggctgagtgttcacatcacaagcacaaagtcaagagagagtgagggaatccaggatgttgttagctttcagagccctcctcagtgatatacttctttcagtaagactttaccacataaacttcccaatccatgtaggaaatcaagtgtttaaatccctgagactatgaggaatatgtgtccttcaaaccaccataccaacttacttaaatttaccttacatacaaccacaaagggagaattctaagatataagtgtgattatgacactgggaacactggggaagttaaataattgaacacctccatcatatcaacggtttgtctgactgcctcatcaacatgtaaaacctttaagacaggttttacacgatttacatgtttccggaatggctcatattcatcccattaatgctgtgtggcattaatctatctttcataaatgtttattgaacggatccatgttagatcttcagagccacagactctcaaaaatgatgattaaggaagaatgttcaggaaaaaacagacaaaaatgacccacagccaagtagtagactttctttcacatctctccatgtgccccagaaaaactgagatctttatctaagataacagagtctatattacaaccttccttggcaccgagggcttttgaaataatattgcacctgaagtgatatttaaggaaatcatatggcaagccagcacctaagccatgcaatgctatgctctaggttttgtgtagaatgaagggaatattttctgaacacgttcactaaactatattagaataaatgtcttcaagtaatgccatatcaacacctatacctgtctcccttttctcaacacacacacacacacatgcacacacatagtcctgatttttgatacaaacatatcttacccagatgtataggaggtgaatcctactatctcctcactgctgttccatctctactccccctaactgcattataatcatagtcattactgctataatgatagtcataatacttctacagtgcttctgagatgatctcaaagcatgactgcatcataactgtaaaactttaaaatattcatctcctctagagatggtgcttataataagggtgggagcttgtagtcttgcctaacacccacaaatcaaacttatgaaaaggcttgctcagatctgtttcttttacttagctaggagtggatgattttattggtgcaggtcaaggcaagtcaaagaggagagacttattcatacccaacatttactgaccttatcaaatacattttatgctgacagggaggaggaaagctttatgcttctgtagtgtaaatctggaaagtgactttcaagttatgatagtgaaattaaccctttccaccaaacccctgcaaagagtcttggtctccacttgggccatatgttttgtgtgattctaataccccttcaacccctttcaatatgatatttcctcccagttctcccactatatctttgcaaagcaccacataaccaccatgaagacaatcatcctttggttcctaggaatcatttagggaatgataacatgaacccatttcttcttcttggagataaaccaatctgtaatttgtcctaagtcatgagaggctcaagtgtttctgttctcacataaagaagaaattaatctcacccttattttccgaatatattcagtatctagcagtacctatgacagactgggaaaactctgacaacaataatgtacacacaagatctctgcacttgagcagtttgcttttcatttaagctatgatttttgagctgataattgatattgcacatgatgtgactgccccaatatttttagtctctttatgatcatgtctatgtataataactcagattcctttgctctccggctgaaaatccattaagaggttctcaacacacttaaaatactgaggtgggttgttgttgcccctcactctctcaaacacatacacacacacacactcgtacagtttcacattatagtcatagtttaatagctggataatggctgtccaatcaccagaatacatccttcattgatgtatgttgtccctgggtataaataggcctggaaattatgccttctgtctctacttctgttccctctactcatgagtcagattaaccttgatgtgtcctcttatgctaggtttcttcatgcagtaacagcaggaactggattgcttttatagagtgtcatgcctctctttctttatacctctggataaatcgtctgtatgcctatgaatgtacacacccccccaacacacatacacacacacacacacacacacacacagagagagagagagagagagagagagagagagagagagagagagagagataacattctctgttaaaaatggttgtgagctaaatggtataggcacaaaggtatacagcctcccacagtgaacaagcagattattaaacatgccagattggtaaatccattcctatggtataagttaaaccttaaaacttaacttccccaagctgtgtattaccccatcaaagttcacactctgcttcccacccagtgcataataaggctatgggttcccattggcataggcgccagcgtgctcgctctgtgccatgtgagaaaacaggccaatggcacagtgctatgctttctttctgcttttccaatcatttaagagtcagctctgcctctttaactgcctataacaccactcagaacatggggcttctaatcacacagagcaagccttcctcctgtggcctctgtctatgtcactcactacctgtctctctgaaaaatgacgtaaagtgctatgtggcttgccaaaatgtttagcaaaagtaaggattttggttgtactttaaaactctactgagttgtgctaaatagaatatttttaagtgatttttccatttcttaatcttaaatggcatacttcttatctctcagtcatctctgtccttttaaatatgcagtgaatacctaacccataaaacagccttctggaaacggaaatataagtactggttacttatgatgcttgccctcaaccaattaccttgccttaagtgagagcttctgtattcagcatcagctctagcacatgcaacttcacccttactaattctttttttttaattaggtattttcctcgtttacatcttcaatgctatcccaaaggtcccccatacccacccccccaatcccctacccacccactccccctttttggccctggcgttcccctgtactggggcatataaagtttgcaagtccaatgggcctctctttgcagtgatggccgactaggccatcttttgatacatatgaagctaaagacaagagctcccgggtactggttagttcatattgttgttccacctatagggttgcagttccctttagctccttgggtaatttctctagctcctccattgggggccgtgtgacccatccaatagctgactgtgatcatccacttctgtgtttgctaggccccggcatagtctcacaagagagagctatatctgggtcctttcagcaaaatcttgctagtgtatgcaatttggatgctttctccccaacctttaattatagcaacataacctgtctagggtgtggaatttctattatttccttgtttctttatctatgatactccataactcacaaactacttttctaagtagcatttgactgaactcctacaagaacccgtgaaagggaatctatgaatatgaacttaaagaaaaaaacacaaaacaaacaaacaaaaaaaaaaaaacaacagaaactcaaggatgttgtcactgactctgtccacacacaacctcaaagggagaaatgagcatttctgacaccaaatcatggcatggaaatgtccagtcacttctaccatctccatttagcaagtatgtgttcagcatacttatataccaaatatttccataaaaaatcattttcattttctgagccctctatcactttcttcatctattgctttgattcagtcagttatctcctttgctctagaactggcctcctctaatttattttttgaatgaatttggttgctctttgaaactaaatagtgctgttcaacatatttgtttgcaggggtgaaaatattctaaatttacatggttcttctgtacgttagtcactagtcaattttgactttatggtcaggatatttgtgatgttgttgttagggttttttgtttatttttattttattttattttttattaggtatttatttcattcccaaaagtcccacacccgctcccccactcactcccccacctacctgctcccacttcttggccctggcgttcccctgtactgaggcagataaagtttgcatgaccaatgtgcctctctttccactgatggccgactaggccatcttctgatatatatgcagctagagacatgagctccagggaggtgggtattggttagttcatattgttattccacctatagggttgcagatccctttagctccttgggtactttctctagctcctccattgtgtgccctgtgatccatccaatagctgactgtgagcatccacctctgtgtttgctaggccctggcatagtctcacaagagacagctatatctgagtcctttcagcaaaatcttgctagtgtatgcaatggtgtcagcgtttggaggctgattatgttagttttttaaattattataaaaaggaatgtgaagtggaaacgtaagggttctttggaaagtctgttggatggtgttttgctggacacaggtgagaaagattaaggcaggtgcatgaaggaagattttgctaaagcagacacatgagagaagatgttttgctaaaacaaacacataaaaagacacgtgatggaggattttttgctaataacacgcatatattggtccaccttacattgcgcgtagttgagcggcatttgttgggatactatagagagaaaagcaccaaaaaaacttatggtggtatactacatcctgttgctgcttccaaggacttgggctgattggatgcacatgctaagacaagacacatgctgaggcaaggcacatggaagatatgtgatgtttagaaggtataaatagaactctacagagtaatggagacagagcttggcttgctggtacagctagctgtgcaatgcttgttggtctcgacatcttcactgattttcacttccctgagagaggcacagctgagaaacgtctcctggtgttcctccaggtccctctcatgacttgaactgaggctgaggcatggctgtctctgccaggtcatatcaccactgttaccaaactgactctgccgaaatggactgctgctgtatccatgaagtgtttgcaagtggatggagctgctgctgcctgctgacctgtgaactgaactgctgatttccaggtaacacagacgggagttgctccaaagaacctttctaaacaggcctaccttcctcatatcctttctttcccactacctctggggtggattacagggaaggctaaagcatctaacaatcatcattaaaaataagattttaaaaaaattaaagttacaggaatggatctcactatggatttttcatgtcctctcccctcccccacgccccacctctttccccggaagcttcttggtggtcgtcttcctgttccccagaggcctctgtgtcctgtcacatgtattccgatctactctcttcccactgcaactctttttctcatctaatggtcccatttcgagttttacaacctagtcaaacacacacacaaaatctaaaatatttttaggttaccaaagtgttgagatttcatggggtggaaggaattcaattttcctttcctatatagaagataccttgcagtatacatatgtccttggtctttggctcttataatctttccatcttctcttctgtcatgttccataagccttagatgtaggagttctgctgtagatgtattaactgggacccgacacattattaggataatgctggcctaatagaatgagttctggttcttttctattttgtggaacagtttgacaagtattggtgttaactattccttaaatgtctggtggaattttgagtagacctgtccagtcctgaacttgctttgtgagagacttaatacctgtttcaacctcattggttgttatggatctgtttatttccatcttcttcatttaattttgataggtcatatatttttaggaatatatccatttcttttatattttccatatttttgctatataacctttcaaaatatttcctaatggttttctgtattatattgaagtctgttttaatatactacttttatcattttattaatttagggcttttctgtctttctattgattagtttggctggggtttgtttatcttgtctatcattgcagaaaaccaattcagtatttggatgattctatatatatttttgcttcctctttcattcatttctgccctaattgttattacatttttaccatctattgcatttgtgtttggctcatttttgcttttctagaacctgaggtgaccctttaggtttttgttttgttttgttttttatttgtgatctttctttttaatgtaagtacttagagtaataaagatggctcttaaactgcatcatctgtgtggcagaggtcctgctaagttatgttattgtttccatttgattataggaatttaaaaaaaaataccctccctgcttcttcaatgccctactgttcattcaaaagtccattgattggtctcctaatgtttgtggagttttgttaattccacttgctttagatttgtagctttattccactttgatctgagcaaatacaatgaataatttccgttcttttatacttgttaacgcttgctctgtggcccataatgggatcagttaggttctgtgagctgctgagaacaatatgtattctttatctgctgaatggaatagtctatagatacccgttaaacctgtttgctctgtggtatggcttagtctctcttagtttctttgctgatttttagtttggatgacttcctgaaaggctagagttgggtactgtaagcttccacattattctatcaagacctatctaatttttatgcattttagtttctattattaactataagttaattgtgtgggttagtgcaaaaagaagagggtttaagcactgtattgtcaaacatctgtttggattagggctagggctagggctagggctagggctagggttaggattagggttagggtcattgtcctttgagtcattcattctgtcctccatgctccttcctctccaactctgcctgttgccctcactttccacaattcattgatgattttgaaccttctaaaatggtatcctttattaatatacagtagctccctgtatctcttctgggtagttctttgcagtctgtattattagttttcaagttagctgtgtcagcttgttttcatcttcaattcacttgacagatggacctccactccttgagtctcagtttgtagatagctggactgtgagtaatgttgttgcggcttctgctgttgttagttaccaggaatagttgacatttgcattttattgaactcagccactttgcatcttttaaagggcaaactgaggtcatttgcgtttagacttattgtgtggagtttgttatttcctatagttttgttggttattgttctggttgattcccttcttgctagtgtgttccttgtccctgtgagttctgagggtttcctggtttactgtgatggacataatggattgcttacaagctccctctttgtttcttcctctcatgaaaagtattctgatttcctgctctcagagatgaggctgtttctttttcctttatgcatagcattcatttaaagatcttgcagtggtgtgggatttttttacatcttgcctcaatttgtgtttattttattgtagccttatttctcacaaaaatttatcagataactttggtttttttggcacttattttgagggcataaaatatatcatttcttgctttctgggattttagggttgctgatgagagagctgatgttatcactatgtatttgtggctgatacggcatttttttctcctacaggttttgatattgtttctttgctttttatttctgacattttgtggtatcatagtctgttctgcttatgtgtatttagggttctaaatgcctactgtgcttcagtgtcttcttctttatgtctgggtaacttcctactatggtttatctgaataacttgcctgtatcttcagcgtttatcttaccacatatcagagtcttttggtggggtcattagtcatttttcttacgtatatatctgaatgtgttaatgtctcagctttatcttctaccctagaaattcattcctctgtttggaattattagtgatagtgttttctagtgtgtttttatttgatcatgtgactctctcatgcatttctgtctggttcattttcagtctcacgttgagaggtttttttctgctagatatttgattttctcctccaatgatgaaaacttttaaccactttcttgtctggttgataaattgatttttttattttgttcatctgtgtatttgagtactctatgagacagaccatagattcttttgtttaaaagtcccctgagaggctctgccagagcctgaacaatacagatgaggatgctgacagccaaccatcagagtgagcatcgagaccgcaatggaggagttagaggaaggactgaaggagctgaaggagtttacaaccccataggaaaaaaaaaaaaaaacaacattattaaccaatcagaacctccccagagatcccagggagtaaaccaacaaccagagtaaatatggaggacccatggctctaactgcttatgtagcagagacttgccttatctggtatccatgaaaacagaggcccttggccccagcttagaggaatgctaaggcctgagtgggtgggttggggaacttcctcatagaagcagggggaggggagggaatagtggggctgtgcagggaaaacagggaagaggcataacatctgaaacataaatacacaaaataaccaataaaaaatagactctgcaatccttttctagcattgtagtgagcccactgtggttgtttgtttgtttgttattggatattttctttgtttacatttcaaactttcccagtttccccaccccagaaatcccatatcccatctcccctcccatgtttctatatggttgttatcccaacaacccacccaaacccccctccttgccctggcattcccctgcactgaggcatcaagccttcacaggactaagggcctctcatcaaattgatgccctgcaaggccatcctctgctacatatgtagctgaagccatgggtccctaaatgtgtactctttggttggtggtttagaccctgggagctctggagggtgtggttggtagatattgttgttcttcctatggggttgcaaaccccttcagatccttcaatcctttctaactcctccattggggactccatgcttagtccaatggttggctgtaagcatctgcctatgtacttgtcaggctctggcagagcctcacaggagacagctctatcaagcttctgtaagtatgtacttcttggcatccacaatagtgtctgggtttggtgactgtatatgggatggatccccaggtgtggcagtctctggatagcctttccttcagtttctgctccacactttgtctccgtatttcccgtctaagaagtaccaaagcattcacactttggtcttccttctggagcttcatgtggtctgtgaattgtatcttgggtattccaagattctggtctaatatccacttatcaatgagtgcataccatgtgtgttcttttatgattgggttacctcactcagaatggtattttcaagttccatccatttgcctaagaatttcataaagtcattgtttttaaaagctgagtagtatttcactgtgtaactgtaccacattttctgtatccattcctttgttcaagaacatctgggttctttacagcttctgacttttataaataaggctgctatgaacatagtgaagcacatgtccttgttatatgttggagcgtcttttgggtatattcccaggagtggtatagctgagtcctcaagtaataatatgtccaattttttgaggaaccaccaaactgatttccagagtagttgtaccagcttgcaggaggagtgttcctttttctccacattctcgccagcatctgctgtcacctgaattttttaacttagccattctgagtggtatgaggtggaatctcagggtttttttttattattattatttgcatttccctgatgactaaggatgttgaacatttttaggtgcttctcagccattcaatattcctcagttgagaattctttaactctgaaccccattttaatagggttatttaattctctggagtctaacttcttgagttctttttatatattggatattagccctctatcagatgtaggattggtaaagatcttttcccaatctgttggttgccattttgtcctacttatagggttttttgccttatagaagctttgcaattttatgaggtcccatgtttctatagttgatcttagcataagccattagtgtcctgttcaagaatttttcccctgtgcccatgtgtttgagattcttccccactttctcttctattagtttcagtgtatctggttttatgtggaggtccgtgatccacttagacttgagccttgtacaaggagataaaaatggatagatttgcattctacatgctgactaccagttgaaccagcaccgtttgttaaaaatgttgtctttttttccactggatggatttagctcttttatcaaagatcaagtgatcataagtgtgtggtttcatttctgggtcttcaattctatacaaatgatctaccagcctatctctgtaccattaccatgcagtttttctgtttttgtttttttgttttttgttttttgtttttttaaccacttattgctctgtagtacagcttgaggttagggatggtgattcccccagaagttcttttattgttgaggatagtttccactaccctaagttttggttattccaaatgaatttgcaaattgctctttctaactctatgaagaattaagttggaatttgatgaggattgcattgaatctgtagattgcttttggaaagatggccatttttattacattaatcctgccaatccaagagcatgggagatttttccatcttccgagatcttctttgatttctttcttcaaagacttgaggttcttgtcacacagaaatctatcaatgcaatccgctatataaacaaactcaaaaaaacatacatgatcatctcattagatgctgagaaataatttgacaaaattcaagaccccttcatggtaaaagtcttggaaagatcaggaattcaaggcccatacataaatatagtaaaagcaatattcagcaaaccagtagccaacatcaaactaaatggaaagaaacttgaagcaatcccactcacatcaaggactagacaaggttgcccacactctccctacctatttaatatagtactcaaagtcctagtcagagcaatttgacaacaaaaggaggtcaaagggatacaaattggaaaggaagaagtcaaaatatcactatttgctgatgatatgatagtatacttaagtgacccaaaaaataccaccagagaactcctaaacctgataaacaacttcagcaaagtggctggatataaaattaactcaaacaaatcagtagccttcctctactcaaaggataaatcggctgagaaagaaattaggaaaacaatacccttcacaatagtcacaaataatataaaataacttggtgtgactctaaccaagcaagtgaaagatctttatggctcactgtgtttcttagtactaagaagttgtgcacttgtctaaatctcctagtgatctgtccttcacactttttgtctttctttctgagttttgtgtccatgtagggatagaagtatcctactgttgtttatttttcttgtccccttactttttcagtggtttcctttatcttacatgagttctcatcctgaaaagttgtatctctggggacttgtgcttcctacttctatttagtgggaggctgactactgtaataggtacaatggtttgacagcaaagacccttttggacctcgtatatgccatcaatgaggtagagagatggtggtggtaatgattgggggaacttataattgtgtagtgctaaggatagtaatatctaaatagtaaaataagactggacttggaaaggggaaagggaaaaaaagcaggagtgagagggaaatcctgtgagttaggcataggattactagaaacattttatggagtaggtatagtgaagagaaataggtacaaattcctgttcaagtgcagtacaagtgaaaaatctcaggtgtgagcatgtaaataaaattaatgaaacctgaaatatgaaatataaggtattacaggtttagttattgtttcttcctatttaggaagaatgtggtacacacacacacacacacacacacacacacacacacttcctcctccttctctattgtcttttgtagtcatctcaaaaggtgaggagagaactaactactgcttttagcaattcaaacaagtacagtcactgtgtccttctttctatgtggagacttcacatcctacagaatccctatctgaaagtcctggtccaaacttccctgatagaactgtcactctggtagttggggaatcatgcattctacatgtagagcttactgtgactggagctctgaggggttctggtttgtatagactgtctagttgtatgactttgtcgctgggaggtctctttacattactgagtccgcgtcacaatcagcagtgcacctgtccacatccttttcaccaatggggtgatggaagggctccagggtactggtgtaggatttcagcttcaagctcctatatcaacttctgtttccaaaagcacactctgtcttgttctggccatccctctgaccacagagtagtcaacccatgtccctgcaactatttttggcacctggagtctacaacagaagataatagaaacagaaccaagcaactaccactgactccaacctagagatggaagtgagaaccaactgggaacttctcaccattcatctatcctcaaactctcctctaaaattctaattcaattctataacatttcatggaagccctgaatttaaaactgtatgtcccttttattttgacagaaacacactttgtattatactatatcaattattaaatgattttctctttctacaaagtatatctacacatagcctctttcctccatgcctaatctagaggaaaaaaaaaaaaaaaaaaaaaacaacaaaaccatgagtcagaggagaaaggatattacccaggttctcaatattccaggaagaaagttttgtaaatcctgccagctcttaaccagagccactctgataattacctccatctcacatttgctgttcgtggaactcctctggaccctatttcaagaggatggacattaagttcaagaagacataaaattaaaagcagatgctttgtgtgccggggtcgtgtctgggtctggaaatgtaaacagggacagcaggttttcatattcacaggcaaatcccagggcattctttaaaatgacacatttcaaaaatatataaatatttccattggtccacggataccaaaccaaggtttgtcaactcagtgagtgtaaaaccttctctaagtggaaatgtctccaagaagaataggttcattatggttggcaagaagttggtgaggcctgtatactctctccttcatttcctagaatatggtgtaaaggataaagaaaacaagaagatgacaggaaacagactgaggggaaaaggggggagggagggtaaagggagaataagaaaaattagcataaaagagaacttcaaaaatagattagcacaattttaaagtctatcttaaaacctattggggcattctagggtgggttttggacgaataatagggttattttgatgattttgtaaactatgaatataatactaaagctgctaaaataaaagctgaaatttcttatatacgctatgctgcttgatcctggatgtgtctcgagatcacttaaagaaccaaaaaccaagttcaggaccagcaagatggctcagtggataagtacacatgctgtcaaggttgatggcctgagtctggtctatgaaacttacatgatggatgtaaaaaccaccaacttgtcctcgaatcttcacacatactccctgatacaagcatacccatttacatgtaagcaatgataaaagacaaaggatcaattcccagagctgctcatctccacaactttgctttcagtgaatcttaaacaagacttacaaatcagtgtgagtgtgattgtgtgtgattatgtgtggtgtgtgtgtgtgtgtgtgtgtgtgtgtgtgtgtgtgttcctaagatccacacatattctgatgtgctattttcattgcaaatagctgctgtggacacctcataaagacacacataaaatgtcaataaaggaatgaacacatatctctctacttataatgaatatggcaacttcctagatccaattgagacctacaactacacatactggttttttggtggggaaaaagcccattcccaactataaacccaatatgtgacctataggagaccatggaaacataataaacacagtaaatttaaccacgacttcatgagtttctccactattaacagtgacaaaggcaagaggaccacagcatctgctgttctcaggaactaggaggatgacatcacgccatttgacatttcccttggatcttgctgctcctatctgcacaggcacatactagcatctggaaggttacttcatttgggtttaattcaccagggaattaaaagtgtccaatgagaatatcttagttgattctgcggtatctgtgaatactgtgatatacggtaactgtgataatcccaaaggaagatgccttcattgtccacttggaatacgtctttgccttaaggttattttcaaatatccactaagttccaccattccagaagaaaaagggttttaaaaccttagcatttctgttcttatagcaccaagttaaccatttggaaaagctggacttgcaaaaatcctaaaagcctctgacgcatttgtttttagatatgcaaaagaaaacttgctccaaattaattttcaaatgaaatgccagagagttgggggaaatgtactcagtgggccaagaaaacaaaactgagtggctaggatgtgagtcttgcctctctttcatcgggtttcactttagctaaggtcaggcctgcaaacgtagataaacaaacaacaggactcacatttaaacacagtacattcctgacatggcctctcagcattgggggtggggtggggagtgggtgagccttctcagtacctccctacctcatggaaaagccagctgctcctcatctcttggggagcaggatatgaagaacactggtgacttgtaattaaagcgaagaaattccatccagatggaatcacaaagggaaatgacagagacacaaaagaaatgaagaaattaaaagaaaattaaacccttaaagacccgaagtgaccctagattacaaggaaaaaaaaaccagaatggacctgaaagaattgtcctgttgatgggaaagtcacatcaacagaaattctgagaataaaatgaccaagttggtaagaaaaggacagacagttaccaaagaatatagcaatggagcaattcagcctgggaagtggagtggagttctgtaatccatcactggctctcttccttcagcactaggagctgtgacagaagtttcagtataccaaatcatcttaagaaatgtaaagttgaccccatcgaatccttcttttaattttcttcatgaagaagagacaatgtctttttttttaactgtgtttctaaactgtctaagaggaaacacaaaagatgacatttcattggctatccatacaccagagcttgggacaaggctcagagggttaagagagcttgctatctatgtatcaaaagatggcctagtcggccatcactgcaaagagaggcccactggacttgcaaactttatatgccccagtacaggggaaccccagggccaaaaagggggagtgggtgggttggggggtgggtatggcggacttttgggatagcattgaaaatgtaaaaaaaaattcagattaaaaaaaaaaagaagaaagaaaagttttgtaaaaagagagagagagagagagagagagagcttgctatccaaacatgaggacctgagctcaagtcttcaatacctgtgtgaggagccaagcacagcagatcatacctgcaactgcagcatggttgggacacaagggaatcccaggtgcaaggccagtgagccaagccaaaaacggtgactgtccatttcagtgagaggctccatctcatgtcaataaggtaggcagcaaatgaggacgatatcagcgccctcctctgacttctgtatgtgaatgacacactcacatgcttctctctctctgtccctctctctctctctctctctctctctctctctctctatctgtccctctctctctctctctctctctctctctctcacacacacacacacacacacacacacacacacacatatgcaatgaatgagagttacaggtaaatagttcagcttccctaagtattgtggttcagtcaagagtgtcatttccaatagtcataagagctatgagttgaatgtgtcttgagaagtatagagtgtgcatgagacaaaacagtgatttgggatataaaagagaaaaaatatatacccaggacatttatccttaattctgtgccaaagttgccaaagattgccctctgtaaagtaacagagatatctgagcctattagctaaaacctcagcccttatgttaccctgcaagacccaagtccctgctcccaaactgatttgggaatcgctgggtcagtttatagcgatataattctattttttttatttattaggtattttcttcatttacatctccaatgctatcccaaaagtctcccacaccctcccctcccccactcccctacctacctactcccacttcttggccctggcgttcccctgtactgaggcatataaagtttgcgagactaatgggcatctctttccaatgatggctgacgaggccatcttctgatacatatgcagctagagacacgagctccatggggtactggttagttcatattgttgttccacctatagggttgcagacccctttagctccttgggtactttctctagctcctccattttaatattctggaatcttaatgcattcacattgaaagagtataaagactttctatttgttgccagaagctcgggcgttagagcatcttattaatgattttggttctgagaggcctagaaacatggaaatcatgaccttagagttaaagaacctccattggccttcactaccataagcatgtggcttcaggaataatagttgttgagaattaaggacttgtaccaactgctctgagcacctggcagttactaccctgtggtttaaagagcagctccatgaattatatagtaaccatattatagatgtcaacatggaagtgcacagaggtcagaagtgcatcaatgaaggagaatccagggttttgctctttcctgtgcccttgacttctgtgtcatgccattgttcagcattatttaatttctctgtgtgggtctatgtttgctaatatgtgaaaatggaaggattgtggtaaagattacatcatacacacagtgatctaaatgtttaaaagatactattcttaagggatgtccaatggcagaccagacctctctactttaaacagagaaaaaaaaaaaaagacaatgtatgaaagtttgaaaactggcaatgccaacaagaggagcacagagttcagaactagcttatgcctggtgagtttctagaatgcagtatagaaagaaaaaaaaaagagtccacatagccagaggtcatcagaggtcactctgaagacaggaaacaagagtttggaagtcaagaaccaatgagtatgaataaagcctgggcagagaaaacgcttaataggctttgtaacttggagaatggaattgagggaagagaaatttaattgaaagggaaggaagcaaagttggtcaggaccaatttccaagcctctttaccagacactgacaggtctgtatgatgcctagaagcctgcatctttacaaaaacacccacgaggaataagtcttggtgatcctagggaaacataggtgaagaagctataaaaacaggaccataagccctgccccaggttaagctagctatgatgaattgcaatggactaaacactggatattagaaactactggccttcaagttaatgataaacaaacggctggctttataatacttaagctacattactcaaaatactgatagtagtaagcacatatgtatgtcagtgctgaccactattattattcatgtattgctggaaattttgaagttttacatgtattattcagtgtaatgccaggaaacactgaaggctgaaccagaagaaaaaaatcaagaattaaaagttattctctttttttttgacatcttattcattagagtgtttatatttgttttcatttttaagtatcatattgaagcatcatcccttaaggaatttgttttatttggggtgcttaactctagggccacacacagttatctgaagtcccaactctgtgtaaaaatgtagggaagaattgtgttctatgatgccataggtcattaaggaaacactgaagagaagccggggtagccagccatttgaaagaaagggagagatgaacacacaaagaaaaagtgccatttcatcatttgtatcatttctgacatcttctatcaaatacacagctttcctaagctcttccaaaaagaattcatttgaccaaaatattatttgcacaaccctttataaaaatggaaaatatttagtcttcagaaatgtatagtagtggggtacctcccatagtgcatagctaatgacaggtactgatctcagatcaaataggacttaattcaatgatcctgggtaacaagtcttattttacttttcttttatagataagatgatagaagtatttagactagaggctccaagactttcaaagaggcatggacagcatgggggtgggggtaaattgaggctttcacgtcctaagattcactcaataactttccacctccgaagtcaataagaatagacccagaatcataaaacttgacccaatagcaaagtcatccaagggtccttcttagggtttcatatccccaaggctaattaatcactgttcctctattaactagtatcacaagtcagcaggtggacttgccaagagctggtgttcctgcagaaatattcaggaatataaaggatagcctcagtgtctcatagtgaaattcactgccaactgtagaaaaagaaaatcaacaaatgctcaataggcaactgtgagtatgtgagcgtgggatgcaccccctccccacgcacatacacaacatgctcatccctcatgcaggtgagaattcatttctatattcaccacatttgcatgaaaaagaaagatacagaaaatatttaggcacgtaccccctctccacattagcatacctctacagtcatgaaggcctttgacagcatatcatttggaaaatgctattgttgttgaaaactttatgagcatgtcctgttttaatgctaactaattcctgcttgcacataatcttctccatgtggtatttacacaagatacagagaaaatacatgataaaaatagttctctatgaaatcctccacagactataaacagtttctgggttttggcagaatgactttattatttacacactcagacaaatataggtcatactcttctcatattattaatgttcctctgcagatactgacacactgagcaaatacatcagcaggtcgcctttctatgtcctaattaaattctaggcaaattgctggcgtatagtatgtttggttctggttcatcattaatgcaccttgataatattgaagtctggcatcttgtcttgccttatgttcaaaacagatgcagctggaagtgagctagttctaacacccagctcaaaaagatctcaggattggaatatgcactgtctaacagttcataaaccccaaatcacatcaagtaaccttcagtgatagtaatagatagcgggtggcaaatgacggaagaaagatgctcagtgattgacaagagaagagttgtttctcccagttcagaacagaatcccatatttagatttctttagacaaatgaagcatcatgttgatgacacaacatttcaactcttctcttatccatgcagcacattctgtataacccctggcatttagtgtcaacaatttgtctactaatagcaaccagacaaagattctctataatggacaaagaaacatttatgcatctcacccactgccttaaacatttctctcttctttttttcttttcttttattggatattttctttatttacatttcaaatgttatccccttttccagtttctcctccagaaacactctatcccatctcccccctccctgcttctatgaaggttctccctcacccactcacccactcctgtctaccagccctggcattctcctacactggggcatcaagccttcacagaaccaggggactttcctcccattgatgcctgacaatgccatcctctgctccgtatgcagctggagccatgggtcattccatgtgtattctttggttggtggtttaggccctgggagctctggggggggggtgtctaattggttaatggtattgttcttcctatggggttgcaaaccccttgagcctcttcagtccgttctaacccctccattggagacgccatgctcagtccagtggttggctgtgagcattcacctctgtatttgtcaggctctggcagagctttacaggagacagctatattaggctcctgtcagcaagcacttgctggcatctacaatagtgtctgggtttggtgactgtatatgggatggatccccaggtgggacattctctggatggcctttccttcagtctctgctccacactttgtctccatatttcctcccatgagtattttgttcccccttctaagaaggactgaagcatccacactttggtcttcttcttgagcttcatgtggtctatgaattctatcttgggtattcctagctttgggggtaatatccacttatcagtgagcgcataccatgtgtgttctttgtgattgagttacctcactcaggatattttcaagttccacccatttgcctaagaatttcatgaagttacagtttttaatagctgagtagtactgcattgtacaaatgtatcacattttctgtatctatttctctgttgaaagacatctaggttcctcccagtttctggctattataaataaggctgctatgaacatagtggacacatgtaacactgaggtatcacctcacaccagtcagaatggctaagatcaaaaactcaggtaacagcagatgttggcaaggacgtggagaaagaacactcctccattgctggtgggattgcaagctggtacaaccactctggaaatcagcctggcagttcctcaaaattttagacaaaggactacctgagaacccagctataccactcctgggccttaaaaatttctaaaatacaggtatcctctgaggcctataataagtggaattatgatgttctctctctctctctctctctctctctctctctctctctctctctctctgtgtgtgtgcgtgtggatgcctgtgtgtgtgtgtgtgtgtgtgtgtgtgtgtgtgtgtgtgtgggtgtgtgtgtgtgcgtgcgtgtgtgtgcatgtggatgtgtgtgtgtgtgggtgtgtgtgtgtgtgtgtgtgtgtgtgtgtgtgtgtgtgaatacattactttacttggtaaagggagattattagatgtggttgacttcagctgtctattcaatcacatgaagacctgggtttattcattagacccccaactaatcacatggtactaaaatagaacttttcccaactaatattaatatcagaggaaaggtccaaaaggcccaaggctgttatctttgaaaaatggaagcatccatgagccaaggaatgctggccctctccagaaactggaaggaaaggaaaaccatcattccttagaagttccaaatagaaatctagacagctcagcatctggataccagtccagtaaatttccaacctgcagttagttgtcgttttttgagtgctgacatgtcagatagcttgttctagcagtaataaggaattaatccaaagtagtttcaagttagtcagtaactcagctttgcagggtatataaatgtttctccaagcatcattcccaccgaaggagaggcacgctcttctcttaatgcagaaccattgctattggacctaaagggtccattcatcattgcattttaggaaatgaagtaaaatattcttaggtgccataaccaaatctacaaaagtcaagttccaacaatatctcatatgtctcaaggatgaggggaacctgcaatttcctaacaataaagccctctggattcctggaaatctaggttaattactgggtaatgcaaggagaaggtgcagtgtgggagaaaaagaaatgaacaagacttgcttctcaggcgatttcttagggcaccaaggtttattacatacccgggagaccataggttaacacatatttgttccttaaacagatattgacagtgtttctataatactccagacattgtgttatgtgctggagacacaacagagaacttgacagacagtgccatatcacagaagctgacacttagagagcttctactgaatgaggtaagtcaacagattagtgagaagttgcctcctatttcctagtaactcaggcaacgtgtgttctccctagtacatgaagaagttgcttgggtgtatatactggctagtgttatgttaacttgacataagatgaagtcatctgagagaagggaaccccaattaaaaaaaaaaacactatctcactaagatcagggtataagcaagcctgtagggcattcttaattagtgattgatgggggagggcctggcccaatgtgggcaatgtcacccatgagctggtggttctgggttctataagaaaataggcagagcaagtcatgagaagcaagataataagcagcattcctccatgacccctgcatcatctcctgcctctaggttcctgccctacatgaattcctgccctcactattatatgggagtgtaatttaaataaaccctttcttccccaaatatcttttaccatggtgtttcatcatagaaatattaatgctaactaaaacaccatgggaactgactttatctttgtcatgatttggatagttttgcctctaaaaacaatcctatatctaaacttggtttctaatataatagtgtgagaaggtagggacccaggcaatctaaattattcaagaaggccacatctaaccacataatgttaaaataaaggatcctcaccaactaagatcagaatcagagaggaggatgcgactactgtatcctctcataaaagccctttctatcaacatccttccatcttacagacttgattcatcctcttgggaccagcttattctttgaaaagcagatggctatgcaggaccacattctcttccatcatccatcataagctgaagcaccatgagccctcaccagaagccaagaagatgccagagtggcgttcttggacttcatgaagaatgcacccaaatattctttttttttccttcataagttactcagtctcagttattctatttagcaacctttctggctgcctacaactttgcatttgaaaccatccctccaaaagaatagaatctcagaaactacagctttttgttttctctgctctgcaaaacaccatctttgtgcacaagctgaacagagccctttacatacgcgtcctcaaatattagtttacggaagaatcacccagagtgtttgtttaaaatacaagttcttggtctctcatcaagacactacattacaaggagcataacaggatatccaggaacctgaatgttaaacaaatctctcggatgaaatctgctgagacagctgcagatgacactgccagcactgttccaacttctaaatgttttgtgtaaataaaatgaagaatattgctacattttaaaaagcacttctaatttttttctgaaaaagaattaaattgtaatttgtgctgaaggaaacaaaaatatacacaaccagagtagaggtgggaagaatgaaacttcaaggtcaccttctactatgtagggaattcaaggccaactagtgctatatgaggccttttttcaaatacattcattcatatatacatacatacatacacatatatacatatatgtatatatgaatatatagaaaaataataaattactttacattttttaataaaaattaaccctagtaacttatcatgggtattgtccaatcatttttctattagtaacctatcatgggtattgtccaatcatttttctatataaactaatatttgaaatcacacttacattaaaatgtgagtcctgccaatttcaaataaacattatgaacaatttcccatgcaacaatatctcttaatagtcttaatcatacatattttcaaattttgttcttcttattattaacaaagaaattgcttactattgtatcttcctgttgtttaaatatgtttctccacaaacctcatcaacttctgtatattcaactgtcgatgggctggctcatttcatctttatatgagttcaaacaactgttaaatggattctctttaattttctaaataatatgaagtattgacaattgtgtttcctctgttcaaatatttatagctcattggttttttttatatcattgcacttgttataatttttaaatcaatactaaataataaaacagattctactgcttcattcataaatttaatgatgtttgctcttcatttcatcattaagcataatgttgatttacactaataattttagcatggtgaggcagtgttcccttgtggaaagcaactaagatttcgatttttgttgaagacacgactgtatattataaaagaaaatttccacatctgctatgcaataatatttttatcatcttggatttgtacattaattacttattaatgataagctattcttacattttaaaaacagacacaattgctaattgatttgctctttaaacatatttctggcaactatgtgctaggataaaatttaatgataattttcaaatttcaatgagttctattttaaaatttagaatcttaacactaatactatgaagtgacagtgagtgtgggtgttctctccacatctttgtaagtacctactgggtttatgaaccttttcaaactagcccactggaaaacacaaaagaaggaggcagtcatgttattcaagttccttttcattatacaggcttatctttttggggtttattaaaaccccaaaagtacctacattaaaaaaaaacaaaaaacttttgagtcaggtgtctccaagaatgtctttgtgttgttacacacttgaacagtttaatgtctaaggatgagagtttaaaatcatgtcttagcctctaagtttaaagagtatttctttgtccttagtagccaataagatataactgattaataacttactaataactctctatatgtttatgtgctttcttctaaattttaaaataagtttcaggttgatctaggtgatgtgcttttcttgtttttcattttgcccaaatttgaatttgattttcttttttttaagtgctgaacccagggcactgtgactgtcatggtctacgagctgcagatagactctcgggtaactatgattagctgtgcccacaagcacaacacactagtgttcatctgaaaagctagtaactctcctctttgtatattactacttgtctatcgcttgtctctgatagttctaagttacatgtcctggatagttctctattatttttttctttttcacttttgtctcttaacaatgagcacttaaatgtttttttttttttttatgagttttgtgaaaacaatttctctgatacccagaagtaatcatcaatgttggagctcacctagatgttttcaggcttgttgttcatgtttgatatgacacatggtgattaaatagtgatacaggtttgttgctttaagtgactggccctacaagttacatgtttcagatctcatgcacacacacacacacatgcacgcacgcacacacactttcatttataacacctataccatataagctccatagcaggaactagaagtatacaactcaggatttttactaatattgtgtattgcttgttgtgcttcctgatcattccacaggtcaactgtccaaagccttgctactctaaaggaagagccaaccagcctgtgaatcaccaaaggcaaagcaaaaaagaaaaacaggaaaagcaaaacaaaacaaaagtctggaaagtttcctgatactaccagttcaggctttctcttctgagccaagcaattattcgaaactgattgcacgaaaagttccagttttcagaggaaagggggtttcccttttcaccatgaccttttgttaaattggagtttggaatcagaaacacatagaataaacagtctcaccgctcctcatttgagaacaccatcatacttattaaagttgctacacagggcatgaaaggtgccacaattggtaaagcatttaacttgtaaacattaggacctgagtccaatcacaagaacacatgttaaaagacaagtattgtggtatgcagttttcatctcacaaataccacaaaagaagacagggatgaggctagaactcattggttggccaacgtagcctacttaggaaaatttcaggccagtgagatattctgtctcaaagcattgaacatgtctggagagagatagcagaggctgtcctctgatctccacgtacatgcacacacaggtacacacaggcacaaacagaacaactacaatacaaaaaaatgttaggaagatcaacaacaagagaaagagatgagagaggaagaaaggaaggaatgaatgaaggaaatatgggtgggtgggagagaggaagaggaaaacaggggaggggagacagagagagagaatcaagtttaattttagatggcatgtatttcagaaaatagatattaagatgcataagggtatctcgtaagtataactccaaatgtgatttcaccctaaagcagagctttgaaatacacaagaaaactgaaagctacaagaattatgaaaatacatggcaagatacttcccaatccttctgaatgaataagccataaaacaaggaaattaaaaagtcagtggaggccagcccaccaccaactaacttgctcaaattaacttttgtaggcttcaccactctaaaaagaagaatatacattactttctagtcaccaagagcaaccatactgatcaactgtattctaaacatgaaaagaaaaatgagaaaaaataactgaatcaatataatataaaatataatttacaaatttatgactataataaaataaaacataatgcagagggtaggttatagataaagatagatgatagataggtacatacatacatacttacatacatacatatgcatacatacatacatacatacatacattgatggatggatagatggatagatagacaaacagaccggtagatgtaataatagagaaaaaaggagaagaagaaaaggagaaggagaaggagaaggagaaggagaaggagaaggagaaggggggggaagaaagaagaagaagaagaagaagaagaagaagaagaagaagaagaagaagaagaagaagaaggagaggagagagagagggaggaggaggaggaggaggaagaagaacaagaacaagaagaggaacaagaacaaggacaagaacaacaagaagaagaagaacaagaagaagaagaacaagaacaaggacaagaacaagaagaagaagaacaagaagagaagaacaagaagaagaacaagaagaacaagaagaagaacaagaagaagaagaacaagaagaagaagaagaagaagaagaagaagaagaacaacaacaacaacaacaagaagaacaagaacaagaacaagaacaagaacaagaagaagaagaagaagaagaagaagaagaagaagaagaagaagaacaacaacaacaacaacaacaacaacaagaacaaggacaaggacaaggacaagaagaacaagaacaagaagaagaacaagaacaaggacaagaacaagaagaacaagaagaagaacaagaacaagaacaagaacaagaacaagaacaagaacaagaacaagaacaagaacaagaacaagaacaagaacaagaacaagaacaagaacaacaagaacaagaagaacaacaagaacaagaagaacaagaagaagaacaagaagaagaacaagaacaagaagaacaagaacaagaagaagaacaagaacaagaacaagaacaagaacaagaacaagaacaagaacaagaacaagaacaagaacaagaacaagaacaagaacaagaacaagaaagaacaagaagaagccatgaataattggaatgaaaacatggaagagtatcatggagggtttggagggagaaaaaggaagggagaatgctgtgattaaattataatctcaaaaaaccaaacaaagcaaaacgaaaaaataggaaccagtcaaagtgagaggaaaatgggaaaatcatcataaaaaaggagtgttacaagggctaccttatcacgagtcactccctaagctgttaaaatgacttcacttttcctctccttggaaatatgatggttcagaaacactttcagaacaaaacaccagctccgcggcctaggtgcaaagtctttgtgatcttgtttcttttatttcttttattttttattagatattttctttatatacatttcaaatttcaaatgctatgccgaaagttccctatacccttccccctgccctgctcccctacccacccactcccacttcttggccctggcgttcccctgtactggggcatataaagtttgcaagacaaggggcctttcttcccagatcttatttctttttgagctgagtcttcattacattcctcatccctgttctcaaacctgtggtgactcaactgtcctgcccaactttacttctctaaccttccctgacttcactttgatctcacctgtctttctgagtccaaccccagtacagtatcatttgggatttaacaacatttgtttatttagtaatctttagaagtccaccatgttcttggaatcaaggtctattcccggaaggatcatgttcaaagtgatttctctttccatggaaacccaatagtaactttaacctattcaacagttttttattttttgttttgttgttgttgttgtttggtttttggtttttgttgttgttgttgttgctgctgtttttggttttgttttgtttttttttgtttttgtttttttggggttttgttttgttttgttttttgtttttcaagacaagatttctctgtaaagccctggctgtcctggaactcactttgtagaccatgctggcctccaactcagaaatccgcctgcctctgcctcctgagtgctggaattaaaggcgtgtgccactatgctcgacttctattcaacagttttaactcctcaaatacaacaagtccctcctggctctttatacttgctgtctctctcctggaaggctctttgccccaaaatcatagaatcacctccttacctctcatttcttaactaatggaaaccttccaaaggggatttctgtgcctattatttaaaactgtagcttcttttctagtttgtatcttattttttactaatacttaccatatgccatggaaatatatatacatacatacatatatgcatacatacatgcaaacatatatacaaatatgtatgtacatttacaaaacacataaatatatacatagatttatatgttgtaaacccctctataaaattgtctttctgcttttttcattgacatatgtctattgctcagaacaaagcctatgactgagcagatgaaaggtttggttttatgtgatacctgagctaagccacagcaaccagatattaagccaatcattagtataagtgtcactgtaaaggtgtttctttttagatgagactgatatttaagtcagtattatgtatgtatgcatgtatgtatgtatgtatgtatgcatgcatgtgtatatgtatgtatgtatgcatgtatgtatgtatgtattcattttaatgaagcagatgatgccctgacagtatgagcaagtctcattcatttaagtgaagatctcgtatgagcaaatctcattcatttaagtgaagatctcatagatttctccaaataaggaaagggggaaactctggactcagtttgccttcaggttccattcacgtcaagtctgtagcaccagcttgcctctttcagacctgctagtcctcaaaatatttactgttgtatgtgtagagagcgagaatgagagagaggaggagacctgatttgcttcctttctttggggaaactcacaccagcccaacaggaactcggcaatcccttgctgaatgaggacctccgactttccctttagttgtttagagctcccattccttccaccttttgtttgttgaatgactcacactgcctcattcctactttcactgtctttgtgttgatttgcatctgagaaggaggcactgggtggggccacattgcaaacaaactttaagcaaacggacttcttggacttcttcacttgcgctcttcctcactccccaatcactgggttcattcaactaacctttcaaatatgtcatctgctatctatgagaaaccattcagaaaatattcattgaatgtttgctatgcaccaagaactggattatggttgtcaaataaacacatgggcttccaaaaagaaagcattatataaagagaagctttaagcgattgtaagaatcatagtaatattaaacttgttaaagatactgtatggtaatagccttgcaagactttaaaaatgtagagcttagttgcttggtgtggtagtttgaagaatggcctctgtgtgctcatatatttgaatgcttagctatcaggaaaaagaggattacttgagaaggattaggatgcaaggtctttttggagtagggtggccttgttggaagaagtgtgccactggtgggttggctttgtggtttcaaaagaccaagtcaggactagtagccttctgtcttcctgttgcctacagatgcggatgtagaactctcagttccttctccaggaccatgttagcctgtgtgctgccatgcttgcgaccataatgataatggactaaccctctgaaaacataagccagccacaattaaatgctttcttttttaagagttgccatggtcatgctgtctcttcacggcaatagaacagtggatctctgaaatgtactcaccactcagcctaaggaatacaaacctggggtgaatagtacaggaaaaaaaaaaggcatattcatctgaaagcaaaaggtcaaataaatatgcatctagtggaaagcatataaatttgaatgtgagtgcagcaggttgagggtaataaagaaaggacatggcaaagattttccaggcaatatcatgttcacccctcctccctagttttcatcattcatcaaaggcgatcagtccagggtccatgtcagcactcgcaagctgaagctttatgtatgaggtgagaagtattcttcttggctcctgctctgcgctgacgtgatttataaggataacagagatggacagattgaagcggtcttgtccagccagccttcctcactgtgtattgctcctgtggcctaacaggtttcccatcagatgtgtgagagcataaccttggatgctccaacagctaaaaggtcaacacggattcgagtacctcttggtcatgtgtgggtgcatgtgaaccccttcactttagcacagaatttaaagccatagagaggtgagtttccatctcttggttcttgtcagcctgggtctgaatcataaattatgcttttccactttacagtcagaaaaaaaaaatcttctcttcctcaacgataataaaaatcagtggaccagattctgcccttcgttactaatatacaaatcctgctgaagtcagcaaaacttacgggcatgcaactttgggcagaccatgttaaaactttctttcttttcttttttctttcttattttattttattttgctggatttttattacctgacatctttctgattcctctggattgcacaataagagaagggtggcccagtttgggtaaaataaaaaatgacccaaaccactgacctaaatcctgcctttgaaatttaaaattacatttactaggaaggaaaatagttttttgagtgtgggtggttttctttttcaaaaccatttcaaatgttgacctcctgaatgttatcataccagtttggattggaaaacagaagggtaggtaaacatttttttaaagcatggctggaggacgccatccttttctgcattcattatctgctaagaagaaggaaataccaagaacttacttttttttcccccaaaagatattctggctacattgccaaatttaactttaaaagtaaattctctacttttacaacatattgaaacgtttcttcctatcttctccaatcatgtgaactgagccgttgaagaagcagaggtgggggtggggggtgctttcatagaggttggatacagttataagcctaggttcccctttacacaagcagatgctctgggtaccaatgtcacaaagaacacagtctataggcttagatttaataagtgttcagagatattttccacagttcttcacatgttcttcagatgtgccagaggttcctgtgtaagtacttgtcagtcttttctcatgaaacccagaatgtgatccacatggcctggccctttctttaatgctgacatcatgtgatgtagagcccatgagtttattcgggccatcttttctgatttaccatctctaggagagctctataaaatacctagactatgtgactccagcctacagtagcccttctaccaattcttcgtgtttcctatatgaaagaagaggcttggccaaatggaaataaaccaagcaaatgttgatgagcaaggaacaagggatgaaatcgttgagacccagctcttgagacactagcctccagttagttactctatgtgttttcaatgcctttgccagtctgtatattatataaatgaatctccccaggtatcaccactatgtacatcatagctggtctttgacctttactgatcttcaaattgaaaacttttctcagcttttactagaacctagctcaagacctgagaacacggaagaccatacaacagagccttacttaagtcctgggcttttgttttgagtatgacttataaaatatgactttgcataaactattgcacccccatctcaagcttaatacattaaacagacattaatttttatccttcaaatatttttctgggcatcaagccagctatgcctttacatccagccttttcacagagcttgacacctagttgtattcaatagacctcatgatcactggagtgtcacatttgaaaagtttgctgaataagtggatcaacaaatgaagaatcaagaaagaacaatagggggtgtgtaggtatttggtctaatgaagatattttaaagaattggggtgggtagcagctaaagagtgtaggaagcaacatcaacttgttttcaccacatttaaaaaatgcactgcatgcggtgggccaagctaacaaaactcttcaaacagctggaaagtggcaagcttttggaggacaggcactgtcgttgatcagccgcgtttgagaaagcttgaccttccttcagcctctgtttctaagtagaactatgtattggccctcctaaactcttacaaaatgcattgtgtgacccagacagcctgttccctttctttcatgctgacaacctgtgacatagaacccctgactttatttagatcatagtgtggcccattctacatcataaactataacattcactgaaaacttagcacacataatgtgcactttaacctgtgtcagtttactttatctccacaattctacaatgtaaatatttcctttgaggaaattatcaccatcataatcattttacagatgaggaagatgagatgtacggtgaccaagatatttgaatctaggcaagcagacttcaaaggtgctaacatctactctatatatcctactagaaacaccatctctgcctgcctgtcacaggcaccattgtagcagtatttgcatattacattatagctgagtaaattgtgtttattagaagaaatatgactgtaaacccagagaggacatgaaatttgttaggcaaaacaatggcaccctataggcaaattctacttgaacacaaatttgctaatgccttatatgccaacctgagaatgcaggatacaacactggctatgtgttcaacatttcatccccaaagaaactgtggccagtcatgaagtactcagtcacaattcactggatagagtggaatgcgtctaagggcctctccccactttctaaatttcttgccaacagggcagaagataacaactggacaatcgtgaggtatacacaaagttccctaaaaccgcttggcaaaactttcaaagttctggcaatgcctctctcatgagaaactttgcctagaattaaattgagcattgtaatcacagtgagaaaggacagtaattatcagagacactaaacaacatgggacatcctgtcttcctttcaatttatgttctgggtccaggcccaagcacctgtgtacctgaaggtctttccaatgcttttatagccaagtcactcccctcgggaactgaattcatacttctttatgactgtgcatgagcacttaagattatttccaactttactttgttatccttgggtcgattatttctagatgtcctaacattcagcagcagaagctgttatccatgttctgaccctgtacaatagaaagattcattaccttccagctagctgagattacacaaaagcaagttgcaattgtacaccatcttgcatccaaatgaaatgttagttctgtctgaggataggtggattgggttgcctatttattaaaattcagaaaatagtccagggactttagacagctcaactttgttgctttccagaatcctttctgttgtaaattgcctaccactttagctagagcagctacagcgagccacagagaagttcccaatatccttaagatgagaaggcagagaaaatataggcagcataatgtatgctcttaattgtatcttgggccttgtatctctaatgctggctctgtagactcatccatcccctcttccttctgtaacctagttgagattgtagcctgagaggtgaagagtgtccccagctgcaaggggagaaattcagtaagatcaccaaatatgttagaaagagaactcacacttatccctaagcttcaacaattctgctccatctccaacacgtggtggatgatcatgaaaaacctccctacactgtagtctctcttacagctctgagatggatcctgatagtagctagtcaataaggaaagccaaattctgctacaaaagataacactgtgcctgaagccatcatactgatctggatgattgaaatatccacccctgctgtgccatttttgtctacccagattttcttttattcaaacagaggagggtggattcataaatctctagcttgtagaccatacaaaggaattttcttttttctcccccattgtaaaataaaaaattattgcaatcatttagtgagggaggaataatgtgtgatacagatttggatgtttgagaaagttccagaatgataactggaatatgagggaagggagaggagaatattggtcatagtgcagaggtaagcaggagcgttcatgtcagtcaaaaggagaagagaaagaaagaaagaaagaaagaaagaaagaaagaaagaaagaaagaaagaaagaaagaaaggaaggaagaaagaaagaaagagaaagaaagagagagagagaaagagggagggagggaaggaggaagggaggaagggaggaaggaagggagagaacaagaaaaagaaaatttttaaaaagatggggctcagtgggtaagcatattgatgttggaaacttttagatgtttagttttattttgtgcagggaggcaaagaaagaaagaaagaaagaaagaaagaaagaaagaaagaaagaaagaaagaaagaaagaaagaaagaaagaaagaaagagagagagaaagagggagggagggaaggaggaagggaggaaggaagggaggaaggaagggagagaacaagaaaaagaaaattttttaaaagatggggctcagtgggtaagcatattgatgttggaaacttttagatgtttagttttattttgtgcagggaggctacagaatctctcactggagaggtcacatggagaaagtatggcaagcagtggaggggtaaatagcacaactattcaaggacagtatttttgatggagaaatgtcctgtccaaaggatctgaggcaggagaaagtcaagaatcctgggggatggggaggcctacagtgagtagaatgatatggggatgattttaataggcgtggggtgaaagaagcctaaaactacatgcaatggggacatggatttcatagaggtcctttggttttaatggaaacagaaagcatttgtatagagggttagataatttctgacattctaagggggtctctccggttggttgaaatgaatactcaagagaagatattatggactagatgtccatggtatctccaaattcatatgctaaatgcctaaccctcatggccactgctgaaatctaggattttcagacgtaagaactgttttccccttttcaagtctcccctccggaaaccccctatcccatgccctctccccctgcctctatgagggtgctcccccacctgcccactcctgtcctcccaccctggcattaccctacactggggcattgaaccacctcaggcccaagggcctctcttcccactgatgtcagacaaggccatcttctgccacatatgtggccagtgccatggatcgctccatgtatactctttggttggtggtccaggacccaggagctccagggggtctggcctattgacaccgttgctccctccatggggctacaagccccctgagctccttcagtcccttctccaactcctccatcaaggactccagagatcagtccaatggtgggctgcgagcttctgcctctgtatttgtcaggctctggcagagcctctcaggagacagtcatatcaggcttccatcaataagtacttcctggcatccacaataacatctgggtttggtggctgtatatgggatggattcccaggtggggcagtctctggatggcctttccttcagtctctgttccacattttgtctccatatttcctcctgagagtattttgtttacccttctaaaaagcactgaagcatctacattttggtcttccttcttcttaggcttcataaattttatataatatatatatatatataattttgattaaggtttcaccacctgcaactcctcccagtttctcctctggtcacccattaatactcattctatctctcatttaaaaacaaaaaggcattaaagaataatgacaaaataaaataagattttttaaaaggcagaataggattaactaaactaacagaagaaaaggaaccaaagaaaaagcaggagaaaacttattgacaggagacacccatgttgcacatacacacaggaatcccttaaaaacacaaaactggaagctataatagatagaaagaagacaggtaggctttaaaagagctgccccaacacattctgagcccaggaacctcaaaggcaccatggcgttcattttgtttagctgtctcctgttgcccatggggcaggcccttaagagtggtttgtatcactagtaagactcccttgaagaaaactaatttttcatttgcaagtggcaactaattggagatatctttgggtttaggggtggtgatgtgtgtactcttctctctcggctttacggctccatctggggcatctcatacaagccttgtgcatgctgccgcagtcggtatgagtccgtacattggttgtgctgtttggaaagaccttctttcctccatcccctctggctcttacagtttttccagagttccttgagcactgaggggagagactggatggagacctcccatttagggttcagtgtcccccactctttgcatattgtctgcctgttatcaattggagattgattcctgggttagggatgaggcttgggtctgcttctcttctcaggacctggatgccatcagggtcagatccgtgtagactctgtgtacattatcatagcctttgtaagttcatacatgcatcagccctactgtgtatggaaggcattgtttccttggcatcctctatcacctcaggctcttatcatctttttataatctgcctccttttccaaagagctccccaaggcctgaagagagagatttgatataaatatatcattagggccgagtgttccaaagtctcttgctctctgcacattctccaggtctgggtctctgtgtttgttcccatttgctacagaggaagcttctctgatgatggctgagcaaggaacagttacatgggtatagcaacatgccactaggagtcattttacttctatatactatagtataccgcagtaaattttattgctatacactgcagagcaatagtcttcagttttcccttaggtccctggcctatctagtctcaggttcttggccatatgagtaatgctgagtatgggttacatctcatggtatcaatcagatcagatcctggttggtcactcccacaagctctgggccagtgttgttctagcatatcttgcaggtaggtcaccactgtagctcaaagggttggtagctgggattggtgtttaccttttatcctttggaagcaaagttcctttcaacgatgtgaacattagtccatagtggggaaggctctatgtagacaccagctctacttctccatgttcagtgaattgtatgggtgttggtttcagtaatagggccatactatcagtttgcagagagcaaccaatagccttggcaatagcctgggttgtttgagggttctcataaaacccctttagccaataattcaatttttttaaaaaaaattgatctctttggtttgagtcacctagcctatatataaacccaaactatctaagataggaaagaataataggaggcccttttccttcatggcacactaaaaataattcctgatcataaatatctaccaattggttttaaatttcattcactcaactgtaagcttttaagactaggctctgggtcattttcattaaccactgtgtccaggtgctaatcctatacccagcaagccatgtatatgtaataaggctttgctaaatgagtaatttggtgaaattgggatatgattttaagactttatgttacatatatttgctcttaatgaaaaaaataatcttgttttcctcggtctgtgtatgtttgtttctactgagccttctgtggagtgattctgtggcacgctatattaccactttcctctcctacagcctctcatcccataatcactgtctgctgtaaatagcactctgctacacttgaatgcaaggaggattcctagtgtgctacttcaagacatcaataggagtcctaatgcttatattatataagaccaagacatttaagtagatctaaatccaaatatattttgtttctgagttctttttcatgagacaatttattaatcacatattagaagccaggtgttctctgttcaaaatataacttatgtctattttgggctagggctttaaccgttagatgatcatggttagatgatcatggtatgtgcccattttaacgtccctgggctgccttaacaaattaacgcaaagtgaatggcataagcagtggaggtcttttctctcacagctctagaactggaggtccaagagctaggctacagcagaactggcttctctcagggtctacaaggcctattccaggcttctgcctgggctgatggtagtttgattgaagtatttggtcttttgtggcttttagcatcactcagagccctgtattcacgttgaggtgcagaatttcctgtgagtctacctatgttctttggtcccttttttatgaggacaccaatgatgttgtctaggggtccgttttattccagcacaactttattttaacttgttagatctacaatgactgtgtcatagttttcgtatattgttgtgataaagatcccattggacacacaaactttatatgccccagtacaggggaatgccagggccaaaaaaaaaatgggaatgggtgggtagggaagtgggggggagggtatgggggacttttgggataacattggaaatgtaattgaggaaaatacgtaataaaagaaaatcccatgactaaaagcaaatgggattttatttagtttacactacagacttagggaagccagtctagaagctcaaggcaaaaacctggaggcaggaactgaatcaaagctacagaaaaatgttccttgctacctctacccctgccagtcccctctccctcaagcccccaccgcatggcttactcagcttgcttttgttttatactacccaggaccgcctgcctgtatcatcccctgtagactaggccttcttacatcaatcattaatcaaaagaatgtcccacagacttgctcactggccaatttaatgtagccattttctcagatgaagttcctcttcccagataactctaacttctctgaagctgacaagaaccaaaccaggacagactctattcccaaggtcatattctgtcgtacagagaggtgattgggtatttgctgtgtaaatcttagagtgacataattcatctcacagtgattcttaatcagggaataaacaatacgctcttctaaattgccttccccattttttagtccttaatcattgtctttgataaatgttggtgttgaagacttatgaaacaaatgcagctctgaattctacaactttggttttaaagcaccatggtacacagagaaagaacattgtgaaacctgatctgtctcatggatatgttcatatctatctaaggccggctttacagagactcactttattcacatacactccactgggtcaaattccgtaattactgatgtcataacctgtcccagaaaaagggagaatgggctagggttttctacattacaaaatgattccgcatagctcagtagtagagagctcgctcagcatgtgtaaggctctagaatcaattcctccaaaagacaaacacaaacaacacacgcacgcacgcacgcacgcacgcacgcacgcacgcacgcacaaggcgacgtcttccacctcttgacatcccttatggttacgattttatcacagagaagcttccctaatcccaggggctctctcaaaacagggcatctccttctgattctcagaagaatctcagaggttcttccagattgagacgagaaagattcttacaaggaacatggtactagaatgaggaactccggagtagcttctaacttggagaggaactcaactgccagccaggtcctccttccaaccaaccagaatgacggaagttctccctagagcctccacataagcaacccaaccttttgaagccctaagaagaaaactcaagctacttggccttctgccccaccccccaccccaccccccccacacacacaactatgagatagaaacacgtgtttaagccactatctgagtggtagtatgttacacagcaaaggtgagctaatactggaacagcaatgggatgaaaaaatagggaagaatggagtagagaaagaccctttcagagaaaaatcaaagaaatgtgtaagacagaagataggttcgtcaccattttctttatagatttctactggttcccagctaatctgtggtgatagcgaacctaccacgtggcacacagcactttccacaattcaaatgaaacatgacctgtcatactgagggaaacgctacatagaaaggaacgtggacaggaatgtgctttgttttgtacatacgagagttataaataaataaagagtacagagaccaaaagaaaagaaaatttgaaaaggaagatgaaggaagggggaaaggtagagaaaaaaaagaaagggtagaaagggcccagaaacagcaaggggaaatgcacgctttcttccaggagcacagaattccacacccaagccttgcctgatattttatatcatagaagatcacagcactataagacgtttttgatgttctccagggcaacagagaaactgccatttccagtcagtcttttcagcctttctaagcttggctggtccctggctgcttacacagcctttcacgccatcaaaggaagcaaaaactgcacagacatgacatttaaaaacggccttgacctcatgtaggtctttctaaatccaacaattatgaaaacacaaaatcacatctgttctaaagaggtaggtaggccaatagcaatgtcagacacttccaataaaagttagtacgtgaaaataaagtttattaggaaaacatcaattcgggattttcttgcagtaaggcaaagaaaaacaaaaaacaaaaatcagcctggtcaaatcctagcaagattttctttttcttgttgtatgcttagtgagtctattgctattttatcatatgtgggcatattttattccatgtttgattcttgctgacatggaccagaatacactgaaacaatcatgggccaacttggtgtagaatttatagtaaaaagcattcataaagcaactagccaattaaaacccatacacactctgaattgaggagcgtctgcacctagatctctttgatttgtctcacagaaccagttcctagtgagctattaaatactagaatgaagaatttaatactcaggacaaagttcagctggtagtaaaggctcccagtagtaagaagaaggcagctatccacctagcatcttctgttctgggatctaaggtaacatcagtgctggtcctttactgggataagcaacattatttgtaaaactccctcaactcattggtgaaaggaaatcttttccccacagagcgcagagacctctaatcaaagtgtgctttcggtggctcctctgacagtgcttaggaaactctacacggtgattgccactatttcttacattgatgacgattgtataattgtctgttttctgtcttgtggccttgggaggactattaaagtgacagctgatgactagccaaaccccaagattgtagagtggcccatagagctgtttatgccaatcttcaggaggaaaagtactgcataattctaaaataacatacttacaccaggggtcagcaagcttgttctgaaaagggtcacaaagtaaatgctttaagctttgtgggcctaaatacttcagtctttgtcccagctcttcaactcagtaacttgaaagccaccacagaaaatgcataaatgagtaaatatggctgtgttttactaacacgttatttgaaaaataaatttatttgaagaaaataattgtttttacttatctctctttcaaccagttaaaaacagcaaaaacagttcttaatccagacaaatacagaaccagagaacggggtgaattaccatgtctatcagtcctgacttaaatttattttgggttcccagaatatatcatgatgcccaatatattcataattaaatctgacagttatatctaatatgtaccagttgcatgttattgaattttgtaaaattttaatcgtttgccttttctaatatgttgtagttttatttaatccatacttttaaagctttagttcatcacaaaaaaataccatgtaataccaaagactctgactactcgtcagaatcaagtgttttacagtggattattacatacagtcataaaatcctggtatttgttttccagaagaagcaaattatttttaagttacttggggttattatttggcagagaactcctctcagaaatatttatttggtcatgtgcagtaatacaattacatctaaccaatgttcaacaaagacatctcttgctcttggtcccctgttatcagggataatattaaacgaataaatccaaaaaagcacatggaagttggctccaattgcagaaactgggaaactctacagcaagaaggattgtgacttccaactgctacctgaagtgtgctattcagaagtcagtgcacttttcacagcaaaccactgatgggcagacaatttgcatatgagtaaggtatggcctgaatgtggatgcatattcttcacatatttaaataaggtgattagacttgctcaatccacttcaatagtaattcacaaccatttgccaactttactatatatccagggccttgcagaacctataaaggaagtatttatatgaccatatttccataaatcatcttaatatttagcagatctggcaattgcttttcataaattatcactattcttctacaatttcattgcctttaagttttagggatctaattaggatccaacactaaaagaactgatttaattgtttctaaaggaagataaaccccagtccttaaccttcatggtcctacattcagggagatgcacttactcacctacagacaataatcatctattgttttcttttctttatctgtggcttatttattcccctactcagtttatctacatttttctgtcatcccctaacattttcctcttcctttccttccttcctttcttcctttctttcttactctttcttatcttcctcctttctttctttctttccttctcctcatgcatctttcttcttggtttgggtctcttttccttcctccctccctccctccctccctccctccttcccttccttccttccttccttccttcttccttccttccttccttccttcctttatttctttctctatctttcttttcttttctttcttctctttttctttctttccttccttccttcttccttctcctcctgctccctccttcttcttgtttccatcattcctcctttctcccttccttcttttctcccttcctccttccatctttccttcttcccctttcccttcctctgtctttcattctttagactttccctttctcctacttattctccacctctccttcagaaaacagattggttttcaggccttaaactcaccacaagaaacataagtagcttaagatgctattgtacaagatgcacaaggacactaagatgctgagctgctgtagctcatgcctgcactctcttgtgtctgggtttccatgaagcttcaatgtataaaagccaatattttattcttagtctcaaaagccttaaaactttccctttatctgccactaactttaaatacattccctaaaattgaaacaagatatccactttaattttttggctttagtaagctattttggacatttataaaaatagattcaaagaatttatccactgcaaaaaaggggagggggaaatcatgacagattcagaactagaaaaggaattaattttacattctctttcataactagtgctcattattgcatttcagggcatatgaaaaagtatcttcattggtgaactgtagaatccaatgtgaatctccataaattcagaatggatgttcgaacagtatagacattctttttgctgtctagacttcttctagacaagagtcacctgtgatttttttatgatagagtttatttaaaaattaaaataagtaagttcaaataacaagttgttcatctcaatacagaaaatgtaatattttatattattaaatcattatttttttaaggtggacacttctaaatgtaattagtgagtgttgttaccagtctccttggtctcaagtttatttaaaatctcaatcagcctgtatgcccaccaggaaactactatcctgaatctttcccgttcggttaaataaaacaggacaacaaaataaaacaacattcccccacccacccaaaaaatataaatcttattgcataggtgtggacatgtgttcttgtactaaggatgcacttgtttctaaatttctgagtgtttgtgattatatagttatttagcctgttttccgactgtctcactacacagcccatcctggtcttgaactcatagtcacccttacctgtcccttgctacttgcttctgtcaactgaatcatgttctttttcctgttttaatttacataatgaaagcatacgatatatgaaaatctggaacaatatgtaaatatagtctatgttatttacatacacatttgccagctagtttttatgttcacttgatagaagttggagccatctgagaagagggaacctcaattgatgacatgtttccataagatcccattttggcaagcctgtagggtattttcttagttagtgattgatgggagagggccagtactatcacgggtggtgccatccctgggctggtggttctggcttctataagaaagcagtgtgagaaagccgtgaaaagcaagccagtaagcagcatcttttcatggtctctgcatcagctcctgattctgggctcctgccctgcttgagttccgacctgtctttttttgacaataaactgtcatgtgaaatcataagcaaaataactctccccaacttgattttggtcatgatgtttaacccagcaatagaaaccttaaggaaaacattcatgtttcacatttttccatactaatacatacagttccaactaatttcacctgctaaatatttactttcccccttattaatagaaattcatactgcttcaaatttttgctagcaaatatagcaaaactatgaaatatagttttggtaccaaatatagcaaatatgaaatgggaatttctgcaatgtctctttgtggaccagagtaaaatgctttctgtggtacttagcagaaaggggacatctggaccttgggctgcatgcactgtcaactttatttggagcagtaggcagggccagttgcctctacagcacagtgttttgatgtgcaaggacagcgttggtggacagggcttcctgaaggcattggagcaattggtgtggtcagacatcaagagtgcttactgtctggtgctttttaaatgcgccttatcactactttccaatcttgtttccatcctcatttagctatggaagttgtcttttcatgaacatttaataatcaccctcttgccaattcacaaagacttcacttggacccatcactctgcttgacctcaattgtatttggcgagctggttaccaccaagtccagagtcttttttttttttcctttttctaacatttaacaatgttctagggctgaggaagcagtaaggaagaggtttcccttagaagttcaggtgtgaatctgctagataattcaggcagcatactcttcaaattaatgcatttaataataagattgaaagtatgcaaagttggaaacataaaaataatgttcgtaaaattaagttcatgagctaaacattaaaacataatccaataagatggcatgaaactgcaagaaatagcatgataatatctgcgcacatttaactcaacatatactcattatatcttaattctgttcaacacagtttttgtgttactactgcctgttaaaccattgggtttaacatattgggttttaggacatgcaaatggtttattctttaatatgaacaaaatttgaatctactactatgtcaaaagaggggttggaaggtctcatgaaggttactcgtagggcgtcttccacttcatgtccacgagctgcatacagctcattctaactaagtatgcaagctagaacacagaatgctgagaaatactatcttccagacacaatgtgaatgctctggtgagctctacaagacccacacaaggccagttaaaatttttctagcatggatgggagaggatagagaagccccacacctagctgagaaccttttggcagttgatagttgctgacagagggagagggacttttccttggaaggcaaccactggtattccctggtagaccccagggaatgggtattactaaatagccatgcctatgtgagccgtactgattggactcagattttcaaatgcattttttttttaaggtaagatcatttgtccccaacccaagcatctttaaactagtcaaatgggcagcaatgagaaaatatcttgaaaattccttactggagtaatacaagcctgaaacagccacaccaccacttattgtcaccactgatggcactgaacaagtatgcattgaagatgttaggagcatacgcagagactaggggttcttatcttagcaacagtttacaagagggaggatgcatttttagttctgggggggctctggtcagttcatcttgtttagtgttttcatgatgtgttttgtttgggagaaagattagggtgactgttatcactggcaaaagtcaaaccctaaaactataaaaggctgctataaagtgaagggtcatgagcataaaaagataaggtctaacatctcactatgatctaaatctaaaaccacaaaggagtgacgccagctaaacctcctgaagacatttttagtaataatttttaaaaatataagtttttaaatctccctttaaaagtcctaatctctgtcccactatgaagttggaagctactaaaacctataactaagaatcctccagggtcatggtagttgtatgtgaaacaaaaaacttcttttaattagagatggtaaaagccactcttgtctggtgactgtctttgtacttgtgttctgagtatttcttacacctttactataacactatgatgtgtctgtcttgtaatttctgtagtcggtcttcaaatggacaagtcaggaaaggatgcagtcaatcaagcttgacaaaggattagtcattaatctactttcctaaaacttgggatggctgtactaagaaagtagatataatagttagcttatggtattatctaggtaaatatttctactgtggagtaaaaatgctttactcacaaattctctctatgcctctctctgtgtctttgtgtttgtgtctgtgtgagcgtgcatgtgcacgcacatgcatgtgtacactcatgcactcttggatatacatttgtgcatgtgtgtgtgtgtgtaagtgtggagactagaggtcaacaacaggtgtcattccttaggagccattcaccttggttttaagatagactctctcactggcctagaccttgccagcgagccgagtgactgcccagagagctccaggggttattctgtctccgtatcttcagttcaagtacaggtttacaagggatggcaagtccaggtattctcacctgtcttttttcacacgggttctgtcctcatgtttgtctgccagttacttctttgagcatttgcctcaacctaaaaatgctccttttgtaaactgtgagaacgaccacatagacgaattgttggtctagtcccattggtgtcttactaacaaacaggtcaagtttcagtgagggatttgcactcttagcagtttttaaaatggtaatcttaattgctggccaaaaagctttaaaaagcagcccccccaccgtctgtcatcaagtgatgatcttccaaacactgcccaaagttgtgcctcagctccttaatccaagggattggccatgaggaaacagtgcatggaagaaacgccagcattttccctgtgggtgttgaagacatatatgtgaatcaaagcatgtccatactccatgttgaaatgttttgattctcagaaagaaatatactttggctaagtttatgaggcgaaggaccaagtagcctgtttttagaaccaggagaaaagaccaattgtgtcagacttgaaaaaaatagtaactgtcagtggatcttggctgtttggcagaatacttcaagcacagcgcacacagaatctgaaatttcaagagaaaaattccaacttcacttctccttataatagaatgtcagcacttagaaggaaaatttaaatatggatagagcacaataacacacaaaactgtaattattatcctactgtagtgaatattccaaagatggtgttacaaaatgatatttttagaaaagctttcatctagtgttgtaaaaaaatattgttggtattatcatgtgctctgactaaaaacctcttttggacgctaataagaaaaagttcctatccttgaaccactcataattagctcacagtggggatatttaagattgtgttggatttcagttccaaagttatgttttgtatactcatggcagaatactatatcactccagctttccttgtcagtgttcagtgttcatagtatatgcatgtgacccaaatgtttgcacttttggcaaaaaaaaaaaaaaaaaaatgcctgtcaaatagatgtgtgcgttgtgatgccctttgtttcccacaaaaccacagaagattttatatcacccaaacatacacaactatcatgtaataaattctcaaaactgcttattcacaaaattaatgcattttctcttcctagatctatcgcagaagattctttagtgaccatgttaaacggctggccgtctacataacttcctctttgatactacttgtgttgtgggtattttatcttgtttccattcctgtttgaaaactttcctgtcttatatcttgatacctttttttggtgacactcctaagtaactgatcgtgtctcacaaactgactaggaatctctgttcagagaacattgaggcatggtctaaccttggtccaaattcccatgggtatagatttctttcaagtcattcacctcacgtgcacgtgacacctgctgtccacatgtcctgccgcaggcagtgatgaacaccagagtgcacagcagacagtgcaggcaccatagcaatgcctagccatggtctgccaagctcaaatgcttgccaaccacagtgcactcagcatttggcatttaaagcacaccattgaccttctgcactggttcacttccttcattaatattttgccagcactcaaatcactctcccttttatccaaacgtgcaactgtggagttaactccagtgtaacggaaagaaggaagatctatttcatatctcctccatgcctgtcttacctgttgctttcgaattgatgcccatcccacacgtaagaattgaagggctttgtcttccttggagcagtactaggaccggcacattagcttgaaggtgttatctgcatagtatctcgttttatttcaacaccttcagttcttcactgttatctacggaggagaatctaaacttcttattcagctcaaattcacaaagagttataatgcatttcaactgtctgctataactctctaaaaaaatgttcttttggtatatccatttctttgttctcagaacttactttaacattctctctatgtgttaataccgtccaaagtatttctccccatcctttgcagctggataagcttcacttaagatacagtcacattcctaccatgcctgaatttccccttaactcttccaaccagtattccactcactcaagtccagccccttaagggtcttgtatttggcctactttctttccgtctctaatatcattctgtttctctaaagacttacatgtcaagtcaaaacatttttgactctcacaggtttatatacaggagagtctagttacattgcctaaaaactctgcacaagagaagtgtcacatagaatatctggcctgttcggaagctcatccttgtgtccgctagagctcggtgctagtgggattgcttgcatgacaatgggtgggtttttttctgcttttattggagcccaagaatgattcggagcccaagaatgattcagtgcctctgctattcttgatgatcccatgggtgtgtcgtttgtggaaaatgagcattttgtatactgtggtgacagaaaaaggtggcaagaagtatattttgattttgttcactttgtgtattaaatgtgggcatttgtttctattaactgaaatagtaagaccttgtgaaagagtggctgtccagacatgtctataaggatcctttgctttttgcacgagaaatgatggcaagagttaaagatggagaagaaaatagcagctatgtgcactgtgactaagagctcaaacacagcctgttcttgatccgtgactatttattacctgctttttgacacactctgcatttgctccaaaggatctgatataggaatgaacagagtgtccctcaaatgagaacatgtccaatctacagtccatcaatagcaaagtgctaatgggcatcactcaagaaattcgatatgtcaggaattacacccctgtggctcataattggaataaaggacggtcactagactggcttgccaaggccaggctttatctgattgatggtgccaccaaagatggaggccctcatccagtacctcctgtgggaatacgttgagtgtcctgacattctactatcaccttgtacctgaaagttaccgttagttctatggtcagagtagcctaatctccttgctctgtttctttaagaattaaaaaaaaaataagcatccagttagccaggaagacttcttcatgtactctgaaggattgtgagtagattctaatcagcatgacccaaaagaagagacattgagactggaccaggatagagaatgctccctgggatatagtgttcagaaatgtttcattgtgatgaacaagatattttattaaacattctcttttcctaatggttttgttgtggtatgatttatatagtacaggtttgtttattgcaaaggtagtaatactctatggctgttagaaaatctacgaatttgggtagctatcagacatatatgccgtttagacatttacactacccacaaaagacttcctgagcctctcatttgcaattaatagctgccccttgcttggctcctggcagtcactgatctgctttaaaaaattgtcttttctgagtatttcatatatgagaaattttatagcattgccctaggatgctccactaaataaaatgtctttgaggttcaattcgttttagcatgtatcagcagtcactcttgttgattgctgaatggaagtcaattatccagtatccatttataaggtcatggtcactaggattacctccagttggagatataatgaattatgctctaacaagcatatgtatgcctatattatctttggaggcatatgttttgggttggattttttgtaaaaaagtaaaagtattccccttctcatcccccctgaaaaatcaggttttttttttaatgtcacaattctaaactctactgaaatcatgaaaactcccagaaagagcaatgccagcaagattttaaaaggatgaaaagtctgacctgattcacttcattctgccaaattcattgcctagcttttccttgagtttatttctgtatccagaaacatatacagagaaatgacacaaggtcaaatcaaaaatgctagaaaaggcagcatttatcaagggttatatactcttttcatccaagtttacaatagtctaaagaacacaatataaacttctctggtattgacttatccaatgttttagatgtattaaggctaacagaaaaaaaaatcccttattaagactttatttttcagttaaatatttttcccaaaatatacttagctatatagtttttatcacaaagcagaaaacttttactatcaattttcagatatgagaacctatcaatcaagaacctatcaatagcaaccagatcatcccagctatagtcttaatgctatattgctccccccgaccaccaaaaaaaaaaccctcatagattgaagtcctgaccccaatgcaatagtattaggtgaggggatcattgtgagagatatggttgatgaagtcatgagagtgagtcctcatgatgaagttggtgttcttaagaaaaaaagaccaaaagataattgttttccctcctccacagcaataagggagccaagaaggtaccatttcccaaataactggatagtactgatacattttatcaaatttgcagcctcaacactgtgagaaatatgtttctcctccataatccacctgtccaaggcattttgtcatagcaactgcaacaactatgtgagtctcccaattactttcactgcactctctccttttctcaaaataaaacaaacaaaatccgggaaatacagtggatattgtttttaaacagttttctagtcaaaccctgttcttgataatttataaaattaaaagtgatctaccaaaggcattttgcttatgtttcatattttgtggttaatttttccaaagctccttcttttgtaatattataattttcacattaaagaagcactctgatttgccctggtgctagtattttttaaaaatttatctatttttgttttatttgtatgagccttttacctgcctgtttgtgtgtgcgcaggtgtgcaatgctcacatagaccagaggagacaatgaatgtcctgggcctggagctcaacagttggattatatggaacccaggtcctctgcaaggacagcacactctcttagtcactgagatatttctctagcccatggtgccaatatatttcatgacggcacaggtctggtccccaaaaatcacaaaggaaatcaccgagagaatattatttcctttataaatatattcagtatgatacctgagaggcataactcacaagtaaattgagggaaaatcaccatgtgtatatgcatcctaatatatacagctttagctgatatctgacattgtcccttttgtgttggcagaagaaacatgcctttctgggccagccacaaacccaaactacacagcagtcacagtagttactctgggtatgagaaaacacactacatcagaaattctgtaacaactacaaaagaacatattaaatatcaatagcatatgtccctgggaaaaactgtcaataactcaacacagtagaaattccttttgtgaaggcatatggtccaacaagtggctattgcaggttctgcaatcacccgaatagcaatctttaaaatctaattattaagattgtaaaggctactttctttccacagaatacatatctgaagtggaagggtgcacgagaatattaaatattgcttcttttacactttcttgttggttaaaaataataaatggtaagtgagttctgcctcaggctctactggtacaggctaagcaggtatgtaaggcaatgctgaggatacggtggccttgatttcttaactctagttatcttggacttgggagtgctagtgtagagcttagactaaagctctaactagagataaacaattatagtctgtcaacacaacgatgtcagttgaggcatgataacctaagacctgtaaagggacacagtattcaggccattcctgaaactcaggcagcctccccactgtctatacagacagaagaggagtctgtaaaggtccacgggctgtcttagaagccaagggacacagctgtatgccatgaccccaagtgccacagagaatcccaaagagtgcttatgtgattactactcaagaagttgttagtcaccttaactaagccatggtggactaagacgaggagagaagaggcacaaacattagcaactgttctgtcaagatgcttgcctttgagagtgagagaagagatatatccataggggatgggaaaagaagatatagaggtaagagcaaggtaagtatttacttaagtaactcaggagattaataaagaaatgaagagggaagatgcaagacacagttagaagagggagcccccaccccctccgccccttttcctgtgctcctttcttcctgccatgctgttcgcctgtctgacccctctttgacttcagcccttgtcatccttccacaatctggttgctaagtacaattcaagatgcttaattaaatttgaatttctaataaatactaagttactttttagcatagataagccccagtcagtgttttatatatgtagatgttagattattagtatttatatgatacatttaagtagggattctgggttgtttttttcttttttaactaagttagctcttagacaattatactcatttttataatgcattctccccacctatcttccttctgcccctttcagcccctcccagttccttttctacccgtccccttcttggattcatgaccaatgaactgggactatccattggaaccctgagagagcaacaatgagtagacaactaaaagtagtgcctaccccttttgcagtctttccagatgccagatagtcttgctttctctctcattctcctcactaccctgcatgctgcaagagtcatctcataacccaatttcacagtctccagcactgagcaccatgctgagaagtactcttctgctctgctggcatcagcccatcacacacacacacacacacacacacacacacacacacacacacacacaccacacgcctaaaccctaaaccatgcctgtttgtctcaacattgcagtcaagcatgtttcatttttctagaaaatttgactcaaacttttgtacaacctgaataacaatacatcttctagccaacgctatggcagaaacaggggggaagtaggagacgcttctgcttctccaggcaacccacagccgcgataagcagagatcgccatatttaagctttgctgattggttgattctttcgaggtaatttgggttggaaaaaatctgagtttgaatcctcttcctcttgtaccaagggactaacttgcaattcagcagtttccagcactcagagttgctgatccaacactttggcttatagtaaataaaatggcataaggagccagttaatttatacaatcctgacctaatcttttaacccacatatatgtcaaatgcatatgagaaagagtaattctttatagcatttagtcttaagaatataaaaaacacattttgcccagaggaatttttccccttcatttgaaagttaaattgtgcatttcaagtatctaagccatgtgtctcactccttgctaacagcaaactgttttgaaaggactctctgtcatatgaaagatttctagcctgtctagaaagagcaagccatgccttccctcaatatctacattcacactcagaagcatacacctgtggccctaactcgcagtttttaaaacacaaaaatgatctatttcagatgattgctttataagcttctgaaaacgtcatttgatgtgagctgtcggcagctgtaaagctgattaagaccctatgtaggggaggcagtgttggacctgtggagtgttgaagtgtgggagaatatggtccaaactcattgtacagggaactaatttaaaagaaaaaggctattatgtagcaggcacaaaactaagttacctactttacaaacttgagtttgaatttcaattcattatcaactcgtttaatagctgaaggtgataaagttccatgagactaagaactacactaactatataaaagtccatcataagttctttctaacacagagacccagtgtctttccatttatgttctcttatggttagaaaagtagagtatagggaaagctttgccgctctcatttttcttaggatgatagtttttaaagatacaaacaaaagcataacagcacagttaattattccatatttaactaattaataacacatcaagacagtacgcatctaaaagattcaaacaaaaacttactgacacagagctagctaacccatatttaaccaaagaagaatgtaccaagatagtaagtatacacattaactataataagtagaatatttataaaaattatattcaaaattcaaaggagcaaaaaaacctaaattctcttcatgaaatgattcataatgcaccctacctccaggatacacagctttttttaaaactataattgttgtaagagcctaaaaagaggacatcttgaaagcatatgcactccaaacagctaacagaaaaaacctacatacaatacagtctctggattcagaatcacttgagttccaaaccaaatggtgctactcccggacaattattcaaccagagtccctttactctctgcctctgtgctccagtgtcctcatctacaaaatggacataataatacctatctgaggggactgctacagtaactaaaatgagattatatttggagaaagttggcttagctcctgagtcataataagcacattgcaattgatggttgtggttgtagctaaacagtcaagcagaaagcactggcaatcatcggagacacccagaggccagaggaaagacatttttcaaataattatagtccatgataagaaaacgagggaggaagtgaagtgtctgccagcatctgggaataatgggataagaaagggactctcaggattggcatgtaggaaaacagaagtgttggtcagcacactgactgcatgcagcaaaggaagacgggatgctggtgtgtgtgtgtgtgtgtgtgtgtgtgtgtgtgtgtgtgtgtgtgagagagagagagagagagagagagagagagagagagagagagagaccttccatcaggatatttgtacaggaaaaaaattaaggcatcaaagaagagattgttttcattggattagaagaacctaaaaattaggacacgcgggtttctgcggctcaaccatataaagaagatttagctcttgcacatctagcttgaaaggcaccatattaatattaacaagaatcacacgtcagaacttaaaacatatatagttaagagaattgagtaccattattgttgttcagtaacaatgaatgtctgtgctttcataaaagagttttaaatatgtctactttaacctactgtgtgatcttagatgagaagtcaaaaaaaaaaaaaaaaacccctaaagattgtagcacatatggccctctttggtttttggaaataaagtttgttgcaacctaactcatttcatgtttcatacacactatgactgcttttaagtcaaaatggtagacgtgagtagttgcaacagaaaatatgtggtcactgctagtaattgtcagcttgacagaatctagactcacctggaagagggactctgggcatgcttgtaagatcttctcctgattacactaattaatttcaaaggcctacctactgtatgtggctgccttcattgcctgggatcctggactatgtgaaatggataaaggaagctaaagcgtgcatctacttattgctctcttcttctgactgtgatcatatgaccagctccctccagctcttgatatcttgactttcctgtcaggatgggctgtaccatgaacagtgagctaaaataagtgcttcctccttaagtcgttcccatcagagtatttgatcaggacaacaagaaaagaaattaaggcagactatgaaccacaaaacctaaaactgcattatgtgcatagagaaaccacgctatctctcgcttgtcactcaaaggtaagaattatgaagtaatctgatcagcctgtcatagcaaaacaccacacataaacttgacatctttgacaatgggcatctgttttctgtagggtatgaggtctccatcaggataggatggttacagagaccactcttctgggttatagaagacggccgtctcggtatatagtagagaaggagagagagcatgaatatgacagaaagctctgatgtcttttccaattagggcactatttctatcaaatcagggcctcatccttgtgacctcatgtgaccttaattaccagcttatagggctgctccctaaatatagacacattggggaatttacttccagcataagactttaaggacataattcaatctgcagaagacttcaaacttccaaactctaatttaacctgaactgtccagtgcaccacccagtgtgccttgctaaacccatctggaaaacagtttgaatacaaagtacagtggaaacctttcctgttggccatgaataaagagaccatgcagaaacgttgccacaatgttaccacggcaaaccatttatatgcttggagaaaaacagagacaaaagacttctagagggcaggagaaaagaagacttctcctctccaatgtaaaattgaaacgcatccatttatccagtccccaaatgggaatttccatccagtggttatccttttatctcactaaggaaaacagcaataaacattcttgagaatagcctgtgaccaagtgggatgaagagattcgagcacacactgacaggtcaaagtcaagtggtgggcctcgtccctcccgtactatttacagaaaggatttaacgctacctcttcaataaccacagagtattttaaggacactacctcattcatcttctgggtgcctttgaagtaaagtgtcccacattttatttctggctcataaatggaaaaagtaggacagaatgcagtcgcatgcctctttccagagtgaagcaatcactagaaaaaactgaagctacagagtatgaagtaagttcctatgcatccaaccacgagttaattgtctgctctctgaagatatcaaagtatgtcctgccccttggagaaggaactgcatgtccttttatatagattataacacacatctactgcatcaatctgcacaatgactaaaacacacatctaaccatatcattatgaacaattcccccgctttggtgcatttgaaaacccccttctcaattagaagtagaaatatatgaacgtcaggaatgaaaagtgtcatgatctatgtacgagaagcagctttgagtcggagtgctcctgtcttattgcatgttggtgaggtcatgggctgcagcaccccctagtgagaagccaaagtgactcacagattgttaacagagccattgtcaagaggttaggattaatttcagatcaaagcttccttgggcttaatcctgctcctacattggcaaatatgtcttcactggagtcactacatgcgtatgacaagggtggggcctgggttacgtgtgtgtgcttccctccttaatgatgcaaagggaagatacaaaggattagtagatgagacatgggttgaaatcaactctaccgtcagttcttagattttatgcaagtcactgcaggtctctctccagagtcttcaacataataaaggcaatgctcacctcacgatattacagtcctgattatgaaagaatcaaaaaaaaagacggagctgggaagacagcttggtggtcaaagggctggctttgctgacaccagagtttggatccctaggacccatgtgaatgctgggtagggatgctattccacctgtaactctggcctcagaaggtagagacagggcatccctaaagcaagcttgttagtggggatgatttccaacactaaatctcaagcctctattcacatgtgtgttggcatatatgccaccatgcatacatacatacatgtatataacatacacacagagacacacacacgcagctaaatggaaaaacagacaagggaaataaaataaatgtatgcatctttatttcattcccttcaacaaatactcatttctacttctccctaaggagtcctgtaatctttgcatacagccctgcgttagtttactaggctttcaataattaagtgccccagtatgaatgtcttgaaagacagttcagttcccttagtcttctgaaggatgaggttccaaggtggggatgccttgaggtgttaatggcatgagggatgcttctgtttcaagcctgtcaattagtcaattaggtttgaaattaggtccaaaagagatctttgtctctgagtcaccttgcctctatatatacctagagtggaatttcctgttcttacctcaccactcagataaggtcccacacccatgacctcactttgatttgattaccatttttaaaagtctacatctaaatgaagttaccttctgaaggcccaagctttaatgattggccttgagcagctgtcgacttggtgggatttagaatcgccgtggaaacaaacctttgggtacatgtgagagagatgttctagcttaggtgaacgaaagtaggaaagcatgccctagcctgtaactgtagataacatcagtccatagagtggagtcctgggctgaataactaagaaagcaagctagctggtgtcaactgaccaataactggcccaacttgggattcatcccatgggcagccaccaatccctgacactatgactgatgctatgttgggctacagacaggaatcttgcatggctatcctaggagaggctctacctaacatctgatggagacagaaaccccatgtactgattacctttgtagttgctacagccagacaactgacagaaacaatgaaaagacagcgtttatcttggctcactattgagggtctatttcatcatggcggagaagtcaaagagcaggagcaggaggcaggtggaagcagcaaaaagcgaatgcagatttccattcattcttctgcccctctggacctctttcctgtctctccctatacctgatcctactctcctattcccctcccactcctctctttcacccaggtacctctctcccttagctgccccagacacatatgtagcacatggctgccttctctgacttcagagagactaatcctgcagagacttgatgtgccccccagggggtgcagggaacagtgagtgggatgtaaagtgaatatgttaatatatatatatatatatacatatatatacattggcagaaagcaagcacaaagcatgcacaaagacagcaaagagtcagtagagataagacaatcccagtcctggcccaatgtgacacacactccctccagacaggtgtttgtagaaaagtaaaaattataggtcaaactttaggctgtttagggcttgcagtgatgtctcttctctacgatcacaggatcctgagataaaagcgattctccaaatccaacaatgtgttattaattacagtgagtccttgggtaccctgagcaaatacgaaaaccgaatgcaaacatttgtcctgtcctctcaatggattgaatcgacaattcctgagttattgtgttacccgccagggctaaaccaactccgggaaacttcatttcactatttcgctgactcgggaagagcttttgtaacttctggctaatctacagcacaattcaaaatctttcgtggctgaaaaactgcactctctagtatttattctgaaaaaaaaaatgtgtgtctggcagcattttccaaatgtattttgtgaggtgcatagacattaatgtagggatagcaagactgtccacctcggtcatctcctattaagcagattccccacagcagcctcggcacttggatttagagaggacagaactgcagagcattcctgcctgctgtactgtgactttgacatgtcactcctatctcccgaccacactgctcctgtgccttctatgccgtcttcccatgccaggaccaaaaaaaaaaaaaaaaaaaaaaaatcattctgataaaacccaaataggagcactagaatccttccaaaatagctaccattacggtaactacttttgctgatttttaaatgcttctttgagtggactttataaaaggcagaaagaatagaacagacattgaaatacccaatagcacttggctttgcaaatccaaaggaatgggagtctgaaaggtcccatgtgaagttgcagactggaactgaggatcatagttgatgtcaaagctggcctgctgcaggtttaccgacacgctccatcatcacatgacatgtctatgttgagccattatgcatatttgggctctacaaaatgcacatgagtcaataaagaaaagaagaaaagattggctgaatataggaaggagaagaaacaaatcctgcataggagactgtttcaaacagtgttcggtagcacccgcccctgactggaaggctcagctgtgtatctctgtataccctggtttccatgtgacctggatgtaaggactcacctctaaagaacaggatataggaaggaaaaacatagggaactttatggaaaaatgtaaacaaagtgaacagagctccccaagggtgagccattttgactccacacactctgatgctaggagatggggaaggtgtggccaatgctggggatgcttcccctaaactcgcagctctcaaacaattatgaagaaaataccagattaactacattaaaaatagtcctgaagaatttctaagaacctcttttcaaatattctatagattgagcttgctgtgcctatggcggaattgactctatatccagcactcacattgggaagtttaaaaacacctgtaactacagatccaggaaatagcatgctctctctggcctccaataacacccacactcattggtacagcacacacacacacactttttacttttgttttaagttgctataaacattctctcaaatatatgccagttaagtgctgaataatattctgcttgggactttgatatgggagaaaagtcaccagtgagaaaactgcataagtttgaatataatctcaggtttatttaatagcaaaaatgctgatttctttggttgaattccatggttatgtaagatgctgatgttcatggcaaacattttgccctgtgacccatcttccagcctctgattcttttaaagaaaacaatgttgtgggtttagtatatcctcaaaattatgcaattattattaccactatctcatttcagaacctaaaaaaaaaaaactttgtgagttttttgtaaatctaaaattgttccatacctaaaatgtttactttctcatttaaatagtgaaagtaattcttagcttttaactttacagcatctcggcagactctccctttaggagggtcactagtggaaggaaagaagccggaaggaatagctcactgagtctgaagatgttgcttacctggaggggaggaagcaaggtaacctcagtataagttacagagaactcacgcatcataaaatagacccttaaattattgcttgtgtttgtgctgtgtgtgcgtgtgcgcgcgagtgtgcatgagtgtgtgtgttttcacatatgtgtgggtgcttttatgtatgtaggcatgtggaggacaaaaacccatgttgctcaatggcttttaacctaatatattgagaaaggatctcttttgtgagtccaaaacttgcaagtcagctaaactacataccctcctcgctaggagatgccccatctttgtctcccaagggctgggattacagatggcccaccacacactcccataaatttgtgggtgctggggttctaagctgcaagtttcacttttgcatgacactgaaccataaacacagcctctgatagtttattaaagtaagaagtgtagtgattttaatattcacgaaactatgcagttgttcccattatctgatcccagaatattttttaaagaaatccctagcattcagcagccacttttcatacattggacatttcacaacaaaaatgagatcagagatctatggccctttacttttttcccctaaaaatgtttgcacgatgcacttaggtggtacatgagcaggatacactaaggtccaccatctgagtcaggatgtcattaatctgatgtcttaaaattcttccattgtatggctatcccacaatctgcttaacccacttgtcagttgatttttactgtaccccacattatacatcaatcaccacttgatgtatagtgtttcattttttaacaattacaaatgatgctgctataaacattattagagatttgtgggagcctttgccttctttcttgcagcgaaaatttctttctcctgagtgaaactgctgtatcatatgataactattactttattaagaaactaccaaactatttccaaagaggctgcatcacttcaaatctctcccataatgcatttgttttcatgtttcccgcagccctgctagcccttggaattatttgtcttttccctttcttccctgcccccatttaacattgctggggatcaaacatgagatcttgtgcctactaagcaagcattctacctctgagttatactacagtctagtatcttttaattataaccatgctaatgggtaggaaggtgtatttcatcagagtttaatctgtgtttccctaataattgagactgttgacaatttttatatcttgtttgaaatgatgcttactcaaatgctttgcccaagtttaaactggattacattttattatagagctttaagaattttccatattctgaatatcatacctttataagatgtatgatttataaatatctgcccacattctagggctttattttttactttcttgacagtgtcccttgaaacgtaagttttccaattttaacgaaatcgattttcctttgtgtacttaatctcttggcctattatctaggaaagcattacctaatcttatattatgaatatttgtgtctatacccctttctaagatttttttaattttatatctcttattgattttaaattaataaaatcatgactacagattaagccatttcactactagacagggaaagagtgagaagggagccaatcacatacttcctagaattctttctaaactaaattagcatacaacttcagtatgttgtttatatttctgtggaaagtctcttctgcaacatatttttatttttctttctgtgatcatgagcaaccatgataaatgctaaaatatttatagaaaaaaagatatgataaagttattttaaaaactaatgaaatcgcaagggcaggaggagaaggggtggttctgtcaaatgaaggatgggtgaccaggagtggctcctcgtcgggtacttagggtatcataatacaactcattttaatttatttgtgcaaaaatttaacagtaaaacgaatgattaggattgtcaataatgcaagttgtcaggcagaaactttaaaaaaaaaaaccctacagcttattagcttttcatataaagaatatcacctctccccctgagataagaataatagtataatcacataaagaaaaatgctttcatttgggggaaaatatcattgtggaaaacctaatttctctcctaacatcttttatttggtcacagacagacagtactgatccctaccctggtatttgggaaacaatgaatcagagctcaattttgaggaattaaaaccacctaggcttaagtgtatggttcagtttaacttttagataagcccaaggcacaataacaaaagtgaggggaattaaatgttctcaggtgaaatcattttggggtcaacaccacactcagctagggagctaagttgtgcggctctacggaaagccctagcttatttcaagatactgtaattttttcacgaaacactcatgactacagattaagtcatttcactactagacagggtaagagcaggaagggagccaatcacctacttcctagaattctttctaaactaaatcagtacacaactgctgggtgttgcttaagctttatgattttaattacaagtgaatctggacagaatcgggccattgcacataggaactcacagcagttgtgtgagcatgcccaagacccgtgcaatctcaagtcaggaaaatcagcagcctggagaagggaggtgggcacaaagtcctaatccgaaatgggaagttattgcctttgacagctactgagagaagtgtggcccctgataggtcagccatgctttggtggatgactctacatccaagaatatgcaagcagtacaaattgggctgatggcttgaagaaaaaaagaagagaagagaagagaagagaagagaagagaagagaagagaagagaagagaagagaagagaagagaagagaagagaagagaagagaagagacaaagtccggtgggtagagaaggagggattggaccttagaggagtggggggggcggtaataggattcaaatactttgtatgaatttctcaatgaattaatagaaatgagaaaaagttgagttaagattatggagtcagataaacggttctgtgatcaagaccatttgcttctcttactgaagaccttggtccagtttcaaggatccatgtcaggtggcacacaaccacctgatctctagttttaggtagtccagtgctctcttctagactccaagggtacctgtgctatgtgcaaatacccacacaaagatagaaagatagataaatagatagatagatagatagatagatagatagatagatgcatatattgcattactatgaataaaatatagggactcaaatgttgactcagtagttaaaagcatgtagtgctcttaagaggatctgggttgaatttccagcacctacatggtggcttcccacaatttataagtccagtactagggggatcagacagtctcttcttacctgtacggacacacatagtgcatgtacatgcatgcagataaagtattcacacgtggaaaataaaataaataattctaaaaagttaaaactaaaatgtatataatctacaaaagataaaaactagcaaaagatctttatttatgaaatcaaatttgcttatactctttgtgttagaaatctttatagtattaaccttacggacatttataatgagaaaccaaccacaggatcataatttccaactcaaaggatattacaaaaattgtgatcgtctcccttctttgacctctggataccctatacaaatagggagtcagtgtctcagactcaatagatttccgattcttccccctttacccagcaactctagaggaagatttgtcaattctgtgatggttgaggttgatatttctgcctctgatatttcaggctcaagaccaatgtgggttaaagcagcacaatcttgaattccatgctttgttcccgaattaggatttaatatcaattatacatcttctctgcttatttgagacagcattaccctgtgtagcccaggctgtccttgaacttgcaatgatctttttgcctcagatcttttaggtgattctatgaacttcctaagatcccatccaacatcatcttttttggagtatgtcatctgataatcataactcatgaattttgaatttacaaagtatccatttttgcatgcatctctatgccacacagtcctgcaaatagttatggcacatgcttatagttaggctgtctgagtttctaaaaacataagtggcccccattcctcagcctcctctcctattcctagcaccacccattgcttctagtcagctcttcttcactggtaccacagttagtccttcagcaatattggctgggtgtctgcctggtgataggcactgtttgtaccctgcgaagataacaatgaacagcaacgacagagctgcctgttctcacagatgagacccatcccttcctcccttttttgctcaccccacactcccagtgtgctgtgagcagtgtgtgtaagtacactcatactggcttaccatgggtccaaaacaacaggaccaatccaccatgaactaaaacttccgtcttagtagttgattatctccggtattttgttatggcaacaaaaagctgactcacacacttgatatctagcttatcattatgtgacacaatcctgttctcatcccctccaaacagtagttttaagtaaggcagtctttcatcttttcaatctttcaaatctttcaaaatgtggagctctggtaagcaaatctctctaacttaaaggttccacacagatgccagcaagactctgcctccctgaggactttcgcacttactggcagctgaactgcccctatgttccacagatacatcccttgttggactatacatcttttccacaaacttaaacagctataaaatgcccacccatactctccacccttctagtcattcagccaaatgggcaggtccaacagcttagacttttgagctgatacttaggcctgctctggccattaggctatatttcctgagcttggaactttcctctgaaacagagcccatacctatgggcatagacagaaatccaaatgggataatcattcaaactcaagaatccagagaaaacccattaatggttcgcttgccttttccaagtttttaatagtctgtcttataaatttagcattatgaccatgagtagctattaaatctttacatttttatattatgatatagaagggatagcaatactttatttcattgaattaaattaaaccatctaagcatgcaaagtatgatgtaatcaatacattttatgttgtctcgaagagacattatccttaagttcaggtctctaagaactagagtagagtcattgatcaaaagtagtggcctcaatgtcaagagatgggtgctctgaggtcacagctgaggattattggcagcaaaccacaggcacgtaggtctgccatttagagtcactctgaactgagcaaaaattgggccataggcccagcatctctctaggactctgaaatgagccaatcagtcccaacccattgcatatatattttttaagtgataaatagcaagctactaatcttctgaactatggtaatgggacaggctccagaatccaaaaatatacctgaaaatgaaagcatctactttcagtctttcccttcccacgtcatcaaattgctggaacagcaccaagtgtccgctgccatacaaggaaggaataaatacggcattgtcacaaagaaagcaaagaggagccgtatggatagattcatattgtgacagatgtgagtagttcagaatcccaggtgtaaagtccaaaagagccatcttagagcaattggatcaatgtcagatttgggggtggggaaagtggattgagaaaggctttactgaaggggttcataagtgtaaccttgccggctttaacaatgctcatgtttgagaagtaatcatagtagacatactactaacacaggaaggaaccacggggttagtgctgttgctagcagaagactagccctgtcagaaagaaagattttgatgttggaactgagataaaatgataattggataaaccattttctgttgtgaagattcgctcatcctgacataaagccttaagcataaagaactagtacacaagttgtcttagatgcaatgcttgatttaaagcaaggctcctcaaagtcaagctagctggagactgtggggtaaatagaacatgtcaggtacaaggaaagaattaagaaggtatgggatagatggctagaaatggagatgtctttcttttgtgtccattaaatgaataactcagggttgtctactgtgcttatgtgacacacatgcaaaaaacacaaagaaagactcctatagtaagagtaggaagaagtaagaaagacatactgctttaggcaatgttgaaatgaagaataactttgcttgtagggtagccacattggttgaacataaaatctcttacttgttctgaatgcagaaacatatgtctacaataatgatttttccatacagataacttgaataactattgggagcttaagttttcagtgcatactaataattaacttatttgttggatttattagactaagattctttacgttaaggggagctgagcaaccaccatgcaaattattaaatcaatgatgcgacttttcttctgtgactttagctaagtttactggttcaggatagtcacatgtctagtgtgggaacaaatggaaggttagagtcttgaactgcaaaagatggtggcatttgtttgtctgtgtaaagagtggcctctttggacacagaaacaggatttcattccaacacaatgaagattattattaaacagatatattattttgtgttgacagaaatattctacttggcacatgaggccaccattttattgatcacccactgtttcttgtcacatttaggaaaaagacaagagcagacaatgagtgtagaaatacatttatgcaaagtatcttttcaggatgtatttgacatggctttcatctcttgagggcttgagggcttattgttttaatgaataaatgaagctatctttcaaaaatgaggcacttggaacactacacttagagactgagaaagaataaactttgccaaatacaaaataaataataataaagatgatcacatctaatattttcttatcttttcactttcgacccgaaatgttactaaatgctttcaaagccttatgaacaatggccaactcctttcctatcctcataaatatctttgctgatttatgtcctgaaatattacaaatatttttttaaattcataaatctctgagaactgcctagccctattgattttgtgaagatgttcttgcttggctgaatttaatttaaatgtagcactttgttactgcttcaagaggatgacagtcatttctaacaagcacaaattattcagagcatgaccccgaatgctgtatttcaactagcaaaagaaaacaagctatcctgtaacctacttcacattgcaggaagagaagctctatgaaaagaaagctgaaaaagggcaacctgacccagagagagttgtcctcaccggggcactcctcccagctgctctgggtctctggataggccagttgcacaaatacaagaagatcaggccagcatcctggaagggggaggggacttggtatcaccctccttggctagccgctgccaagttctagttagcccagttacagtaaagccattgtgaactctttagtggagcaaccctcaaatctacatggcattcacgatttttttttttatggctatggccacagccagtaactgcaatttagcggctgacacattaccatgaaagggggtgggcaaaggctcgagagcaatggatttttacagcaataggaaatagaacacatttgtgcacttgccagctcctttgcatttgtgaagatgaaatgccccctagatcaaagtgacaaagtagttaggatattcacgggacaggggacaaaaggagttcatccactgccaaaaaccagccttctgtggagtatttacaagtttaataacagtacttacatgagaagtggaacgcaggaagacgacctgaatgtgtccacagcttaccgggagctagtccttccccttcttctgggcaagcgggtggttgcaaggtctgccctgttcactcaatcagctgtcacacatatgttgaacatctaccccagggcactgtgctaggaatcttaaggggcataaatatgccaaattaaagctctaggctgaaggagcctgcaacagctctgtggagatgatagcacacacgcacatagcaaggcctcagatctgctgtgcaacacttgtagaaatagagagaactgggtttgtgaattcgcctaacaatctcctcaaggaggaaaaacctaaaagctgaggttaaagggaaggttttgtttgtttgtttgtttgttttgttttgttttgttttgttttgttttgtaagaattctccttagttctgtgcctccctcgccacttgtccttgctgcctaacagggaagttggaggaaattcctttcttccatgccaaatgaaagaccttgcaagataactactctgggaactgaacatggatatctctagagtttctaaaggatactgggtcagatacaagccagttctacaaaaaagtatcagatatatctggtttttctaggggttctctagaataacagaactgatacaataatagggtatgtgtgtgtgtgtgtgtgtctataagaaagagagggggggggagttgaagggagattttatttactaaatttgctgaaatggcatagtccagaagaaaactgccagtagaagttttcatactggggaggctaagaacccagtcactgctcaaatctataaggtcaaaattggactctgctggtccaacttggcactaaaggcctgcagggttcccaaagagatgttggtcttcttctatccacattgaaaggccacagaagctgaatttttatgtcggggaagcatggctgcaccaaaaacagagcagatggactcacatggaagaaggaaatgaaaaaaggcaaaagcaacagcttttgcttcagacttccttctgcctggccaccaatagaagatgccactcactctggtggagggtcttcctcctgctatcaatccatctagaaaacacctttgcagacctgtccagagcccccttcgttgatttaagacccagaaaaattacttagtgagattccccaagtacaagtactcaagtagaatctgcagaaagcacaccacaatgggtctgatatgggattaggcagactaggtgcccatgttgctgggagaaacaagggaccacgcatgcataggggagatgctagaggggtggggcaggagaagaggggcgcaccctcttagaggcaaaggagaggggagatgggatgctgggtttgtggaggggagacagggaagggggacaacatatgaaatgtaaataactaaaataaccaataaaaatgcagacttatatttcatccaaataaacctggatcccttgattaaatgtgagacccattaagagcagcgggagaattaaagaaatttttgtctgattctttggagacattgggatgggttgggtttagcggtaggagagactgagctaagttctctggttgttagtctgcttgtcaggaagaagggtacagacatgcagaggaccaaggatatgcccagactccatatctctacctcatctctataccttatgtctaagtttctctctccacttcgttgttttccccagttctttgactactgactcaggcaatgctcaatagagccctctcaaggtgaaggccatagacaagtttggggacataaagtgcacaccaaacattatgtagtactgcattctgtcatgagacttgaagaagtgtctctcactcattagtacacactgatttgcagtagtgacagtaggggaattgttactgccatcctcctcttctccaaaaaggctatgcaattacgctgccttaaattggaggcaagaaaaagtgcggggtcacatgtagactcagacacacatagtcacacacagggaaaacagtaaacagccccatgcatcccacataggaggcagatggtactacagctatttaattattacactttacatatttgctgcacacacacacagacgcacatgtgtgtacctctgtgtgtgtgtgtgtgtgtgtgtgtgtgtgtgtgcgcgtgcgtgcgtgtgtgtgtgcatgtacacatgtgccatggtacacttgtggagacaagagaacaatttttaggaattgctgtcctccttcggccatgtgtgtcccaggggattaaactcatgtggtaagttttattgggcagtgcctaacccaatcagttatctcaacagcttaaatgcctctatctcaaacaatcttatttgggactgctagtagctcttcctcaaccaaaacaaaacaaaaaaacaaggtaactttaaaaactacaaaactgtttttttcacatgctgtgatgtcataccatgtttcaaaagtcaactgactaagtcgagggaactttatgaaagtaccattgatgttcataccaactctacctaaaaacctatcatctctactcctcggtttttcctaaacacacacataaatcataggcagtagttgccctctcaagatgcaatgtaaaggaaaagaccatgaggctttctgagtttctgcatcagaagtcttctggagggattttactcgcagttggtgctaaattgagtccacacctttgtaggaatgttccagccccacatcagtgcttgcagacctagagagagagcgagagtctgggcagaagtggctgcaaagggaatctcttccagttctgagcacgtcccttcatttgaacccaacaactcgagcaaaacacctgggtctctctctgtccattgttctttcaaccggcaaaaagcaattttttccataacatgaataatataaaaagatatgtactaatgagatttgcgcaatattggaaagaaggattatgaataggcaattacacttttaggagatttacagatttcaaccagttaagccccagggggtgattatcttattagtcaaaataaatatagactagaatgggcgtgaccagtgaatcccacttttgccaaaaacttgcaaaaaaaaaaaaaaaaaaaaaaaaacaagctctgaatccagagcatgcagagtgagtgttacctatcttggtttcatacacctcaaaagagaggaacacctggctttgcaggctcccatttcacagccacttgcgtggttcgccatgttgccaggctctcaaacaaactgcagtgtctcatttcccatcccaggctgccacttcaccaagtacttcatgttctttctgcccttctgaaatgagtgagttacctttgcctggggcccagtctgtggctgacttctctgtctgtctctgaaaatgaagggaacttcatccctatataatcctaggcgatgtgagcaattttagcccagacgacttcagggagattaaacctactactatcttggcttcctttagtttcatcctcaaaaatggttcttgagggcaggctggtgagatggcttagtggataaaggcacctgtctctaagccagaaaatctgagttcaatccctgtgatctacacggtgaaagagagaaccataggccacaagtcgtcctctgaccaccacatgtgcactgtcaaacacacacacacacacacacacacacacacacaccacacttttaaatgggacttgaggaaagccagttaaagctaggaatggctggagaataattcactggaattgaacaaaagcagccgcatgaaacagtccaagactcttccatcaagagggacttaacattgaaaatgctccttttatgtacttggctctagtctctctttcccagtatcaaaaatcccaactctctcaacagctccataatgcagatactaccttcagaatgggccctagaagtataaagacatgaaattggagcccaggagatggctctgtgggtgaagcacacaagggtgaggaccggagtgatgatccaggagtggaggcagagtgatggtctgcctatgatatcagtgctcagaagacagtcaaggggtccttacagggagctgaatcagtaagctctgagttaaagtactgtatgtggtgaagagcaatgaaagaagatgctcgacatcaaccttgggtctgcacacacacacacacacacacacacacacaaagtctagccttttaacaacggctgagtcatcgttccagccacacagatatttttttaaagttaattgtatgggttagaatattggaatgaagactcaaaaccaaacagcctgatcaataaccatacagttgaactcagttatatctaaattccagtgttatatgagccattcatattctttcacttagcccttacaaccccacaaacatgatggcattatcatgtctttttatacatcatttcttcctttatactgaaagcccagaaatactggaatccaagcaagtgttagactagaagattaatttttctctctatactcgtgtctctctaaaagctatgtccatccagtctctagagagactgggtctgaatcttaaaacggcatggtatgcccttgcactggagatggtcagagaggggatagtggctgaatttcatgtcttttaaaatcattccagtgttctgacacaataggtacagctactgacattctttgatggctgcgtccatacttttcctgaacctcttctggccacgattgtattcactcagcctaaggttgcacactgcctttccttcctagggttcatttccctacagtatctggactccacactctgtaactgttgccactgctgttcctggtgcagctgagaagctgggattatggaacaccttgaaaaacaagtctgaattgtcttcttacaaaacagacatttccttgctcagtgctttctgcccggagcgagaatcactttgttctgacttgcaatgaactgagtgctcctgagacagtcagagggccgccacacccaagctgcacaaggttctttctcatcagatctggatctccaggtgatttggagtttctggcctagctggaacttgatgatccctcataaattcagaatagaagtattgaaaaatcatggatggtcatcagattctaaatccatttccataacagagacagcttcttccaagaaggacaccacaagcgtataataatacctccctaacatctacttagaatttaccgtgagtctctctgctaagcaccttgcaggcattatgtcatttcgtccccacacacgtcaaggaaaattgaaatgcatgctgacactcaccacccacttacctgtaagaaaactaactgtgaggaagctgcaaaactagtccggtctcactagctatgagcagatgaaatgaccgccaaaccaatcatcagccttcagaagccagtctcctaactaaccactatccaacatagctctggactacttcaatattaccaactgctagtatcattttaaagcatgttccttagtatgtccagagggaaggcgtccaaaatccaagcaaatagtcctccctgcaaacatacatacaagtgacatcctatgaactcaacaggttggatttagaaatatatatgtacacacaatacatatatgcagcagtagaaatgaatgcatgaagagttgatgaattggaaagagggcaagaaagtataaatggaaggttttggagaaaataaaatgaagggagaaatgtaatgaatttacacactcaaaaacagacacaaacactgatttagaagttagacaagtccaaaatcaaggcaccgctggagtcagtgtatgaggaggacttacctgactcacagcagtagaccctcactgtaccctcacctgtcagaaggatggaccaggtgcctgggtctcccttgtatcggcagcaatcccattcacagaggtcgagatcaccaggaagggcgaaaatatcatcatacaaatttgaggtgatggagagacactgactacatctacttcaagatgatgcatggagtgtctgaacccacagtgtacaacttgatatccatctcccagaggttgcttttctcttcatgtacatatctttatctagtaatcctcagagttaatttgaaggatacaggcagtacctcctgtgattaaacacatttaataaatttcacttgctttcttgcataaatatacttttaagctatgttttatgccaaaaagaacctaaagtcatcaaagtaaagggaaatttatgtcatatgaatggacaagaaatatgaaagtttataaataaaaaatagggtaatgcagactgttctaactatacaaatatgtagggatctagactccaaattgttttgagacgttaggatcatagaagttttaccccaaagctaccttagaaatgaattttcacaatgttttcagaactcttttggattcttatgaaatctaaaccagagatgggaccaacctttatcatctattcttggtttgttgcctaaaagacccttagcccttgcatggttccccacagacctcatatcattttgtacttagtaacccttggctaatttccttccagagatgaacattttcattctggacgctctgacatcctttagaagatagcaccgttcaagtctgaccttggctattcattcactgtggaacaaagtgtgtttcctactgcctgccttgctgtaacacttctcagctacatctcactgatgtccatacaagggcagtgactgcaccgctgatggatggacctagaacaagagccacatcaaagggacagctgactcgctatgattgagttttccaacttggaaagaccttgtatctcagccagttgtttttttaagcacctggaagtcacaagcagatggtgtaacttgtcctcttgataacaagccaagggatagattaaatattggtctttctcatgaatgttcagccagatgtctaacactgccttcctattccattgtggtaaagtagtattgccagaccctccataatatttcatcaccctggttctgtctttgtagaaggactctgttctctaagcagatctgtgctcatccattgatgttagtggtctggtcaagaagccaatatcagatgcaattctagaaactccccttgccttattcatggactggagatgcagagaaacaatttcacagatgcccatcaaaagtttcctcacactgtctcaaacaccacctgctctatgctgtatctcttcctgccactggagattaaaaaaaaaaaagggtgacaactggctgtccatctgctgttcgactctctgaaacaggttcaacttagggcaaatcagagataattgccatgtccaagtacctagcccctggtacttccatcagtaaaaagtcaaaagcttgccaccgaagaatcatgccagagagtataaggagggaatatatgtatctgggacaggttatggtactgatgatgtatttgggccatgctatgaattagactatgtgtttccaaagtttatatattaaagtctgaatatgtagatgttcagaaagttgtcttgcttacagttattatagattaattcagataaaaggccacctggagtcggttggtgccaatctgatgtaaccagtgttcttaagggaagatgaagttacactgagagatcacgccaacatgaaggcaaaaatctgggtgattattccacaaatgaagaaggccagagattgatgaacaccattagaagccaggaaagaggcatgagacagtccctgtcttatgaccctctaacagactgacccagctttgtctgtgactttacctcagtcttctaagcaccagaaatatgagacagcagatgtctgttatccagaccacccactctgtactattgtgctaaggccatatttcaaattttgagaagcttaagataaaagtttagcaatctgtatactctactagtaggtagacttttctaattcacaatagttaatattattcatattatctaatgtatggttcatctctacccccaaatactacatagtggatatttcaaaataaactaacaacaaacaaagcacactcattaatgaaacctgggtcttcctacaaaattattttgaaagcaatagatcgtggcctttgttgttaggagcagctaagaactttccatgattcaacaggtattttagtgaagcccatgtatattctttccttccttctaagtagtactgtaaagatgctgtgtatagacactctgacaggcatcaggggttcagttgtgagcaaagcaagtagctatcacctttacagtggcttgagttcagtgaagaaggaagatattaaccaaccaatcaaatatatacaaccattgactgtggtgagttcagtaaaggaaaaatgtcaccacctctgtaggatataacttttcccccaaccctgggattgtaggcaggcagaaggagacttactctgtatcctagcagtaagacggtaacactgttaaattctcccactatcaaaaaaaattgtaacaacaaatatgacagggaagcaatccacccaacaaaacaattatctaaataaagcaaaggcttccaagcagaggagatagatgctgaaagggatgaggaaaccaggggacactaagggagctaaaggaaaaggagactcagaggttgatgctgaggttagaatctccagttaaggatgctagaaaaagggagtttggcatccacagtgctattacatataaaactgtatacaactactgagatcttgcccccactccaaagaaacctacctttgttgctggttctgtcctcttaggctggatcatgactgctctaactacacgttctctgctctaggaagtcacatgcacttttgcttgctgctgaatggtgtagctggtaaccaaagagattgatggaatctgctgaagagatggaagaaaatacatagagtgaatgctcacccctgcaaacaaggctgcctctcacgggttcttcatcagttacattcaagtcgcctctcagatcacatgcaaggtcttcctgcaggtggtgacacagccaggattttcagaatgccagagtgaatcccatgccccgggtctgcagctgctgcattgctcacccttggttgaatttaacaggataaattgttcccttagattttccttttacacacagaagtgaattacactcatatcttatccgttgacgtctgcaagctatcaatggactgaacaagggtgggaaagagatagagaggggacagtcattgaatgatcatttaacccattggtaatgtacaacttaaggataaactttaaaatcctaagtggcctgggaaaaacgtattcaaaagtactaggaaaatcatgaatacacccctctacatgtatataaaaacgtctatctcctgaaacaaggattgtactgatacctgagggttaaaaatgataagcaaatgatgaaactgggctaaggatgacatatagtaaggaaacaaaagcatatcccagaacaggattctacagcaatcatcaatttggtcttggttaagtctggatgctttagtgtttggctataatagttataaatgtctaagcatccttaggtaactagttatattaatgcagggctagtgagattgctcagtgaacaagagcaactgctatgaaaacaagagaacccaagttcaaattcccagcatccatcaaaatgctgagcatgactgtatgtgtctgcagttccagggttagtagagcggcaatctcaggagtttgctggtctgccaacctagccaaagagtgggtgagagaatctgtctcaaaagaataaggtggagaccaaaggaggaagacatccaatatctctgctggcttccatttgtgcacacaagtatagtgtgttactatacaacattcaggaatcctcagacattaaaaataaattaaacaaaataaatctatctacatctattcaatgcacaggtaaatactttgcagataaaagtatattttaaatgcttttatactgaataaggacaaacagaaagggaggaaattaaatgtgggatgctatgagtatgggcttcagtggctgcttacagggggacatcagtgccagccacatctgggagcaactcagaaacacaaaaagtttcaaacctcatgctagacctagcaaagtataaactattcagagaactcagcaggcatggtttgacaagctctctaaggagccgtttatacttatgagaaggagtgagttggggcatgaacactcaagcacagaagagagaaaagcaaaatgagcaaactatcgtcctctgagcagcaggatcaagccggaactgcattgtcttggggatcatttacagactgatgctgacgtcagcaagcactcaccggtctgaccaaggatgagcaagaaagaggggacagccatttaacagagatcatgttgagtggttcttcgtgcaaattggtgacagataggctccgtggcctcctgacatctgcagagtttctacaagtttgttacaaacagcgttttcatccccaagttctttggagactaaaataagccttcgactcgggcagctggggttcatgtggtctggcaagtgcttggtatgactctctacacctgaggatagacattttccttctgaatcgctcgctgagtgagacgaatttgaaaaggaattaataaaacacattcttcgaggttggaaaaaaacaatataacttctctggtcacaaagcagctaactcagtatcagtcaaggagatacaggcaagaaatacataatagctcaatatgtaccaccctcccttccctccatgactctaaatatctagggaaatttccaacaggtcactaagcaaagggaatgttcaaaggatgaacggttcagacgaggaaaatgcagtatactaaaaacaggccgggtgtggtttatatcgtctacgtctgaatgccactgacaatttccaccttagctcccccaacactgtgagaatgtcctgacttcaggtgggtaacgaggcaaggtttgatgtgaatggaagtttctcctgtcttttcacctccacttagcagagaccacaaaggaactatatgcctataaaagtgacatcggtttgccagttcaggttttctaaactgaggatataagtgaatgttttggaaaaagaaaaagaaaaaaagccctaagtcccaaatttggtactgccacacttcagaagcagttcatttaacagaatatgcatatatatatatatatatatatatatatatatatatgcatgttgggatgcttttaaatttttttctcattttgatatggctaactcgatttcaaatctttgtgaactttatcccttttctactaataggcatttcaaaagatttttttaagggacaagtcaccaaattaatttacttttaatgaagagaaattatttcactgaaaaaaactaacatatactcagctaagacccaacacagcacacatctagaagctgactggaatattctttaggaattttttttctttctctttttcatttcttcttattatttatttatttttttattttttttagaatttgtttttagtgagggcggcagtctatagctctatctgtgccagaacttttgagggcagtaggaagaaaggtacaaaaatagtaatttaatattttccacctgtcgccagggctggtctcatgctggcaaaacatcgataatgcttttgacatgcctgaattctgtacctttgcctgtcttctacttaccaccaagaaacctgtttttaaggaaacaattgtttaatccagcgcgacgttcgttccaactttatagatcatcagtttgagttgagggtagtgtgttcccaacttcaaaactaaagtggaaaaggctctgggtcaaaaatcccagagggcctagcggctgcaaaggaaaaaaaaaaaaaaacttcctcagtgaagatctcgctcccaaggcctcccaggcaaagttagcccatcgagaaaggctaaatttcctttggatgttaaaggagccaggcattttttttgagttggcatatagccagtgttgttgtcctttgcttccttgactacttaggcaagaagctgtgtgagaaaatatggagctcaaataccccaggttaatgaaaacacaggtcagacagttgagttgccacacacagtcaggagcctccacttcctgcgggggtgtgtttctttgcttctgcagtctggatttcttgctgtccttgttcttcatcctgtctttttctttccaactgaacaaggtttgatggtgattggagccgcgtgggtggtagtgttttcggtttggtccgttgtgtgaggctgactttccgttcctctccttcttctgtattggcattgtccgtcctgtgcttgaagtgtgtcagacccggttacagtagaagcctttgagagacagacgtttctaaacctccagacaatgattacgtctctcaagcaacacacatagtacaataggcctcctgtataggcaaaattatctgggcaatctgagttagtctgagggagtctaagcatgtgtggtttgagcagaaaccgagttcttgacacagcactcacgggagttttgttccatacattctgcttatgatttgttaatttacatggaggtaccacattcagggatgttttcaagcagacctcattttgacctgtgtatcctctgccattgtcatgaacatgttcaaaaggctgcacatatgtctcggaagcatgttattcacaatgtttgtctctgtcactgtgtgtccccatgcccagcttgcccccagcacattcaagactgtagatgacttcaagttccactgaataaagaatgtactagaatatctatttcacagagagacagaataaaacaatagtaataagtcatttccttgagcaacttaaggaaatattacagccaattttcttacattttattcttaggcaaagtagaagtcacttgttcaagtgcccaactgtaaatacaattggaatgagattccaaaaccatgaaagaggacatttacctgtgtgtccctatctcactaatccttcgccgttagcaatcatcatagaactttaaaaatagaaatactatattaagttggacaaataaatacataattaatttctattaacattttaattaaatttgagtaggccctagagtccattagcggggttttgaggatttttgttcaaacagcggtgaagctccataaagtcagcctatgagtaaacataagccagttcttgcacatggcagagcattatcttcccattgtttccctttccatcttgtaggaaacataagcatagacatgttcaacctactagacccaaggaaacaccacaaaagtcaacacagttctggatctttatctggctaaccaaacctcatctcagtttcttttttcagacgccttccttgagagtcaaacactttgccttcaaggttaatctgatcaaaataatggtggctacccttgcagtgagcagatagttgagactactgtgatctatgccacccccagacatttgttagcatgtccctataacaatggtaccatctgtcatctcttttctcctcagataaacaatgtgacatgagagctgtcgcctaactagctgaggaaggagggagccagcagtcccccaagcctattctcctccactctgtcaccacagggcactacattaagtcatcgttaacttcttcatgatctttcatgaagaaatttattaggctataaattataagagaaatctttttcttaatagcagaaaaatataaagtgaccatctaaggaatagagctgttcttgggaggagtgataagtgaaaaggtcctttgaacgaagagtggtagaaaggagatacatctggctgaaactgtggagaaaataaacataatgaagtctactgtcagagcaagcattccctggcagcgtactgcatgcattcatgtcccgagtactccacatctcaatttggttcaactttcaaggccagagaaacatttcaaagttggagctatttcagagaaacaaagatacaggaatataaaagcataaaagctcacgaaacaacttctgcctgttttacagacacttctttgtggacatggctactttgaccctacccagacacttttccagtcttgaaaacatccctaaataaagaacttagacaaaggaagagatatattgtggttggctggacctcactcagggcaacttgggagtgcttctagaagagaaagaatatgaaactggaggtgtatgaaaatacaaaggtcattattgcttattgttagattgccttatatcttgaactctttaaaaagcatatgatcatgtgaacatgtcacaagagctcttccccaagacttccaagggcttgtgcaagcaatgggcccttggaaatcttacttgctttctggagcaattgcctctgagagcaaaaaaagagcatatacctaacaggatggtggaaagaaagggtttggagttacaagttgaggacctctttcaaattaactaccaacagcccaacagttggaactaggccaggtgtgtggctcttggctcttggctctctggaagaaacatatatgccacagctgatcatctatttggaggtccgggccatgtcaaccagtttaaacatgaatcaggaagtgcttaagctactgcaagacaaagttgcatattgtttcagtcttaaacccctcctgggaagtagcaactatgtctccttctgaatgtgtcaaaatatatcagagggttagataaacaatgcctggcatttgccacatttctgttctggtatttgacccaaggcatagggcagggcagggagaggcttggtgagaccaggcccattctattacatataatctgtctgagagaacagaattcatctcttgaattgctatcccatcccaggctccttggtttctcaatttgagatggacacttttttttcccatccacctcgtaaaaatccacgtagtaagaattgaacacaggaattaaaagaaagcatttaagaaattacttcataggacatcccatccaccacactaccatagaagaatgacagaaatatagatacaggaatctaagggacaagaagaagctcttaatggctttccttgagtctgttctaatgcaaagaactgggagagctttcctttgaaagcaatctggaaatgaaagaaaaaaaagttctgagactggctgaaatgaaatttttcagatgccagacacaaactggactccttctttttgcccttggactggacgactctgaaggctgcagagattgaacccttccctgctgtttgcttgatttggtctgagatggagccaagagatgtggtgatgaagtttggaaaaacaattaaaaagaaatgtatgtggtggtttttctgggatcctaattagctgacccatttctaggtaacattagggaagttgtgggcagtgattattatctctttaaagtcctaattaaaatgtcaaactgtaaggtagaatgtcttcaaagctgcatgtaatttgattgtgttggcttgttgaaaaaatggccttggaaatacaaataagccagccactaaaaagatcccagaagtccaggctgtattccagaagcatagtctgttgacccaatagcattttataactaaccactcaccaagtggtaggcatccaaatgtcaaagccagtttcataacacggtaacacatagcatgctgtggatgggtgtctgccagaagcacgcttgggtttaaagaaaaaaaaaaaaaggtgtgtacaggttagtctacctagtcaggcttacgtgcatattggccagatttaaatgtgctccttggatgagcttcctaaatgcctggcaccctacccattctctaaatgagccggctggagtgccggatctctaaaaggatgtctgcatactatggagagcttctgttactatacaacatcaggatcccaagagaaaatgtgtcatgtctcatctatgcccgggcattagcaaagctatcctttacctgtgacggtgaggcgtcaagcatcaggcataaatgcatcgatttttaaaaataaatttaaagagacaaggtcccgaaaattttggcttaagcaagaaagacatctgttgctgtaaaacaggtctagcagttgattcacacagtctctcaaagacatcaacaatgaacaattttgctcccattttcattttgcacacgtccctttcagcgtgcctgctgctctcattatcactgtgtctagacagctctcctatcaccggatctaaagggagggctgttatatctcacgaaagtcctttgtcctgtcctagaagcctttccctggtattctcatcacatgtcattgtccatagttgtatcacatgcccattcttgaatggaacactgtcaaagaaaactgtgaacaaccagactagcttgatcatcactaacatccaagcccactgctaaggaaagttacaaccttccaaactttcaatatccatatttgccacaattgacatctaaattaaatattttatttgtaaggaaaacagtggaagcagtcctgggtaggtaaccagtgtccacccaataggtgagatgtgtgttatagcaatgtaacagggtctacattgaattgtttttccattgatatagagatttatactattcattcatattttctatttatattcatgcccatttattttttttaatacttggccaagacttttggccatgaataataaaaagaaatgaattttgtcttggcttatatctatccttcagttcgttattggcaaatctgcatgacacatctacttggtggcaggctctgcgctatatagatacattatcagaaggcatattctctaatatcagaaagcttgtagtctagttgaagaacacattaaggcaaataggcagagtcacagcaccttgatggagaagtacactacaataaggtactttagtagagaacattagaattgctttgagaatacaagtcctagaaaccagagacacacacacaggagatggactacagcctgtcctcttggcttagagattctgatgtgagaataatgttaaaaagggaacaagatttcaaagacaactttgatgtgggtctccaacctccatacttattaatgttgactggttcagctaacttctcaatccttgagacttggagactgcgaaaacaggaattcttaaatgaggatacatggatttaattttaaagatcactgaactcaaagaatagaaaacaactacatctttatacctattcatctctaactgaagcatcccttaaataataagaatctgagacaaaacaaaggacagcatagaagtattatcattatccatgctgttgtcaaatagaaatggcagataattcatactaaactaaaactgatgcagttatctcatagaattgctcaaaatcaggcaccttcaagacttccagctgatagacttttgtttcaaaaaaacattagtttaaattatatttatgtctttcttttgattactttgtttaatattattagttccttaaggttttttattttgttgttgttctatacattgtactttatgcaagtaaaagcaacagagacacgggcttgtgaatcccaccatactagttgggctgtaatttcctgagtcagatagcctctgtacatgagtgatctggaacacatatcaattaaacttttgttgcaattttgtaacctgtttaactaaaatttttagtggtgttatcattcttgtaactctctcctctctctctctctttctctctctctctctctctctctctctctctctctctctctctctctctctctctctctgggaaaaggagtaggagttccttgcatctagagcttactgtttcctttttataagagctacagggtaactggaaaatataggctccctagtgattctggccattttttttttcccttcacagtcaagtttgggagcttcttaggcacttatttttagacatgttatcatcaccaattataggtgctgatttgattaaatgagacactgttggatatcatgcgttgctagcaccagatttcaatattgtatttacatcaagaatatgcctaaaccaatttccaaaccacatgttggtttgtctattacccgaaaccactggtagaaccaatttttggtatcattcagggtccaaacaggagacaggaactgtatctgttatttgaatacatgaaattgaatattcagacaatttagaccaacatatttgttatttaaaatattcaaaacaaggatggctgtaatttggcggtagaatgcttacctagcaggtataagactgagtttaatctccagctctgaaaaaatactttttttaaagtctagattatatcccttaagtcggtattcttacatattttgaacaaaagtagctgtgatagatatttttggctttgtagtaatatgatgtcaaatactgcactcttcttttgctaagaaaaaagtagccataggcaatatggaaattagtctgcccatccctgcatgaaggtgttgtggagataacacaaaacatagacaaatgctttgaggagcaaagagagaagttgggatgtttgagatttagaagcctacaagaaatgtcctgtgtagcttgtggtgatttgaaacaaaatggctcccatagtttcataggaagtgacactactaggaggtatggacttggagcaggtgtgactttggtaaaagtgtgtcactgggagacaggatgggagaggctttgaggtctaaaatcctgaagccagatatgtgacattcacttgtagaatcctcagatccttctccagtatcatgtctgcctagtatgccactgtgcttcctgctataacaataatggagaaaatctctgcactttaccccagtcccaatgaaatgctgttctttataagagttgctgtgatcatggtgcctttccacatcaataaaaccctaactaagatatagctgaactcaaacttttaaagaggggtgctggccagtgttgatgcctctaaagagagtatgagccagttattcaagtgtgggcaaaacagcaaaatggtttcaggtgtataaggtgctgttcctgttacaggggagtactgcccaaggaaggggaagcatttccttctccttgcaattatgccatgccttccgctagtgcctcctactggtacagcctatcttggaggcacttgaccgggagaaaatgtggcctaaaatcctagcctcagcctcaggataatgactttggaagtgtgtctagaactaaaaacaatagttcattaaatgctgtataagtgctttacaaacttctaccaaagaagatatagctcatataaacaaggtaagctagttcaactttcctatgagctctgatgactaaatagcctttatgtagacaatgtgtacttcagggtagttcattgtttacatgcctaagccctggaacagaaccagaattaatagtaacaccctcttgcctgaaatgttagctcctgtggctgcagttagttggtaaaccctggtgtgaaaatattaatggaaatcccagaaataaatagctctgaagtttcaggttgccattctaagtagaaagatgaaatctctcaaggtttctctctgtctgacctggagtgtaaatcatctctttgtctgcatatccccactgtctgcaccacctgccctgccacagttaggggagagaccacattcacaaactttcattacagtataattactccattttattattagttactgtcggcctcttactgcatccaatttagaaattaaacttttgtcctaagtttgaacacctttaaaaatgctgcaaagttcagtgtattgtagagttcaggcatttccccctccccctatactgtccagtctttccttgaaaataacgactgtaaagtagtcaaagtgcagtgaggtggtccagtgtgtaaagatgattgctgtatgcctggtgacctaagcttgatccccaaaacttacattgtagaaggagagaaccaactcctgaaagttgtcctctgtctttcactaacacattatagaatttatgctcatatacaaagcaagtaaataaaaatttgtttgtttgtttgtttgttttttaaaaaaagctggatggtggtagtgcatacttttaatcgcagcactcaggacacagaggcaggaggatctctgtgagtttgaggccagcctggcctacaaagcaagttccagggcatccagggctacacaaagaaaccctgcctagaaaaacaaagacatacagatggatggatggatggatggatggatggatggatggatggatgagatagatagatagatagatagatagatagatagatagatagatagatagatagatagataggtaggtaggtaggtaggtaggtagatagataggtaggtaggtaggtaggtaggtaggtaggtaggtaggtaggtagatagatagatagatagatagatagatagatagatagatagatagatagatgaataaatactacaatcaataaagacaataaaagcataatcaattttttaagagaagcaggcaccaaggctgaggcagtttctcctgagttcattgttatccctctgggtagataatggtagtttcacagtctcttttaagcctgctgagaaatttaaattaatattaaattcagcacagaatttaaatgaagcaataatgttctaactgtagatgcctctctgctttgggtagcagacatggactgaagatggaagaaagggtaattaggaagatattttatttatggagcctagtccctgtccagaaggaccacacattctgtccccttggatgatcgccactatcaataattatgagaattctgagaaataaaagaaaatatgacatgctccaggttagtgcgacataattggagggcttatgcaggattcctggtttcggtttccctggggtgttttcaccaattgacagagtgtataatataatactcggatttttccttcccatttctgtctttccaagtctttggagagaaaagaatcaaaaaaaaaaaaaaaaaaaaaaaagcttacaaaactcctattactgtctttggaaatcatctctgactagcaccatcccgatcttgctcattcccctatacttggcatcctgatgacatgttctcatttaatgggactccccttattaaccatattttcctgtagaagactctcaaaacagttccactgtcaaactgtttattatgtggtcaggacagcgaaattaaactatatgtaagtagtgaagtcaacagaacataaaatgaactgatttatttttcagtaacctagtaatggatcttccccatatagtagactagattatatcatcctaaaatacaactataagagacccagctgtgctacccaaaatatacctcattggcataaggattatgtttttctacttttatctatacttattttatactgaatttattcccatgccatacttttttttttcttcagtttcttctgggagatctttttcttctgtgtagcctccttttctggctttggaacaatctgttccattttagtgaggatcatataaatgtggcagggggagctcatatatggggttaatctggtggtggccaaatcagagtccagactttttgctgcacatgcttaaaaatgcagagagcaatggtgaacataaggtttgagatgtagattccctagtcattgaacacatcccagtgaatgaaggcacccaagatgcagcggcaaacttacagagcacaaggattattttaagatgattgtctagaggacatgcagttgtaggagatctgaaaacagaataatggtagctgtacataaaagcaacatgcatccgtaatggaaaccaccattgcgaagatgtcttcttcctctctgcaccagtacaaggccatacgaggccagtactagagtagtagaaatctcacattatagagaaaatagcaactaaaaatctgttgaataagctttcccttggataccatacttttaccaaattaactctctttgttagtttgaatgaaaaaggcttatatattatatgtatgctcaaatgcttggtccctggttagtagaactgtttgggaaggattgctgcggagaagacgaactttaagatgtcacaagcccatgcgaggcccagtctctctcttttatatgctgtctgtggatcagttcataagctgtcagccactgctttagcaccgtacctggatgcctgctgccatggtgatcatggacataggcatatcctctggaactataagcaagccctccatttaatgtttcattttataagtttccttggtcatggtgttccatcacagcaatagactaaataactaaggcattctccagcttcgcttcctccaacatcttcatttctttggctctgttgaagatggcatttaaagctgaacttgaagccacttctttgagatttatgcattttccctatatctctcatacatccataagaactccagtctgtctttctcctcataatctgttctttttcatacaatccatctcaagtagaaatgcagagtggtagagagaagtttattttttcctcatttttactggtgacaagaaagcaaatcaacattcacacacacacacacacacacacacacacacacacacacacacacactgatgtgtgtttagaactgaaaacaggaattatgctgggcctcaaaggatttgtaaaacctaatctgagagaagaatggcctaaaaagagtagagaagcacagaaatcaaaacaagcttgtaaatataaggtagatcaagggctaaagatgtgatagaagaactgtgtgaaataaggttcttgacagctcatagttgaatctgaaacataagtagaaagtcatgaacttgaagcaggcacatcaaatcaatggtgcgaaactcactaaaaataaaatgaagaggtgggttatcagtgtaacgatattagtggtctggtgaaagtatggcaaaatttctttctgagattcataaatgggcctgatattcaagtctagatactgctagatcagaatcctcattgcactggatccaggagaataaccagggggaagctgagaatccagacttgtagatcactataaaagatgcacgccagtagttgatttgtgatgatggtatcagcatctttgatttcctccagtccaccagcctttactgtgtcttttcacagccttatgcatggattgcccgggatgtaagcaaagactgcaacacaccaccaaagaggagatgaacatgttttgagtggcatgcatctcctggtaacctgtagctttctgtaatttttttcatcgtgttattgtaatgaatacatttaatttttttaaagatgtcttccttccttccttccttccttccttccttccttccttccttccttcctttcttccttccttcctccctccctccctccctccctttttctttcttctttctttcttttctttcttctttctttctttctttctttctttctttctttctttctttcatatgagtacactgtagctgtcttcagacacaccagaagagggcatcagatcccattacagatggttgtgagcgaccatgtggtttttgggaattgaactcaggacctctgaaagagcagtcagtgctcttaacccctgatccattccaattcacatttaattttttgcatagaatattttgacatctttttgaaaaatggatagactggctttccagggactactcaggtattagagacaactaaaggctcagatgtgatcattcatgtctttgatatctaaactaaccaatttatctagaaccatatctctgcccagtccaaacatctgagggaagtaattctcttacttgatcattcagagccaggtactaggcaagcaagagccaccctatagctttgaagtcatccaaactcaactcttccaacttattcatttggccccaagatgatggtgaatcctggttgtcaaactgactagatcgggaatgaactacaaggcaaaacatctggcatccccatgagagatatttggatcagattaattgaaatgggaagaatcaccataagtgccgggaattctcgccaatgtcaaaaaataaataaactaaaataaaataaaattaaaaaaataaatgaaaagaaactttgctttttgcctgctttcctcactcttgcagtcaacatcaattctgctgctgctgttggttttgtaaccctctgacgatcttatagccagcatctttagagcagcagctctctttaagccttaaatactgtattgggactgctgaggtatccagcctcatgaactgaacaattaccatattccagtcttgtccactgtaaaatgaccatcattggactgccggttacaacaatcagatgatatctgaggaaaagaaagtttatatttacaattcaagagacatgattcatgacatgttatgtggcaccacgtgagatagacacagtgtcataaattattacataataatttgtcagcaaaatgtgtttgtggacatatcacctcatggaatcttattctttttctctaaactaagaaaactaagagtgtgctccactttatgaaagagatacttgaaatcatatctgatcacatgtgctttatatccaagcccccacttcacttggggtatttggctaaagatttgataaaacatacttgttttaccaggtcctgcctcatcacagcatcaacacatctactcacattatataggttaacattcattgctttggtctgatattagttttaagtagtttaactatataagactgcatagtagatgtgtatattatgtttctacaaacatgtttttatctcattacaaatctaaattctctgattcaaagcccttgcattaatcccagagcagaatttccattttatatttcaataaatactagcaaatgagctcctcttttatatgtataccctacttgctaaggaggtgaggatgaagttgcagatagaggtgtcctgacaagatgttatgcatcagaccagtggaatctcctaaaaggtatttagatttagtgagtactagtagataaatgatatagtcccatgaagtcgttggctttgaaatgatacttttataaaccgcctttagagagttctttggaaagcaacttgaaagtcacatataggccaatatgaggaccaagtcatctatttaaagacaatgtcatagttaaaaggtgcatagtccaccatgtcaggaaatcatggaggcagaagcttggggagctggtaacattgtgttcccagtcaggaagcagagaactatgaatgtttatgttcattttaccttttcctttttgtttagtgaagaaccccagcttaaagaatggcgccacccacagcgggtcctcccacatcaatgaacagagtccattcacaagcatgcctaagaggcttctttctaaggtgattctgtcaaatggcaatattaatcatcaggagttgaaatagcataaaatcttagacatttcaaagataacaactattattctgttccatttgtttcctcgtgcacaacgattgatagtgaggctcctttttgaagaattacatagcacatgtctatctattatcaggaagtcacagccatcacttcctttggacagtaacttgtgtgttgttcaggaagggtctaaagcaaaaggttgaacttgatgtggtgataaagagaagatgagatggcttaatgtttgggcaggttgaggctagatttagatgaaccttagctaacattcataagccccaagagttccatgtaaatagtagcaggccccaggactttagggaatattggacttgttggtagaaaccagattgaaacatcccacaaaaatcttcttggctgtagattcctcatatgatacctgtagtagaggagtcccaaaaataacacaggaaatcgaccaccactctgtggtattggaacctggggtcaaacttactttaattatgggatagcaacattatgtgattgcaaactacaatttaaactctttatactctttttcatgtttacttaactctaggaggagaacaggccccagaataattatatttatcccttccttttttttctttttaataatttgttaacacataaattcttataatattctacaatagccaaatgcttaacttaaaaaaaattagtcaccttttcttatagtactaacattccacatgagaactactttaagctgagtcccacttttcaaaggaactttatctaagagtacatgagatttgatgtgatatttccttcaccttgcaagagaatgtcatctgtaattttcaaagcaaaattttctacttctattctctctttttcctctatgggacaagaaatgcaggcatttcctacataacatggatctatttttataattctattggttccttctattactatagttagaacttgctttatccaaggccatccatgttttctattaatttttttgtatagtcttcctgaaactttaatccttttcttctgttcaaaatctcttaaaactattttctcactatatatatatatatatatatatatatatatatacatatatacatatatatttagtttttaactaaaaatattttcttagtgtccaatagataccatagctataaatatactcttgacatctccaagctaagtttgtcttcttgaggtgaatcctaaataattccccttctacaaatatcacccctaagatgtgaatgctgaaggtcagaaaattctgagacactgagcttgagcttctcctaagcacccacattccattagttgttctccttcactatacctaggcccctcttcatgtcttcccaccaggctcagatgctcactatacagagaggctcagcttgccaaactgtgttaaggtaacaaactaacttttaaaattcaccttacagcaaagcaaagagacaatatgaagaactcggggcaaaaaaaaaaaaaaaaaaaggatttccctgagctaagattcctaggagtaaattgctaattttggtaggtctcctggatgtcaaatgcagcccttagaatagttcatgtcttagccaggcaggccattcttctgatctactgttctgtgtgttgtaaactcaatcaacaagagtcagttgcaaagcacttaaaaagcactaaaaacaaactgaataaatgaaggcaggccatagtcatggtgtgagagactcaatgccacaacaatgtattctttccaaatccatgtacatattcagtgcagtttatcacagtagcaacatgtttatggaatagaatgaggagtgggcagccacacatgcaaaagcaaagctttcgcacaaatttttgtaacaatatggtgtacacagttatatccaaaatgtccttaaagaaaaagaattgataatggatactaaggaaggtaatatatcaaaaagtaatctgggatgttaaaaaacatttcaagatataaagtataataaaccacatatattaaagtatatgatttcttaggacctgatacatttgtaaaaccatccctgtccaaagtcttccttggggatagagagaaggatcaatggttgggggctggctgctctcgcaaaggactatgggctagcttgctatctcctataactccaaatccagggaagtcagcacctttctcttacctctgagggagtctacacttattatgaacacactaacacagagacaactaacacgtgttatacacaaacaaaaattaaaatctaacaataagaaaaagtcttttcacaagagattgtatggatctagatcagttttatttctctctagatttaaatttattgaaattacatagagtgccaaaattttggacatgatgatttttaaaatatttccccactacagcagctgcctgcggctcttttcttttcttgccaatagtgttcccaagtgagatataaagtggaagaaagaatttactttggcttctggtttcagagatagagttcatagagttcagaatggcaagggaggctggcagcaggcagttgggtggggaagctaaaagatcacatctttaacagaaagcaccaaacagaaagagcaaattggaatcagggtaggttgtaaattctcaacttacttcctccagcaaagttcctaaaggtcacataacctctccaaatagtgccactaacctcgaactaggtattcaagtatttgaacccaaagaggacattgctctttcaaacagccattatcatctacctcagtaacagaccaatgagagcatttttattatatttcctatatacttttattatcattatttcttataaattaagtatcatttttcaagtcttctgtgttatatatcattttatctttaaactagtcttatcagccattctaatttcatccagagtaactgaggcatggggacagtataagaaaagagtaagttaagtggtacaatggagcagagctgagcagcagactctggagacctaaaccttggtgttctacccatcttcttgttccctaaatagagatctctagactagcttctgtaagtaacagcgccagcaaggacagcttagctgataagatgcataaaaagggttcagcaagaagtagctcaagtagaggcattacaccaggaccaacccgtcattcttccaccatttaacttgagtccgttactcagttaaatgtctgtaaccctgataatccaatatgagtttgaaatatttgatatttaaaagcataggaaattaatattaaagtacattcagagtttgcaccaaaattaattttgtgccccattaccgatcagatttcctgaaaacacactaagacatagtcctcattgtctttaaaactcactcaagagaacacacttagtacttcacccagcatcaatttgttcatctaccacatgggcattatctggaggttagcagtttgacattttgatgagtgatgcctgctcgcctttctttagcttatccttttagctctcatgttttcttccacacagactgtgttaagtgttccctcttcaacatgacttacaatgtgactgtgaagttgctgagatacactacacacacacacacacacacacacacacactcatacacacacactcatacatactcatacacacacacacacacaagtgggggcacctacaatattctgaaatcctttatagaaaagcttgtgagcttattcctgaacacaattaagcctatgataattcatggtgcacaccctttcctcctcactcatcttgtaataaccagatgttagaggttcttattttaagctaagttgggaccccttgccacatgcccttgcacgccacatgacaaaaatcagccttgccagttgcatcttgctccactctcatcacagttcaggattagtgcaatgaccttgtctaatttgatggcacacattcctgtctggagtcttattctgaatggtattagcagtcagatgactgtaagaaaatacttcaggctgtcaacacgaggcagctgggagaggaaatcaccgttggctttttgtagcagaacagaactggaaacacgatctagccttgtgggaaaattaagacagcaattggctgtttcactggctggaaaccgtcaggtatttctcaaatgcctccattccaaatggagggcactgtgaccgactatggccacttcttggatagaagaaagaattacaaaggaaattagctgaaatacagtccttcctcccatcaggtttatttccctgactctctatatttaggatatatgacatcactcacctctccctcagtaacatccacaagtgatacatcagtacagttctcagtaccaccaatcaacactgtgtggtctcttctgatgaagaattccccagttcataaatagaaatggccaactccatctctactttccatgacgcggctcttagttaaaatgaagttatcctcctacttcacagagaaaacggaagccttgccaaccatttcctaacagcaattacaccagatgtgcactaatatacaatattcccctctacagtgagaatggatgctgttttgttattattaatgaggataatgcctctacctgtgcttttgacccctagaacatcttaatgtatatactacaacatatttcattggtgtattatcttaaatatatccaggtaatctcatcctgcttctctgaaatgttctcctatgtgtattcaatctaaaccatgatgcatatctgtctcctccaaccatgttatctaataggaccctctgctcctggagatgaaaactatgagaacaatactcccaattctctttccaaccctcctttctctatcctcctctcacttgttctcaggaaagaagggatacgttactttattggagatctagaaaaagacattctactctggttctcactcttttatttccctgttcaaattctaaaggcagatgcattctaaaacacattagaataaacctagcacattcacaggctagaaggtttaatattgctaagatttgtcttaaattaatctatagatttctttcatgttttaccaaaatacaagttggcccttcctatacaaattcaaacccaaatttacacacatacacagaggaagataccagcttgataacaaggagctagagtataccgttctgaatttggaagttggaggaattacgcatatctgaagcctaacaaagagccacagtaatcgagatggtgtatcagcacagtataccagatgtctgcaggcaatagggagtaaataataaatatatctaaaactagataaatgcaacagaactaaaatatagaaataaaattttacatgtggggatgacttgtttttcagttggtgagtgtcaaggtagcaaaagttgaagaagaggaagccctctgacaaatggttcctggaagagctagttgcagacacagcacatataaaaattgagtccacattgtaccagagaactgagggtaatggggagtaaataataaatagaagtataagtatgatacaggtaatctaaaataagtttttattatactatgatattcttttaaagatgacaggcgtcctcaacagaggaattgatacagaaaatgtggtacatttacacaatggagtactactcagctattaaaaagaatgaaattatgaaattcctaggcaaatgaatgggacctggggtgcatcatcctgagtgaggtaacccaatcacaaaagaactcacacaatatgtactcactgataagtggatattagcccagaaacttagaatacccaagatataagatacaatcagaatggctaagatcaaaaactcaggtgacagcagatgctggcgaggatgtggagaaaggggaacacccctccattgttggtaggattgcaagcttgtacaaccactctggaaatcagtctggcggttcctcagaaaattggacatagtactaccggaggatcctgcaatagctctcctgggcatatatccagaagatgtcccaaccggtaagaagaacacatgctccactatgttcatagcagccttgtttataatagccagaagctggaaagaacccagatgcccctcaacagaggaatggatacagaaaatgtggtacatttacacaatggaatactactcagctattaaaaaaatgaatttatgaaattcctagccaaatggatggacctggagggtatcatcctgagtgaagtaacccaatcacaaaggaactcgcacaatatgtactcactgataagtagataatagcccagaaacttaggatacccaagatataagatacaacttgccaaacgcatgaaattcaagaagaacgaagaccaaagtgtggacactttaccgtttcttagaaatgggaacaaaacacccatacaaggagttacagagacaaaatttggagctgtgatgaaaggatggaccatctagtgattgccatatgcagggatccatcccataatcagcttccaaatgctgacaccattgcatacactagcaagatttcgctgaaaggacccagatatagctctctcttgtgagactatgccggggcctagcaaacacagaagtggatgatcacagtcagctattggatgggtcacacggcccctaatggaggagctagagaaattacccaaggagctaaagggaactgcaaccctataggtggaacaacaatatgaactaaccagtacccgggagctcttgtctttagctgcatatgtatcaaaagatggcctagttggccatcactgcaaagagaggcccattggacttgcaaactttatatgccccagtacaggggaacgccagggccaaaaagggggagtgggtgggtaggggattggggggtgggggtgggtatggggaacatttgggatagcattgaaaatgtaaacgaggaaaatacctaattaaaaaaaaagatacaatttgctaaatgcatgaaactcaagaagaacaaagaccaaaagaccaaagtgtggacactttgccccttcttagaattgggatcaaaacacccatggaaggagttatagagacacagtttggagctgagatgaaaggatggaccatctagtgactgccatatccggggaacccatcccataatcagcctccaaatgctgacaccattgaatacactagcaagattttgctgaaaggaccctgatatagctgtctcttgtgagactatgccggggcctagcaaacacagaagtggatgctcacagtcagctattggatggatcacagggcccccaatggaggagctagagaaagtaaccaagaggctaaagggatctgcaaccctataggtggaacaacaatatgaactacccagtaccccccagagctcgtgtgtctagctgcacatgtatcagaagatggcctaatcggccatcagtggaaagagaggcccattggtcatgcaaactttatctgcctcagtacaggggtacgccagggccaagaagtgggagtgggtgggtgggggagtgggtgggggagtggggtgggggacttttggggtagcattggaaatgtaaatgaaataaatacctaatttaaaaaaagagtaggaaaaaaatgacaggcatatgctcagtaaactctagtgattaaccatccatatctgtcaaactaaagcatatgagaaatacatttgatgagttagtcgttatcataacccaaaacatttgtgctacaaaaggaaccatctaaaaagtggtttatatgtggggttatgttttcaaatcaaatatgttgctccagattgatttctggtgtggtgatagaacaccatgaccaaaaacaacttggagaggggcgggcttgtatcatattacatgtcccatccttgagggggagacatgataaaaactcaaatgggacaggaactcaagtgacataggaatccctgccaagcaagaacttgaagtagaaaccacagtggaatgctgctcgctgctcttttcagctagcattttaataaagcctaggtcctcctgcttaagtccacttagtctacagtgggctgggccctccctacatcaattagcaatcaagaaaatgtcccactgctatgtccacaggccagtctaatatagaaaggttttcaatgctacttccctccttccgtttgtgtcaagatgaccactaagattagccaatatgcatgtgactaagaaatgtctaggaagtatgagaaaggaccacattcaactaaacagtaaagacgaacagaaaatccagtctaaaagtgggctaaggacctgaatagttgtccaatacagttaccaaaaatgtcaacaaacacacaaaacttgttttaacattacagtcttgaaaatcaaaatcaaaatctcaatgagatgtcacattacactcactcaggggaaaaacaacaaacaaacaaacaaaaaacagaagacaaggaggagaaagtagaggaaggaaaagttttgttgaccaataacataaatgaggacatgcagtaattagagccttacacattgatggtgggaatgtaaaataatgctgccatattggaaaaccatgtcagcccaagaccttaaatgaaggcataccacatgagccagaaattccattcccaggtacgtagcctaggaaatgttcacacaacatggatgtcaatgcttagagcaacatattatattcataacgttcacaacagccaaaaagtaggaacaacaatgttcagcagtgaatgaggagaacatagcgtatccacacagtgcacaattacttgccagtaaaaagtggtgacaaaagataaacaggcttcaaaagtgttctgttataggaaagaagagagtcacagctgccacatattgtagggctcgattcgtatgaaatattcacaacaacaacatctctggaacaaaatcatagcttcttggtaattatgctgaagtctgctggagctttgctgtttctttccgagcaagtgagatgtgtagtacattcctgcctatcttcaaagccaggaaaactaaatctcaccatcaataatcccatctcttcccacaacccagacagaaagtttcctcttggcaatgtgggactggggagatggcccagcagctcttttttaaagctcatattgttcttatggaggacctgagttcaattcccagcaccctcaccagaaagctcacaactttctgtaacagcagctccaggtgatggagacacctgaaaggaaacatacccagactcatacacataactaaaaataaaataagtattttcaaagtcacttggggttggaaatggatggccgagtgaagtgagtagcatgcttgtcatgcaagcatgaaactctgaatttggattcccaggatccatttagagccaatatggtcatatactgttatctccacattcctacagaaagataggaggcagagacaaggaggtacctaaaagctcatgggccaggtatcctggcatacacattgaccaacaacaagagactctatctcaaacaagatggagaacaagaaccaaaatcaaaggctgtcttgtggcctatacacagataccatgctgcatgcacctgtacgaacaaacataacataccaacacacagccatcccacacgcagcccacttagagagagagagagtaaaatgaatgaacaaataaataatctcctgttggccatgaatggtggtccagacctataattccatcaaacaactctgaaagattgagacaatctgagacagcctgagctacataaggaaatcagcccaagaaaactccacaatgtgggcacacatggcttgcccggttttctagctctctttcagagtttattgccttcatcatgagaaaagagattactagagaaactgagagcagaatttcttttttatcttctggatgtatcttatgcctctcactgttttttgtttttttgttttttgttttgtttttttttacctcatctttactgcaattgctttgctggaggcctctatcattgttcactgatattactgtaatgattgttttccatattttctattctacttcattctctttgaggcacagcatttccttcctcagattaaacacacactttgctcatgttgctattcagataaaaagtcttgaatttcatatgcactgggccatgtctgaaccattgctcctctgacccgttacaggccagagccctgggagaactgcttctgctctgggtgatccctcttccccgtgaatctgtgactgggtgtgtccataaagatgacaagtctcaggtgaaacttgtcttcccagctccactccaagaaagacacattaacattgtgcacactttccttggtatcttgttccttccattcagagcacagatgacaattaaacatgtcattttctaggctcatggattaaatgaagttgtgtaaattttacgtttacatatatatgtgtttatctgtgtgtatctgtgtctgtatgtgggtatgtgagccactggtgtgtagaactcaaaaagactaaagagagtattggattcctgtaactggagttatagaaatttgtgagctgccaatggtgggtgttacaaactgaacctggattctcttgaatagcattaagtgctcttaaccactaagccttctctcccattcttaaaaatgccgtgtaataatatacataaaataataaatataaggtgttgaatacaacaaacaaaattctgcttcctgaacttcaagaagttatgtgtatgttcatcttgtggcataggtttacaatgtaagattagatgtggcttcatgtctaccattagaaaagcaaaggctgatctgtatagaaaacaattctttctatgccattgccgtagaatgaaaatgacacgccaagctccgtggctacacatgacagacattacaatcatttcttttttccttcctgactttttagtaatatgttttaagccttgtgggctataaacaatatctggctgtatggtggcttacaacttaatacagtgccctctgctcactgtccttttgtccaaagctctgtaaatactttatactattttattcactgagcttattgtgggtatgtgatagaggtgatatctggtcaaaattaaggtaccaagggaaaagattacaaggtgaccatgtgatcctggccattttgagacccgaattcactaacacagcagtgtcagttctgaaagaagagaagctttgagttaatttgccaaactacctcccaagtaccagccccatggcattatatggctctagaaaatttccttccttccctccttcctttcttctttctttccttccttcctccatccctttctcctttcctcctcattattccatttttatagtttttttgcgacacaatctttttaacccagactggccttgagctccctatattcctgcctcggctgatggcaagcgctagaatcacagtcatgccaccatggccagcaatttcttctccctactaattgtaagagtagtaaatgcttgcttcgaataatttgacaaaacaacaaaaggaggggtgactctgaagattgctcagtctctaaagtgcttgctgcacaaggacctggaccttaggttaggtgcctaacacccaaacacaaagcaatggacggtagcttaatctcagcactggggaggaagaggtaagaggatgactggacttcactggtaaccagcctagaggagcagtgtgctccatggttcagtgaaagggcttgtctgtagacaaacaggagtgaatgctaaagatccctaatgtcaagctctagcctctagcatgagctcacatttgcatctatatatacaaatgcagacacccacatcaatatacacaccaccacactaaaataagaaaagtgtgaggggtaaagcaatcccagaaatcaaatatttcctacttaatggtattcttaattcagtaatggttgcatgatttctgcatatctgtcaacattctacttgaagacatcttattcccctttatttctcactacttggctttttttttccccctttatgtagacttgagaggcaaaagtgtcctaccagggaaaagacatggacttcagtataacagccaccataactcagtctctggcattagctgtgtgatttgggagttaacgcattaaaaccttttatgctctacttccgtatgtgtaaaatcagcaagtggatgatcacagttcttctaaaagagttcaaataatctcctcctcggttgaaaagcatgtagagtgttaggaagacagccaagacatccttattaaatcttagctctccatctagaacaacacaaatgagcaatctctctctctctctctctctctctctctctctctctctctctctctctctctccccagtgtgtgtgtgtgtgtgtgtgtgtgtgtgtgtgtgtgtgtgtgtgtgtgttacttctaacaagaagcaagaaggtaggcaaagagaatgcacagggtatgagctaccaggcttggcaccaagtttttccaagagggaagacaggctttttttcccaagccaagcttacaaatccccaagtgtatcacaaactataaaacattccatgttaacacagcattcagaccgaagattgttaggttctcaagcaacgttatagacttactccacaagaagacgtatgcagagcaagtagggctgtgtaatcttaaattacagtgaattaaatgggagcctttgagggatgattatgtccatccatagcatctgcagggccctcttgccagcttacatactgctgccccaatcagagggaagactcatggatccttccatacagccttgccaattccctttcggaggaggaagctgattattcagcttggaaatgcacccagattccttgcttctctttctgcctactttcctcccctccttctgatcgttctgcttatagaagccctgccaagggatagaaaggaacacgttcaggaagtattgagtcagcgtttcattgttttctggaagcacagataaaagtaatttggaagactatattccaagaccatacttcactcctgcttatgcaaatgacatatcaatcaaagccccagtaagattatcttgttttctacaccaatctttgattctttcaaagtagacaatcaaggtctaaccatctccttttccgctcattaccatgaacaaattaaatctggatgaaacaaaactctccaaaggtttgatgtttattttctgctccccacattggatccaaaattgtttagaaggaaataataaagtgaattcaatctttgaactgatgagaacatgttgaacaactcaggccgcttccattgtatgacaagtcaacagtagatatagggaacttttctgccttttgactagattgtgtggaaaagatagatgtagaagaaaaataagaataccattctctagccactaaaccttctgcaatatttattttactgtggagatttttttttcctctgttagcctcagcttgaggtcattttatgccctaaagcacatcacaggatgccctcaagcatatcttgggaatcagaagtgaatctttaaatcacctaatttcacatctcagcagccatggtttggtcaatatcagttctgagaacacgctgaggcagaggttaaaaacacaaagacaaaactctgaagtgaacggaataaataacttctggaggaaaactggataattttgttgactttgtctttcataacacttgtttcaaaaaaaaaaaaaagaagaagaagaagagtcctttaataaccacatgacgactctcttcttccaccaaagtatttttaaaataattaggcactgccattattacatgtgagttgtcaaacagaagagctatgcccctggagtctgcttccaggtaatttatcacttcaggtctttatttgttcaatttgaagattattgcttttcatattgcctgtgagcccctggaagccaaaaatgagatctgggcatcgagattgaagcaagctatctttataaaataccttgaaaaggctcaagcatgcagatccaactagagacataatatatttttattttatttcataaaattgtagaagaatgtacttggccactggagagtagcaaaattgctttgtgatcttcatcaagtaaattaggtctggacttttgttctgcaacaagaaaaaatggatttagaaatactatcacttcatcagctttttgtgaaggataaaggaggtctcatgtgtaaactgtccagaatattgcttgtcatataagagatagtcaaatattaattctctttatgagcaaacttgaaaagttagtcaaatatcactatattatgaccaggatgaccctatatgaaaacaaaatattccccaaagtgtccagaaaaaaaaaaagctaattctgaatagttggtctgcctttgggtttggattggaggtcttgctgtaacacaaaaatcattaggctaggcattgacaatttctttctggattgtatcagcaagggcttcatctttgctatctgttccatcaccaagtgattagtcgaagcaaatcatgataattccatatctattgtcatgctgggtacaggatttgataattctagacagggaaatatgaagcaaacttagacgccttgatacgtgttaaagtatcatcatagagggtagggctaatggctaggtaggtgaaatgattcctgtatatgcatgacgacttgaattcagatcctgaccagccatgtaaaaagccaattgaggttgtgcatgtctgtaacctagacttgagagaagtggatccttggaattccctggctacccaagccaacaaaaactgcaagtgccagattcagtgacgaggctgtgtctcaaacttttaaggtagagacacaattgaggaagataccaggaaatcaatccctgacctctgcacacacatcacattcacaaacacacacacgcacatgctcacacacaccagacagacagttgaacagacagacaggcaggcaaaccaagagattacattgtaataaataggactccctcactcccggccttagtcactggggtacatgatggactgagatacagtggttatttttttcaacaaccatgagaatgaaataaaaactggtcggatgacaaaaggcacttcctaatgaaaccattaaagtgacgaaacaatcagtcctgaactacatagtgaaactgtgctttgtaagtgtgaaattaggaataagctgagggcaggggctgggctgtaacaattacttggtggttaagagcacttggtgtccccgcagaggagctgagttcggtgcctagtacccacatgacaactcacagtcatccttgtacaaatcccagagagaccagtgttctcttctgacatccccaggtaccaggcacacatctggtgtgcagatgatgatcaatcaatgcaccacagccccttctcttcatcaaaattgttcagtacctgaccccataacacaccaaatccacttagtctttccacaagacaccaccaaaaatggtggggatatgtagaaaagagctgtctagagtcaaccacacctcgggctatgtgcagactgaaattgtctaaccctgaatcagtagatgaaagactgagaatcaatgtctgttctcataacacattaagtttgatgtatttccttgacagtatgtatgagatagaagctaactgactagcacatttcccatgttgttttcatatcctcaacatgaacataccactttcttaatttcatcaaatccaccttgtgtcttcagtgacacaaatcttttttttaattagatattttctttatttacatttcaaatgttattccctttcctggtttcccctccccaaaccccctttcctctccccccttcccctgctcaccaactcacccactcccacttcctagccctagcattctcctacactggggcatagaaccttcataggaccaagggcctctcctcccattgatgacctacaaggccatcctctgctatacatgcagctagagccatgagtcctaccatatgcactctttggttggtggtttagttcctgggatctttgggggtactggttaattcatattattgttcctcctatggggctgcaaaccccttcagctccttgggtactttctccagctccttcattggggaccctgtgctcagtccaatgtatggctgtgagcatccacttctgtatttgtcaggcactggcagaacctctcaggagacagctatatcagtctcctgtcagcaagtacttgttggcatccacaatagtgcctgggattggtgactctatatgggatggatccccaggtgtggcaatctctggatggtcattccttcagcttctgttccacactttgtctctgtaactccttccatgggtattttattccccattctaagaactgaaatatccatgctttggtcttccttcttcttgagtttcatgtagtttgtggcctgtatcttcatctcatctccaatattaacagagacttcattgtgaatattcgtcatatttctctatgtctttccactcatccttgaagactatttatgtgctagaaacaacaacagaaaaggaactcacccccaaagagtttgtagcctaatagggacaaacatgaacaattaaaacaagacatgagtgtcctttcttcaaaagtagtcttagcttcttaattaaatccaaagctgttatgtggggcaagatttattttattatttctggattccattgtagcaccaagcacagtggtttgtccagagcaaatgttcaacgaacaagtagcttgttttattgttcaatgaccagtactttacagtgtccctttgctgtgtctagtaactgaatatttggtcagttgttccctataaaatatgttcacactatgcaggcattgtttaaaagcctgggtggtaatagctgtcaaaaccatagtcaagcatataattacattagcatgtattatactttaccagatatgaaagaggactgtgggactaaagaagggtgacgaattttatttgaggaagtaactttatacttttataagtagaattgtgactttaaaaacatgtaaaaaatttcccaggcaagaaacaaagtggagacctcctctaggttctaagactattatgcaccaaagtatagaggtacaaagaagtagatggctttggaaattagcaaactatttgtcacaggtagagtttactctgggtggtagttgagtgataaaagatgaggctactgctgaagtgaactgagaagacccttgcatatccaagtaatgaactaaagttcatgaaactcagaaaagcaaatacgtggcaaatgccgggctatgttttatatatttagggtcattgcctttttacaatgtagtgactgaaataggaaaagataattcagttacagaaagacctgttaagaaatttatactggaccaataaatgtcctaaatgattaaaaccaagctacaatagtaacgttaccagatagacatttgcacagtagaaggcagaatgcaagagagtcagagtgttggagagtgcactgtgcctaaatcatagactacttgaagtacctcccacaaaggcaggttccaagtggaaagatcccatctgtttcactgattagtcagcactgtcatgtaaaatgcagtacccttatgaactagggactacactctaaaaatggggagaaatttacttcatgaaattgttttgagtttaaataaaattaaggcacacaaaactatcaaacttgctgcctggcacaccagcattcctccatggaaagacgtaaaaggatatgaatggaagtgagtggggttcacacacagttgactatgttacctgctatggtttgaaagtgaagaggtgtgaacctcacagcttcataagtcttcgccagagattgtagaaccatttagacatctgcctagctggcagatacaggaccagaggcacaggaattgagagttaaagcctgactcttcttctggtctgaaccctctactttgttatctatggagatgtagaaagcattgctgcaagcttctggaaccatggacagagccctagctcttcctgatacatatttattgtagccactcaaagcatgagtcaaaaatgaattctactaccatcgcttctgttgggtactccgtcagtcaaaagaagagtcacacaggatacaggtataaatagtgctataattattgtaataatcttaaacatgtggctcataggcctttggaattagaatgtggaagacttaggtggttggcatgaggaatccctagagtactacaagcagagcaaaatgggagcttctgtgagaacacagaaacagaatgctaacagaaatgtagacagtaaagtctcggtttatgaagtctcagagtaggtaaaacaaagacttaagaactatgttacatgaagttcatgttgtattctccagaaaagaatctggatcttttgtgtatgctctgaaattgtgaatgaggcttgattttaaaataatagattatttcatttggtggaggaatttcaagactgtctattatttgatctgtggaattgtttgtgctgcttttagtctgttgtttacttggttggttgatcggttagttagttggttggttttttttttttaatgatggagagtaggaagtggaacagaaagatgtaaaatatgtgctgtttggcaaggaaatgaattaaatgaagttaaagttgggaacagataagatatagacaaatcagctacaatctcctttctgatcaaaggctatattgcttaaaaatacaaattctcttaaagaagagtggctgaaatgagagtacctaagaaattaagagtttacagcacaccttgcttgaacagaactttctagagatacgttttcaaattcagcttcacaatcatacctcctaccctgctgtaggcaggaacaaggagggcaagctacatcctgagctggcagcagaacctggcattgaccatatggtactgattttttgcaggcatgcagaatacaagagttacaggctcatggagccttgtgccaaggattcagaaaattgctgaaggccagaacatatgtaaggtgattggatttgctgaagagaagtcctaagagacctatgtgtgaagctgtgaatgtgaagactaacttgcgatggagattgcaagatgtttagagatgccaggatgcataacatctgccaaacagatctgtgggcactgagtaaagacggcttaagagagcccatgtgtaatgtaggcggtggagctgccggggtgagaccacccaagctcaccagtgctgcaatgatgtcaccacaagtcccagatgtcatgaactacaaggtttggttttgccttgctagttttcattctttctttggcctgatcaaatcttcttaagcctgtttaagaaacagaagattttattcatgcctctgcatgttggaaatatgtaactgcattttcaaaaatattttacaggggctcacaaccaagagattgcaatgaattcaagaagagactttggatttttttttccattttttattaggtatttagctcatttacatttccaatgctataccaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcacaagagacagctacatctgggtcctttcagtaaaatcttgctagtgtatgcaatggtgtcagcatttggaagctgattatggggtggatccctggatatggcagtctctacatggtccatcctttcatctcagctccatactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatcctcgccagcatctgctgtcacctgaatttttgatcttagccattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttggctcccttgtcgaagatcaagtgaccataggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctcggttttttgttattccagatgaatttgcaaattgctccttctaattcgttgaagaattgagttggaattttaatggggattgcattgaatctgtagattgcttttggcaagatagccatttttacaatgttggtcctgccaatccatgagcatgggagatctttccatcttctgagatcttctttaatttctttcttcagggacttgaagtttttatcatacagatctttcacttccttcgttagagtcacgccgagatattttatattatttgtggctattgagaagggtgttgtttccctaatttctttctcagcctgtttattctttgtgtagagaaaggccattgacttgtttgagttaattttatatccagctacttcaccgaagctgtttatcaggtttaggagttctctgttggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcacccctggaataaaacctacttggtcaggatggatgattgctttaatgtgttcttggattcggttagcgagaattttattaagaatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccgtctggtcctgggctttttttggctgggagactattaataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccgttttttcttgaaggcactcatagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccatgtgaatgttggctttctgttatttattttgttattgaagatcagccttagtgcatggtgatctgataggatacatgggacaatttcaatatttttgaatctgttgaggcctgatttgtgacctattatgtggtcaattttggagaaggtaccatgaggtgctgagaagaaggtatatccttttgttttaggataaaatgttctgtagatatctgtcagatccatttgtttcatcacttctgttagtttcagtgtgtccctgtttagtttctgtttccatgatctgtccattggtgaaagtggtgtgttgaagtctcccactattattgtgtgaggcgcaatgtgtgctttgagctttactaaagtttctttagtgaatgtggctgctcttgtatttggagcatagatattcagaattgagagttcctcttggaggattttacctttgatgagaatgaagtgtccctccttgtcttttttgatgactttgggttggaagtcaatcttatcagatattaggatggctactcctgcttgtttcttcataccatttgcttggaaaattgttttccagcctttcattctgaggtagtgtctatctttttctctgagatgagtttcctgtaagcagcaaaatgttgggtcttgtttgtgtagccagtttgttagtctatgtctttttattggcgagttgagaccattgatgttaagagatattaaggaaaagtaattgttgcttcctgttattttagttgttaaaggtggcattctgttcttgtggctgtcttcttttaggtttgttgagggattaccttcttgttttttctagggcgttgttcccgttcttgtattggtttttttctgttattatcctttgaagggctggattcgtggagagataatgcgtgaatttggttttgtcgtggaatactttggtttctccctctatgataattgagagtttggctgggtatagtagcctgggctgcagtttgtgttctcttagtgtctgtataacatctgtccaggctcttctggctttcatagtctctggtgaaaaatctggtgtaattctgataggcttgcctttatatgttacttgacctttttcccttactgcttttagtattctatctttatttagtgcatttgatgttctgattattatgtgtcgggaggaatttcttttctggtccagtctatttggagttctgtaggcttcttgtatgttcatatgcatctcattctttagatttgggaagttttcttcaataattttgttgaagatgtttgctggacctttgagttgaaaatcttcattctcatccactcctattatccgtacgtttggtcttcttattgtgtcctggatttcctggatattttgagttaggatctttttgcattttccattttctttgattgttgtgccgatgttctctatggaatcttctgcacctgagattctctcttccatctcttgtattctattgctgatgctcaaatctatggttccagatttctttcctagggtttctatctctagtgttgcctcgctttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgttggggttccctggactgggcgaagtgggtgtgctgggttctggtgatggtgagtggtcttggttcctgttagtaagattcctccgtttacctttcgccatctggtaatctctggagttagtagttatagttgactctgtttagagattgttcttctggtgattctgttaccgtctatcagcagacctgggagacagattctctcctctgagtttcagtgctcagagcactctctgctggcaagctctcttacagggaaggtgcgcagatatcttgtatttggacctcctcctggccgaagaagaaggcccaaaacaggacctttctcagacactgtgttgctttggcagttcccaggtggtacagactctcacctaagcagactaaattcctaagttccttggagtcccgggaccaagatggcgaccgctgctgctgtggcttaggccgcctccccagccgggtgggcacctgtcctctggtccggaaggtggccggctgtccccggcccacacagggtgctgcctcagcgcctctgtgcttctgcctgttccagaagctgtcaggttctctggcgcaccctctcacctgttcagactaatttcctaagttcggcgggtcccggaccaacgagactttggattttgaaggcttgagatagttaagactactggacttcttgaaatactaaatatattttatactatgggatacattatgggaatatattttatattatgggatgcccatggcccatagttctgtgcttccctatctgttaagctgtacaggcagtgctgtatgctcccatcaccatggacagagccaaggtatcatcatccatgacaccatcttaaactattatctgaaaataaactcatgttttctttcagatattctggtagcagcagcatcaacaagaacaagaaaaaacagagcatccctaaaccttcgtggtcctcattctcttacaagtgaaatgaggaaaagagggcccacctcagcgaattgttgggaaggttaaacacgaaactacatataaccctgctgatctgtagtaggaattaaatgcatagttcatgatagaatgagtttattcacctgaactaacaccatcccatttaaaggaaatgcataaccctctttataaatactgcacagatacaaaagagatattatcattacagttcattcttcaagactagtaaaaataatagtatgtgtttgattcacttgtattgaaactagatactaccttcatattacctcatgaacatagaaacaggacacacaattaagttcccaggtagagactagaactgcaatttttttttttctaccaagaggcagtttgtagaaaacttgagaatcacatttttaaagagcgtttttctttacttattatgtgcatgtgtgtgtgcctatgtattcaggtgcctatgtgttctggtgtccatatattcaggtacctgcagaggtcagaagacatcagattcttggaattagagttatttataagtgagtgtgacgtgggtaccaggatgtgtgcacccaggttctctgccaaagtagtatgtgctcctaacagatgatccatctcctcagcctccagaattacaatttttaaagaattctagcattccttacattactaattcattcattgattatttgcttttgaatgatctgccactctttgggcttggataaatgtatattaccttgtatttattagccattatagatactgatacacctatcttgtttttaatatttaaacctacataactatccaccccatttaataagttggcttcccccatgttgaatttgatagttcatgctgccacagtaggcaatgttggtgtctgtggtccatgttatcaccaaaagccatggtgtcctttctcctacctgaagctgtgctgatgtcaggggccttgttgctgctggagaccatgttgatgtccatgacctgtactgccactgagggccatgaaggtgtccatggtctgtagtcacactggagaccatgttgattctgtgggccatgttgatgctagagaccatgctgatgtacatgccctgtgcct

SEQ ID NO: 254 - DNA, 5269 bp, Mus musculus
aaaggagcattggtttatttgccagtgagttcactcgcccagagcatcctggaaaaatctgactccttcagacactctggagttctccaacaaatacagtttcctatgagggtaaaagaaaatggactggaagagaccagatgagctcaccaggttcctctcccagctccatggtcagtttcctttcagctgggagcctgcatgtgagcgctcccgaagttcaactgagctcattctgaaagccaccacggttggaaccgaagccttttctcagctgcacatcatcattcccgtggcccttgtcactctcactattgtgatccatttgacaatgcttctgtcttccacagacacagcacagcagctgggggagtggctaagttggtgacaggcaccggagcatgaagacggatcctaagcacttaggaaaaacctatgcatctgttagccagtgcttggggttgggaacagagacatgcagggccttgggaactcatctggggtcagtgagagacaggatcttaaaaaagaaagagggaggtagagagtaaccaaggaagagtactggacatagacttttgttgttggttttgtttttgtttttcaagatagggtttctctatgtaaccctggctgtcctagaactcactctgaaaaccaggctggcctctaactcagagatctgccttcctctgcctcccaagtgctgggatcaaaggtgtgcgccaccactaccactccccagctagacatagccttcttgctttcacatacactcatacccacacacccacatgaatatgtctatgtgtgcacacacaaacacatacacacactgtgaattctataagtgatatgtgaaaaatatttcttctgaaccttttactgatttttttttgtttttgttttgttttgctttgtttttgtttttcgagacagggtttctctgtgtagccctggaactcatcctgtagaccaggctggcctcaaactcagaaattcgcctgtctgcctcccaagtgctgggattaaaggcatgtgccaccactgcccggtctgattttttttttttaaataatgcctaatctactgaataagcatctaatataagccagcaattgctgtatgtacccaggactcaaacacaataaccaagcatgcttgtcctaaagaagctgacattcttgtgagcacaggcaacaggcagtacatacaacatgcagacagttacatgtggactgtgcatagcatgttagaagttggccaatgctctagaaaaaggaaagcagatcagatgccaagaggctttttctgtctcccccattcataaaattccttacgttccaccagagagtattaagaacaaacttctcattttcaaaaaacctactgacggacaggtctttgagctttgggaatatgtcataagcatgcagtcaagagggctgacaggcatccaaatccaccttacatacaaactccacctgcccccaactcctagagaaaggtaaacgtgctgagttcagccaaagaggagaaagcgagtgaagcagccaggcttttgctcttggtgcagctttcccaccgaggaccctcaactctaattgtaaacgggcaccccgagggacctgtgcaaatcattaaggaaaatccttcagtcgaggccgtccatcacaaggtaacatgaaactctccagcctttcagtttgtttttgaaaaggtgctcggaaaatagggtatgccacagtccaggggctactggcttttagggaaaaggaaaaataaaaacatcatattctgtcaaagactcacctaggtgcgccatcatgcccggcttgtgagagcaggtcttacctgagctatggttggtgggcagggaagcaagcagtcctgtgtgtccggttcctctgctaaatgaagaagattcctatacattccaatgtgagaagcttgtctgtatcaaagttgtttatggtgactgtgaagggtgtctgtacttgataactttccattgctataactaaatacagtccagtccacctggcatcctgagtgctgagattaaaggtgtgtgtcaccatgccagccataaaaattaatttatattagtataaatttatgaaaattagtacaatattatcttttagtaatataacattaatggagatatattaatatgaatttgtattaatataaatataatatatgtaaacatatatgtatataataactaccctcttgagaacttcattaatgcttttcaaggtaggactcccagtggctcagtccattactttagtctattagactcttcctaagactcttcctgaaacgtgcatgtgcgcacacacacacacacacacacacacacacacacgcacgtgcactcatacatacttgtgcatgtacatacacgtacaccccccaacacacacaccaggattatcactctgaaggcagcctctgactcacaagctctgagagacacatactctatgagagccacagctacctgactggaggaccccaggctttggtgtcccgcctgtgagagacaacctgactacctatgactactgagagtgaagagacacactctgttgcctttggttgtgatgaaggaggggagaacagccctttctctaagggattgtgttgagtgggttactgatattatcatccccagtccccacatcagataggtgtccatatcagagaaaaagaaacggaggcatttagcaggttgtgtggcgtcactagtgaatgtcagtctgaatcacagggggtgtgtgggctttggggtcatctcccacaggagacccgcctgttccctgctgttccttgccctacatgctattaaatgcttaacaggttactcttaccttcctcgtttttaaggttggactagtaattacagtgttatactgatgattcaagaccgtcactatggcacacacggtgacaactgtggtgaactacaggtttaaccacaagcaattgttgttgcttttgtagtggaccaaagtcagaggtcacatgctgcgatctccttctgtgatggggcaacccccaccatcaccacacccactggaggcttaacccagaacctcacacatgctaagcaagctctcaacgtaagggagctatggccaacagagccagactagcaggccatggctgttgacttgagaggatttgagcccccttcaaccccaccccacccctgggaatattgttgtttgaggaatggcattcccactagaaggctgctggggagagacagatatcagccataaccactggtcattctgcaccctggagttggagatgaggacttggtcagcaagcgggaagctgtaaaattggacacattcaagattaatcagaacctggatgctcttgagctctgacagaccagggttaagaagggggtactactcagacgtggcccttgaggaggccataagatagggaaaggaaaacaagaccatttttggtttgttttgacagggcttcttggtgtaggcctggctgtcctggaacttgctttgttgaccaggctggccttgaactcatagagagatctgcctgcctctgaatgctgagtttaaaggcttgtgccaccacacccagctcaacttcgcctttctaaaaggaaaggtaggagtaggttgtgtgtgtgtgtgtgtgtgtgtgtgtgtgtgtgtgtgtgtgcgcgcgcgcgcgcgcatatgtgtttgctgggaatccaactccacctttctcactctggctgaacaagtattgtatcactaggctatccccccaccccagaaggctggtttttgttttttgtttttgttttttccaaagtaagactatctctataatgcaaaacctaccagaagttctctttttctgataagatttttatcagacttatctggttgccccaaccagagctctgattgtaacctacttgcatcccactccttgcatttcacagtaagagctaaaagtagctctgggggtcgagtggtcaggagagacaaacggtgcagagaacgtctttaagtgatctttctctcatctctgaagcacactgacatcttggggacactttagactttccccgtgtctgaactgtgcttgctacggagtgtgccttgcgatgtcttgtgagagcggtagggcatctgcacgtttgttccgtttcctctcacctaagaaataatctgaaatcaatctccattctttttcaaggaagttcatgaattgtctgtgaaatttcaatgttccctacatacacacacacacacacacacacacacacacacacacacacacacaccatagcatcccagacaaatgaaaagccatttgcatacccaggaactcaggcgcacttggtttttttttttctgtgtgcgctgttctctctttctttgtgtctatggttactgttaagctgacccctacagtctggggcaaataccaaacttgaatcaagcgctgcctagccatacagctgcaaaggattgccatttcaagggcgtacaatggcttcagctggctgggttttagggtgtccgggacagccctgcccacagtgggatgcggtgcccacttcgttggagttttatctgttttcacatctgaggtgatttttttccccctccaatattggatttcattgttcagaacggtgactgtaaaaagatctttctttgtatttgtgtctccttgtctcccagtttctgtaagaaagtctcgcttgcaaaaagctgtagctaataaaaaaaaaaaaatggagttccatcagctgcacagggatctgggcgtccagaaccaggcagaggaggcgagaaagagcttggccttgccttcgttgcacagcgggtttgagtgtttgaggaccctggggcggcgccgtgggcgggcagagagagagttctttaccggacaaacagttctaaggtgcctggagcagggttgcccgcgggcacggtagaaaccggctctcttggttctagccagtgagcggacgtccctgacatcagggggcctgctcctgtcagccaggccagcaggcgattggctggggagaggcagtaattcgaaccgcctttgtacttagctaatcagggcagcgcaggttccaggagctgaggtgcctggtgtcagacacctgtgtcttagctctgcctccctagagctggctctccagcctgcagtcggcctctgtgccacctgcccaaggccccaaggccgggtggaccagctcgactgt

SEQ ID NO: 255 - DNA, 16280 bp, Mus musculus
gccaataaatgtaataacagatgtttgtttgcagttctttctgcagctgcaacaggcagcactggaggtctttgcagagaataacgtcctcagtaaactgcagctgggacagctggcctccatggagagctcggtcttcgatgacatgatcaacctcttagagcgtttgaagcttgatatgttgacccgccaagtagaccatgttttcagagaagtgaaagactctgcaaagttgtataagaaagaaaggtgtgtcctgtgtcagttaccctttacacacgctagtctgagtcaagataccatttctactccctgttttagcttctgtaaaatcctcactccaagtcttggagatggaacttggggctttcgtgtatggtagctctaagcactggttttgatgggatcgttctagaatctattcttttgaagaatttacttagaataaatgagtgatggtgtggacctcttagagaggttcagttgtccgagtgtcactcactttacaaaggaaagtgccccgtggtctatgccctgtcatgcttgcctgtcacaactctcctgcctctgtaccctggcatggcacctccacacagtactccagtcagtttggaaatactgttagtttgtatgctaaaaccagagcatagggggctggtgagatggctcagtgggtaagagcacccgactgctcttccgaaggtccgaagttcaaatcccagcaaccacatggtggctcacaaccacccgtaaatgagatctgatgccctcttctggtgcgtctgaagacagctacagtgtacttacatataataaataaataaatctaaaaaaaaaaaaaaaaaaaaaccagagcataagattaactggtatctttggaattctaaagataaagtaattaactttagggcatttttcaggaaatattaattaaaagttaaaatataaatatagagacatttatttctggtagagctttgagtattagacatcatgattttttaaactccagattttccccaggacggtatatttccccctcacatttaaaattgcgttttgaaactttaaggatacagagtggtaagggtcactcttgtgaaggttacttgtttttccagatggttgtccctgccgtctcagtcggaacaggcagtgatgtcgctgtccagctcagcctgcccgctcctgctgaccttacgggaccgtctgctccagctggagcagcagctgtgtttctcgctattcagaatcttctggcaaatgctggcagagaagctggacctgtacatctaccaggaagtgagtcgggagacggggccggggccgagagggcggccgctgcatgaactgctctttgctgcagataacccttgcctgggatggcagccattacatggatcgctctttgttgcagataatccttgctaaccacttcaacgaaggaggagcagcccagctgcagtttgatatgacaaggaacctctttcctttgttttctcactattgcaagagaccagaaaactattttaaacagtaagtccaatgtccagccataagtattggtggtgtatgcaaacgctggaggagctggcttctttttaacagtttcagagttttgctgatatcttttgtaatagcatcaattaaaatctggagctagagatgctcaacagtcaagagcacttgatgctcttgcaaaggacaggggtttgttctcagcacctacatggtaactcaaccatccttaactccagttccagggcatcttacactctggtctccacaggcatcaggcacacacacagtgcatagacatgcatgcacgcaaaacatacacatgaaatttaaaaatctaaaaagcaacaaattgctggctccttgccagcaggtccaggagagaggagaaaggtcccggtcctgccctgttggggtctctctgggggctaagtgggatggcaagtatcgatggcccaaaagaaacacactgagcctagagtcttgtcgaagcaggaactcaactttatggcatcagcctcttgcttatataagttcagaacacagggagagggatttttggtggggtaagatgatgtatatagggggtaaggaagggtgacagagggtatggagtgactgacagggccaatggcaaagctctacatcagcaacagtggggcagaggcagggcttaacaggtcatcccagtagggaagtgactgagactggtctcaaaactcgagccaggctcgggtttgtcctcaaggctcaaaccagagccaaaatgggacccaacataattaaaaccttaaagcaagccaggcgtggtggcgcacgcctttaatcccagcactcgggaggcagaggcaggcagatttctgagttggaggccagcctggtctacaaagtgagttcagaacagccagagctacacagagaaaccctgtctcaaaaaaaaaaaaaaaaccttaaaacattcattgtatgtctgttaatattttcaagacacaatagggaaaccaaaataatgcacatggtatatacatcaacagaaagttgatcagaactataaattacatgttgaacttgctacatagcatctggttcaatgctatttgcttataactgggagagtaaatagaaaatgatacaggtataattctgccacctgtagaaaataaggaaattaggaaaatgcagaaaattaggtttagtgcctaacaatagcctagaccagatgaaagtcagttttcttacaaatttaatattaattttagctcttactatagctgtaaacatgagaacagttactaggaatctagtaaaaaatttattgatttaaaatttacattaagtaaagagtctgtgcaatttggaaaccttcctttgaaacataaaaggttatgcttcctgggaactatggttgtttctgatttgcttttctgtttttgagataggttccatgtatcccagcctggccttgaacccagtactcagtagcagagggtgaccctgggcttttgctcctcctgcctctgtcttctgagtaccgtgtttacaggtgctcaccccacccgccaaagcccctcccatgcttcattcatgttaggcaagtaccctacctcgtacatgaagtctcagcccccttttacttttattattatttaaatattctaatttggtttccatgtgtggggtggaggccaggtgagaacttgtgggaacagttctctcctgccacgcagatgccaaggactgagcctgccggcagcagcagctttatcctcggccgccacaccagccttcctattctgtttggtttaggttttctgagacagtctcgctatgcagccttggctggcctggagctcatagtgtagaccaggctggcctggagctcacagaggtcatgctttggcttccagagtgtggggattacactcgcatcatcgtccccagcctctttatagcttggttggccttgctgttttgcctttttgctgccttcatttttattcctttgcttttcccctaagtcctaattctagctgaactcgtagttacatttaataatctgttagcatcaaacagtgtcctgagacaaatcctaatgacgtaccaagacaagcctgaatgatctattaaccctgtacagcttgtgtagtcccagcacatgtagaaccaagtagtccatagatagttaaatggctgtgtagactctccaaaggtggtccaaaagagcatctcttctttcttgttttcctaaacagtgtaaaagaagcctgcatcattctgaatttgaacatcggttctgcattactgctgaaagatgtcctgcagtcagtgtccgagcacattcctgccacagcagccttaaatgaagttggggtttacaaactggctcaacaagacgttgaaattctgcttaatttgagaacaaattggcctaacactggaaaataatgcatctttgaggaaagtgttgtttaagaaagacaagagttgcctttaatcccagcacttgggaggcagaggcagtcggatttctgagttcgaggccagcctggtctacaaagtgagttccaggacagccagggccacacagagaaaccctgtctcgaaaaacaaacacaaacaaacaaacaaacaaaaaaacaaagtcaagagttggattgaagttctctgataaagttctgaattaatgaacctggacaaaagaaaacttggcagaatagtttcttgtcttgagttatgataacactaaatcggtgaccatcctccatcctcccgttcctaagaaagcaaagaatgaaaactcagctgtgagaagcagagtaagtgtattgcaaataggaatggagacatctgaagacagaatgagagcagagggtagcccttcctgaccgccatgtccgaatcaaggggagctgttgtcaaaagctgaatgtcgcaatagactgtagaaactcatgggtgcatgctcatagttgaggttcctgtatccattttgggaattcagtgtttatataataggtggaagacacctataaccccagcaactgaaggctgaggcaggaggataaggatcactgagggttcaagactcttctgggcaacatagtgagatcttatctgtttcaccaccacaaaaagaccaaaacaaaacaaaaacccaagaccaaagcacaatagttttatgagatggtggttaagctatggttgttcttaatattctattcttatgtccttccatataagtatttctttgtgtgtgtgtgtgtgcgcgcgcgtgcgcacgcaagtgtgaacacacaggtgtgtaaggggtgtgtgtgtgtgtttagatcagaaatcaaccttgggtcctgttcctcaagatgctcaccttgatctggaaacaggctcccatctggactgtgggcaagccccagggttccttctgtttctgcctcccctagacaggtatttcaagtgtaccaccgtcatgttagattttcccatgagttttagggagtgggttctcagtgccaaatactttaccgttagtccttcctggttctactcctttttttttttttttttttttttttaaagatttatttatttattatatgtaagtacattgtagctgtcttcagacacaccagaagagggagtcagatctcgttacggatggttgtgagccaccatgtggttgctgggatttgaactctggaccttcggaagagcagtcgggtgctctaacccactgagccatctcaccagcccccttttttttttttttttttttaagatttatttatttatcatatgtaagtacactgtagctgtcttcagacactccagaagagggcatcagatctcattatggatggttgtgagccatcatgtggttgctgggatttgaactcaagacctttggaagagcagtcagtgctcttacccgctgagccatctcacctgcccctggttctacttcttgtaacaatggccatctttttttctctgaaacatttttttttttttcttccgagacagggtttctctgtatagccctggctgtcctggaactcactctgtagaccaggctggcctcgaactcagaaatccacctgcctctgcctcccgagtgctgggattaaaggcgtgcgccaccacgcccggctgtctctgaaacattttagaggccagatactgccttagtcatttacctgtggtaatgattatgtagctgatgagataaaaatcctttgtgtgtgtgtgtgtgtgtgtgtgtgtgtgtgtgtgtgtgtgtgtgtgtatgcagtactagagatcaaacttggagccttgctaatgcaagaaagggctccaccaccatcctcagcccagacagattccttcattaataaatcctcagagactaaaataaaacgtttacacaaactgagcttagctggaagatttctacacctgtaaagttttattctcatttttttcttctgacatggcatttatttagtactttcaatgctgtcctatctcaatctataattgtcaggttgggtgctggagaggtggctcagctggtaggctgttcttgcagaggacctgggtccagtacctcgcacacatgtactcacaacagactgtaactgcagccccctaggatccaatgcactcttcttgtctctgaggcattgcatgcatgtggtgcacagacaaacactcatacacataaaaataaataaaatcagctgggtggtggtggcgcatgcctttaatcccagcacttgggaggcagaggcaggtggatttctgggttcgaggccagcctggtctacaaagtgagttccaggacagccagagctacacagagaaaccctgtctcaatcaatcaatcaataaagctacacagagaaaccctgtctcaataaataaacaaacaaatcttgctgagcagtggtggcacactcggcacgcgagaggcagcgacggttgaatctctgtgagtttgagcctggtctatggagtaagttccaagacagccaggactacacagagaaaccctatctagagaaaaaaacaaatctcaaaaattgtcaggcttgcatgtggccttcattgttgatatttactttgcagactgtaattttgagaaaactctttaagatagtaccttctgttctattttctgagagagagagcagcttgttttatagcttaggcttgtgttaaacctcaagtactgggattctaagtatgccctctgttatccatgtagagccgtatcaatgtgtcattgtgactgtgtgtgtatgtgagagagagagcgcgccagccagcgtgcacgtggacagaagcagagcatgctgtgtcgtcagcagttctcccacctttatgtgggtccccaggctcctggcaggctctgcgtgccctgcctggcttgcagaggaaacacttgcacctcctcaccagccgcctcgatgttctatatggcggctttccaactactgtggagcttagagttttagtaattctagcagacggggtctcctcacctgtgtgagggttggtaaggtttccttttttttaggcagggtcactacatagccctgcctgcttctacctcctgagtgctgggatgagaggtgtgttctaacatgccccacactgacaggtttcccagtgaggaaagcatgaactttctctacctccatcatcacacctccccttgcctgggtgggccttccctgccttctcttcccaatggcaggcagttaaagggaatgaaacattccacccaaagggtagtaggtgtggggagtggagagatggctcagcagtaaagtgcttgctgtgcagaggtgagaagctgaatctgatgcccagagccatgaaaacctgcgagctctgggcggaattcagtttttccacagctagattcaaggtagagatgtagactcctagacgctcacaggctgcctagcatgggctacacagtgcagcagcaaacaaagagacaaatgggagatgaaaactgacccctgggattgattgttctgggcgccacatgtatacactccagtgagcacacatatgcacacacacaaaagggtggtggtactctaaatgcaatggtattgatacttcaaaatcataccatgtcattaagatattaaaaaccttacccttcatctttgaatttatccagtattaaatgtccatcatcattcaaaacttcatgtgcagtacacagacccaatgttttcagtactgcaaaaatgagaagaaatgaaaatacacaaagtagaattatttttataggtttataggccacatgagcctttataccacacctctgccagagatgcccattatcttaaacgcgggcacgatgttgtccataaagaatggaggcgcctgttaactttgtgattctcagctgttccaatgtagagataaaaggctcttggtttttctgcaaataaatagttgtttcattcttctgtgaagttaaactgtcacaagtggaaatagtcccttaagagttgaatgccgggctggtgagatggctcagtgggtaagagcacccgactgctcttccgaaggtccagagttcaaatcccagcaaccacatggtggctcacaaccatccgtaacaagatctgactccctcttctggtgtgtctgaagacagctacagtgtacttacatataataataaataaatctttaaaaaaaaaaaaaaaaaagagttgaatgccgccgggcggtggtggcacatccctttagtcccagcactcgggaggcagaggcaggtggatttctgagttcgaggccagcctggtctacagagtgagttccaggacggccagggctacacagagaaacccagtctcgaaaaaccaaacaaaaagtttgctatgttgaaggtgctgtgctaggcactcaggctgtgggccttggttcatgaaacggtacagcagagaactggacaaagcagctccttagcatacctcataggactgaacggcagtctggagatcatccgtgggggagcgcgatggagagcgagccgccagactcccacgattccttgaagagtcctgatctgccctactgggcattagatctaaactggctcccttcagacctgtgagacagcaaaagggaacccaggccagggcaatgtgggcatcccccattctcacagatgacaatattccctcaggccccacccactctttctgagttacctcattaggcagggctttcattggggcacattgtggtgagatacgattggtcaaggatttagtggcttgggattggatcaaacactatatattatggtttggggggctgggcaataaactcagatctgcaccctgatgctgctcttcagagttggatttcccaggatccatcacgtgactctcaacctcccaccctcggtcctgttgccacatggacctgggcgtttttataaagctctccaggtgatgtaatttgcagacagagatggaaagcagaaagacagagggtgttggggaagaagctgcctcggtaagacatgggtacagaagcagagtcttaggacaaatgcagtttctgacaaggcagcatgtttacatataacacagacgcagtgctctgcatcaacaggctcttctattacatgattttagaaacaaagtccaatctactttccaaaaatactgcgacagtcatggcagaagtcaggcataaggtggacgggctcagatgggagtagcaccatcactgcaatttattcttggaatgcatttccatgcctgcatttaaaaaacattcagttttaagttattgttttgaaaaaatgaaaggatattggggcaggagagctgttaatagcactttaatactttttttggtaaaagacctgagttctattcccagcacctacctcacacggctcataacagcctgtaactccagtactgagggatttaatgccctcctgcggcctcacatatggcacatacttagtcagacatacacataaataaacaaaccttaaaaaggataatgaggggctggagagatggctcagtgattaagagcactgactgctcttctagaggtcctgagttcaattcccagcagccacatggtggctcacaaccatctgtaatgggacctgatgccctattctagtgtgtctgaagacagttatagtgtactcatatacattaaataaataattaaaaacaaaacaaaacccaaaacaaaacaaaaccacagagttggacagtgttcgggaagggacagtcacctctggtcctcactttaaaaaaaaagaaagaaagaaagaaagaaagaaagaaagaaagaaagaaagaaagaaagaaagaaagaaagaaagaaagaaagagaaagaaagaaaaaaggataatgaattcatcaccaactttgactataagattgtgactgtggtggtttggccagagagagtcactattaggagatgtggccctgttggagtaggtgtggtcttgttggaggaagtatgtcattgtgggcatgggctctaagaccctcattctagctgccttcagaacaagagttgtgactctcagatcctccatccccacatctgcctgggttctgccatgctcccaccttaactgaacctctgaagctgtaagccagccccaattaaatgtccttataagagttgctttagtcatggtgtctgttcacagcagtaaaaccctaagacagtgaccaaacttattttattatagtctcatctatttgcccttctctgcatatatacttattttagtttgctttgttgttgttgtttgtttgtttgttcaaggcagagtttctctgtgtagccctggctgtcccggagcccgatctgtggactaggttggcctagaacttagagatccactctgcctccccagtactgggactaaagatgtgcaccaccactaccaccacacctggtatctctatgtatattttaagaaaatcacacactgatcattttgactaataaagtgtttatctgccgggcgtggtggcgcactgctttaatcccagcactcgggaggcagaggcaggtggatttctgagttcgaggccagcctggtctacaaagtgagttccaggacagacagggctacacagagaaaccctgtctcgaaaaaaaaaaaaaagtgtatctctgtcttagttatttttctgtcgttatgctaaaatgctcttacaaaagcaacttgagaaaggaagagtttattttgcctcagagtttcaagttaaaaatccatgcgggagggcagggagagcccgcagcaggaagcagagtgctgaatgcttctgaagctcagatcacattcccttcttaaaggtccgacaccctaaccctgggagtgctgccacctcgtggacaggctttcacgctgcaattaacttaatcaacatagtctcccacaaatgtgcccagaggcctatttcctagatgactttagttcttgtcaagttgacaactggaattaaccaccataaagactgtttttcatattaccacagtactgttggggaaaactgctaattaaggttgaagtccactgttggcatcaggagctttctacagcctctgaatccagtgatgacatcacccctaggtacaaggaccctcatgcatctgttgccatggcaaccaccacacattcccagtgtgcacctcacctgtgcaccttatctgcacttctcacctgtgcacgatggtgcacgtgattatgtcacgacccgaataaaaagcagagaccccacacccctcaccccttcttctttgcccccttcttcctcctccttctcttcctggctttccccaataaacctcttctcacggagctgtgctggtctgatacgagctgccttctaactatagcctcttggcttgttgcacaatgaaagaccctctttattagctgggtttctccttctttgaccttgcctgggaaattcaaacccctacatatgcctctacctaaggaatgccatggagcctacactaggttacaggatgaatttcctttctcctgacaggaactcattcagctagcacctgaaatgattcctgtaaagctcccccatgctaatgagacattttggtaccctaagccttcagccagtgaccttagcgcatcctgaatatttctaccttcagtcccttgagtcaccccaagtacagttgctctgactcccagcagctggtccaggtgtgttattcactgtacatactcacagggcttctgaaactcctgtctgttgtctctgctccctttgcccacatggaccaaattggcatatccacaagggcctattctagctacaatacacttcacacctccaaaaaattgcttttagtatctttacgtaggtgggtagtgtgcaagtttccaagggtctacaaatggtattctgaatatcattcaaggctaggtgtgatggtgtatgcctagaatgccagcactgggttggggaagttgaggtagaaggatcaggagttcaaggccagccttagctacctagtaagttctagggaagcctgggatatgaagccttgtctttaaaagcaaaccaaccatagatggtgtgctgcctagttttatgtcaacttgacacaagctaaagtcatctgatgggagggaacctctgaagcagaaacttctaatttctttggaaagttcgttttccagatgatgttttgctgaggacacacaggatatcttgctaaagcagaccaggaaagacttttcctgaagcagatacaggtgaaaggatgtttggatacagcaaatatgtgaaaggacacttgatgaaggagtataaagatgaccccacagacagtgggagacgagcaatggtttggtttgctccacctcactattcttgaggaaccacacacatgtgttggttcaccttgcatagcgttgctgagctcaacttgtggtgatgcctccagagagaaactctcccaagaactgcttgtgaagttcctgtggcagcttgctactgctgaggccttgcctcaggcaggtaggtgaactttgtggttccttcaggattgaactacagctgctggttcgtgcctggtgtctgcctgcctagaggactggtctacaactgctgagtcgtatttggtgtttgctatgggactgaactgctgcctaagacgactgagctcgaccccaaagaacgattgctgaactggcccacttcccccatatcctaataactttctcttctactacctctgctgggggggtgggttagaggagaggttgaacccttattaaagtgcctccataagattgagttggtggccaggcgtggtggcgcacgccttcaatcccagcacttgggaggcagaggcaggtggatttctgagtttgaggccaggctggtctacaaagtgagttccaggacagccaaggctatacagagaaaccctgtcttgaaaaacaaaaacaaaacaaaacaaacaacaacaacaaaaagattgggttggtggtcctgggattaacattcgctccttttctaaattataggctccatggaattgaaaagattgttctcacctggccaaggctggcttagcccttattctttaatcttcccagaattcccatgagagctgtactattatcgctgttttccagtggaagagagtgatgtttcagtcttgtcccaagcactcattattaaggggtagacctggagctgcacagttcctagactctgccacctactgagccctctccctggcatacagagctacaggcaccaaaaggccacttatcatatttgacttgtggggtggcgaggggtggtggtgcccagagtcagtggacagcagccaggctccaatagcatggaggcagtgaatgagaaacatgggaggacatggtatggtgagcaaagcagccggctgggatcctttgcttgggaagaggtagacagaaagccagtggaggcaagacctttagtacttggtcagacaaagaggaggaagctgaggagttggctcagcaactccatgatcggtcagaagctccaggttacccacagcgtactggtggatcatctcagcctcctcttcggctcagttacacgaggcacctcgtctcctcctccagccttctgtcctgggaacacaagaatgggtgtggcaggcagcctttgagggcacatgcgcagtagggtgaggtcatccttttcatggactgagactgggcttggttggtacctgtccctgccttctgcacttgcctcagtatctgtttatctggtgatgtggtttttgagtgataggaacactgaattaggttgattaaaaaaaaaaaaaagaatgtttgcagttctgagatccgactagtgttttctaggtgatctgcttgcagggatggctctggctactggctactggctactggcaggaagtctcagtttatggatcccgagcttcagagtgttttctgctgaactacaccagagttgcttcaacatattccactttcaacagatttcctgtgtgaccttggtgtataggtatattaaataggtgtattaaacacttactgttagaaagaaatcaatttcaaaacagttctttgaagtcaggtgtggtggtgcacacctgtttacccaacattttgaggatggaggcagaaaaattacgacttcactgacatccttggctaacatagggaggtcagggccaggcagagatacacaacctgcctcagaaaaccaaagcaaagcaaagaaaccaaagccaaacatgtttggaatgtagagcaacagaatttagtatgcttgaacccttccatcacttcccatcctctacatagggaaagagagcaagaagctttacatagaggagaactggaagggaatccagagatgatgtatctcttcctgtacccggtgaacactcccgtaactcatggctgtcttcttagagcctgcgctcttgaggtcatgtgagaaatcacagtagaaggataaaggggacagggtcagtaacactgaccctgtacattggcacaggaagctctgttcttcctgaacactctgtggaaaggatgatggggcagtgagctttacagagtataaagatgcagatatagaccctgagaagacaacaggaaatgtcatggagaagtcacgtactctgtgtgctttatgggagtttttgaaaaatccttgcaatcctgttaaaataataatttccctatattcctaccaccttgcagaatcctctctctctctcttcgttttttttgtttgtttgtttttttttgtttgtttgtttgtttgtttgtttgtttttttggagacagggtttctttgtatagccctggctgttttggaactctctttgtaaaccaggctggcctcgaactcagaaatccacctgcctcggcctcccaagtgctgggattaaaggcgtgtgccaccacgcccagctcagaatcttctctctctctctctctctctctctctctctctctctctctctctctctctctctctctctctctctctctctctctccctcctccctccccctcctctctctttctttcacttaaacaacgtcagtgggacatttattggcattaggaaaggatttctttaaacgatataaatatactgaactcaaactctccgtccagacagtcctatttcaagatgataaagcaaagaggggaagaggtaacattcctgcttctacaccacaaagtttaaggcacaagaagctagcaatccccaatgcggtacaaaactgcttcccactgtctctcaagacacagtcacttaattgtcagtccaaattctaggaaaatttcccaatacacgggggcgatcctccccatcccctgttcagtgacctgtagctgagaagccaggacaagaagactcaaagtcatcgcgctcctcattgtactccaacacgtgccgcttgatcttggatgaatccaccccggtgacaaagtcctccatgctgcgattgacgagaaaggcgggatcagtgaccacgtctgggccccacgcggacatggccttgctccacaaaagccacagcagcctggagatgctgcgccatgcgtagtttgaagagcaaagtaggcaagcggcggcggcagaaggacgaggccgagatggagtcgcagagttccagtgagccgcgcgtgggcaccaggcccagagcgtacagcttgtccaacagcgccgtcgaggcgcgcacgcggaatgggtcgcgttcgggcaggtcgcgcaggcgccgcgccagctcgcgcaccgcacgactcagctggttgtagcgcgtgtactcctcgcgccgttgctgcccgtaccgcttcagctcacgcagttcgtggaggttgtggtcggtgacttcccagtttaggaagtccacctgtttcagcagcttctgctcgtggaacttaagcttccgcaccatgatggagaaagccggagaaaaccagaatcttttcttaaagtgcaccctaactgcctttcagtcactgtgctgctgcccacagtgctctgtgttctccctgtgtttgcctccctgaagctgactgctgaggccttgacgactccttgatgatgactgatgcatgtggtcataatgaaggcaattcttgcccaaagcgttaaatgtatagatcatttgggtcttgtccttcattctaaaactaagcattccattcttgcaaatgcacgagaaatac

SEQ ID NO: 256 - DNA, 4970 bp, Mus musculus
agaaaactcacgtttaatccaagacttaaaggagtctcaaagatagactaattccaagatcaagttacataagacacagggaaataagccaccaagagtggagccagcaaaactaggccggagaaaaccaacactcagaaccgtgtccaatcagaaccatgacaatcaggtgaaattccaaagaaatatttaacatgtcacagtgtatatccctttgaaaatgcccagtcacgcttataaaagatcctagcagatttcatagatataagaattaatagcattccttgtggtatctaagtcaatagaaataaaagctagtgaagtgggtagtgtttctgaagaaattatccagggtgcccagagaaagcacaaagatgaaaaagatacagatgaggtttttaagtgcgtggcaaaagaccccagcctaagacaagtgcaagggtagacttttaggtatctctcctctcataaaatgtggacggccaaatcacaacgtcagcttgtgagaggcagtcccctcaccagctccttcccaaactgtgtttgcactagggtaatggtttctccagaataaggtgccggcctacccgataaagacaaaaaatgcgaagaaaatcgagaggtgaagacttggaacctgcacacttggaatctgatcctttacgaggcaaaaatttcttgcatcctgttccggatacggcaggattccactcctctgctgagcagcctcatgcctgcttttctcctgccacagccctgtggcagtcctcagtctctatctatcccaggggtctgaatacggcgacaaatccctggccctgagcggagctagctggagttcttccggacttgggttctgatgacatgggctcttgtgtgggtttaagcaagcgtagaaggcgggacaggaggctacaagtgcgcatgtatatgtgtgtgcgatgccatggcttcggcactgaatccagaactgtaaagtctagcgtgagatgctcttcactgtcgatgggccaccagaaccctgaggaatggctgaggaacacttgccactgccggacggtgaggtagggcggagtcgcgccgtcaggccctacagtcacagatgtacatcttcaaagaaccaaagacacagaaaaaaatcaagcagttctgttagcttggtccatgtttctcacttctttcttcttggggttcttctataaatgccatagccatagcgtcagtgggcacggagctccctcctggtttccaatagctacacgccattgactcctgtcgctactaatacaagagcctgctgcacggaacagctaatgaatgagttgactctacaggatgaaaggtaagggggtagtgagagggctcagaaaaaggcaccagtcacaatgcctgaccacctgagtggttccagaaggaattgactgctgcaaattgtcctctgacctctgtacacctgcacacaaaataaaataataagaaaaattacagggagaaagaaaaccatgggtgttgacttacaattccgctaggctccacccaacaactacctagcaacagcttgtgactccgcctgcctggtaccagccaggcctataagaaggcctctcattaccacactatttcctattctctctttctcccctttactctgtccctctgtccccacatgttcccgggccagcctcttccttttttttttttttctttctcccttttggtccttctctgtcccccatcccttctctgtctctaccccttttgttaaatcgtcttcagactaggtctgtcgcatggcttgattatgtagagggacagcttggcatgggtcctccgagatcctccctcctcctgctttgtacagaagacacaaagcacaacagtgggtgctttgaacctattttaagagcactgccttccctataagcgctatgagctaaacctgtgctcagctctcctctcccatcttcctctgctcctgtctctgcctgctgcagggattctcaagagccagatcaggcccgtggtagtagactccctgacccagccccagaagccacagtcccaggaattgaattctaaagtgcccctagcccaggccttgcaggtgcctctgcaaaaggactctggcttctgcaacccgcttgttaccctttccctggctgctcactctctccctctgaactggcctgtggtccttctggagatgagctataggatgtgtccgagcccagggaggaatcaatcagcagaagagcagacaaatgtgctatcacatcagcccattaccatcctgccaggctgccagcaacctgaaaggcagaaacgtaattgttttcctctttccagttcttcaggccagttgtctccatggtcaccgcttgtctatctctgccggtggctctccacctgggagctgttttgcttccctggaggacatctgacaaagccagagagagttttagggtgacacctggggtggtggggtcctggcatctagaaagaagatcccagggatatggttgaccatcctacatgccaggaaaaaaaattatcaggccccaaaaagcattggtgacctggccacagtgaccatcttttcctctaatgcttgtgtgggcttgaagctcctgtcaaggaagttcctgcatgtgcccagcgcatcggaatctagggtagtcataatctgctaggtgaattgaggtggaaatctatctcttatagcctcagaacccagcagtgccaccaggccacagtcctgttaagggcctaagagaggcccctttcttgtctccaacaaatttagtggctctaggttttctttggcttacggcactgaaaatcaatacctgcttctctcctttccacagcgtgggggatggtccccaggacctcctgccacaggctaggaaagtgcccctccccccccctgctgattttaccttttgttcctatggaaacccattgccagatctggaatatctacaagtatgacatgatttcatttcaggatctctcactaattataaaaatcctaataccttacacaaatacaacaaaatagttacaaagaaaagaaaaccttataccaaaaccaaacaaaccaaaaatccctctgaagttatgtgtgaattttcagcccaccacaccctaggaaggaatggcctctgggctaggagtggtgacaatggatgttttgaaatacaaaacctactgtctattctgtccattcctgacccctaagtccccaaagcatctcttcagggaagcaagagcaacagaggtgagccctacccttccagctctctgttggtgagtttagattccagacggtttgaccttctctcccaagtttctcctatacagtccctttcccctcagaaagtactcgaatgaaactagaatatcagggtctgccagagtccatggtgcctgaggcaggatttttagaggcagtattctgttgttttcttggtggtgatgttttcttttcttggtggccattattctgaggtgtgctcttgttatatagccaagcctggcctcaaacttgccaccctcctgcctcctctgtgttaagattacagctatgaggcccccatgatgacctcggtggtagctgtaattcagatcaaggccaccaactcacgtagacctcccactgaaaggtaaacaccgtatttccatcccttgaacctgggtgagcttgtaggacctctgtcaaaaggagaagtcacatggtcacaaatggctttctgctcagttcacaggggcatggtggcaggagctcacacagtctgaggtcatcatgtcagagagaccaagggaaggaccattgagagcacgggaagggagaaatgaccacaagcctcttacccttcgttcaagcaatcgcaacccaaagctcaaaatgtgtgcatggagaaaccttcagttaacttcacctttagcctccaagccttctagtttgtggctcggacatcacggagcagggaccaggcatacctaacatgacctacttaatccttggctggtagggatcagaagaggttttgcagcacagcttgtgcggtggcttgtcagacaataaagaattgaacctgggaaggagaaaggatgtctcaccgtataattccttgttccttttccccctgtctctctttggatctccatgttagaaaaacagccccataggagggaaagaaactagatgctagcagctttaattaatcctctgccttgccgcagtttcttgcatcatttatatgcctttgcccaaggaagtggctgatgttctccctaatttagggataaggaaaccttgacttataagatttgacaacgccagccaggaagccacctgggtatgaagctctgccttacccctcgcctctatgttgttcctgagcacagtgtattcagagttagcacctagattatctttgtctaaattaaattttctgcaagactgtgttcttagggaaaccaaattaaagtaccgttgaaagagccacggcaactcaggaggattaagcatgtcaaaacatccctaggcatgtttcccccaagatggcacaggctgttcatttgcttctcttgcgagattgtcttgctttgaagctcacggcaaatatcttccccgacagtgaaagagtgtgcaagggactggagcctgttcccaagtctatcccccgtggaaaacagaatggcagcaagtttcctgggggtgggggtgggggtgggggtgggggtgggaaagagcctagtggcttcaggctctacaaagtcttcctaccctttcaagaggttttctcttcagaacccctggtggcagctgtccagaggaagaatccaagtcgcttgggttgtttgtttgtttggttggttggttttggttttggttttggtttttcgagacaaggttgccctggctgacctggaactcactctgtagaccaggctggcctcgcact

SEQ ID NO: 257 - DNA, 8675 bp, Mus musculus
cagttttactattttgattttttaattacatttatttacatattgtgtatatgtggtcagaagacaactttcaggagtcaggtctcttcttccacactgtgggtcccaggaattaacggaggtcaccaggcctgtgtgaagaacaggtttgttagagcaggaaaggcacaggccctggaggagtgcagacgcgtgggtgagtaagctccgagagcctgggctctggtccacggggcaggtcactgtattgttataggccatttggtatagaacattttactttttcatcactggcagaaaaagattgttttgaaccaagtgtctcattgattttatggttttgctttccaactgattctagttttctcaccagtcccctaagttatttccttaaattttaactaactttagagacatctctgtagttttaggttctctggtgagaagggacaaactaggacagcaggcgggagtgccataaggagagggtcactcacagaaggagccagaaactgaactgtaggctggcagttcccatctcccctttgcaatttgttcctttaatttctgggccataccttgtaatgtcgaagtgacagtcttcatttagaaagagattagtggcccttctagcagtcagcaggtctggcccccaaccagccccccattttgtaattcaccacagtccatttggtcctccatggccatggaaaaaatacccctgtacaccacacccaccccagccctgactcctaatccactaacaggtgtggtctgtctacagtaatgcgcgtacccaggtgagttgggccagggtacaagtacatgtccagttggctggtgggcatatatccttccacacataaagaaaatgcccaggcatggatgtcaacagggagaatagttactggctcttacacagccaaaggtttggtcacactgatccccagtcatgttttctactggttgtatcccctcaaagttatttatacacagcaggactggggaaaaaccaagccagcaatcacagaaatcccaagcacctaaaagactgaggcataattagagctgaaggccagccttgtaactctacataaagaacttagtaagttcacaaatcccttaccttatataaatcttcaaattaatgaatatttctgtaagtgttactcttacaaaaaacatcctttgatttcattcctacaagaaaaacggacaaataagtgcaaaattacaccacatatttaaaccctgactctagacagcaatggagaaagctagtctcaggcagctgcacttgctgaatataagctctacttagaaaagctttgttccaagtatcaattctctaatgtaaaacatttcaaaaaattcataaagcctagccaagtatattattatactatctactttgttcagaccatctcatgtcaccttagtgcatcttctcatcaagcgaaccgcatatgggaatgcctaccttatcatataataaaactgcttcttttgtgaatatttattttatgttgcatgcaagagtgtttcgcctgtgtgaatgcttgtgtgcagagagggctttaggtcccctgggactggaggtacaggtggttgtgagcggccatgccagtgctcttcaccactgacctatctctccagctgctttaaacatacacagtactttttagaggtttccaactaagatcttcctagcaggcatggccagcctgtaacccagatgcaacaccatgcacctgaaaatacctatgagtgcaacccaacagttgcaattacacttaagaacgtcatatgtggttttgtttttgatagcccaattatgttgctctcatgcatcaactttgaaggtgaccatgttatgcctcaacttcaaagtcagtcttatttttgagtaaagtaggttctatggacaggaagagtaatgaaaggccaccagacaggcagtatcaggctcttaatgtgtcggccagtcctgggtcatcagcctgactaagccaagcggctgggcacaaatgaggtgttcttaactggatccctggaggtgggaagggcacaccttctggtgacaaatccatggaagttttcactttccaccaacttgcccacacctcttgctggaatcagaagttcttgcagattccaatgtttctctaccatatcagaactcatggacttcctgaccagcttcctggcctctcattgttgagctagctggaccaaagccgtgatagtaaatctgcctttgatatatacatgtctatatgtgtgtatccatttatcctttcagttctgtacctttaaagaacccagactgataacagtattctacagagtattgtgggacaatgggctatgcacagacagcctggtctccagtcaagctgaggtcttgaaccccagtggtacctgatgcgtggtaatttccacctacatgggatggtaggcgttagatcatgtctcctggacccctagagctcctgtcgaagttactgcccccacaagagaggcatgtggctaacagtgatgaagacaatgtcccaagcttctggccttctggctagactcctccaattacctagcaaaagcaagataagcagcccaccataagaggggctgtttagcccctccttgctctcttaagctttcacctttcttactctctagctccttctttctttcccttcccacctctctaagcttttacctctctctctctctctctctctctctctctcctctctctcagccttcacctttcttactaactctctttcccttcccccttctctcttcttggccatggtcagtgtctgtctctgtctctctctctcggagactgagaacctggtaccaggttcttgtccactccctgccgtgtggggtcagcggcttcacaaagccagatgccaacccagagccacatggagagtgaccagcaatcctcccacgtctgactgcccagagcaccggaactctggcaggacagattctctcccactcccctctttcccacacacccacgtcccgcagagtatcagcattctgacttcctgatagtcaatcctgctcatgaagagaagccaatgcccacaaaggggcaaagaagcaccaccaaggggacaagtactgtgtaaatctatgcttatcacactctgcaaccaagctttgggaggagatgtaaacatacttcagtaatgttaagtatttgaccacagtcccactccaaaaagtactaggcatggggatacctaattttattatagttccaccagctgtttcaattacctccataattaagtagaaatgttccaggaaaacaaccaacacatcctgactacaaacactttaaatgccccaggaactttccacatacataaactatatgcaaacataggcaagaaaaaaatcgagtacctcaagaaagatgtgtgaattggaggcctgcctggtctacatagtgaggtccaggacagccaggaatatgcagactgccttgaaaagccaaagttggggttgggagaacaccccactaggctggagagctagctcaatagttctgagaactagctgccccgagcagccacatggctcacagccctgctgactcagttccagaggacctaagtccctcttctgggcatgaattgggtgcagacacacatcggcattaacacccatacacagaaacagtttttaagaaggaaccacttacttggacatgcatgctcttatactcagtcctggattcaaatactgaatccaaatcataaatgtgaaatggacactttaaagaagccagctgatagtcaacctccaagatactagctatgaggcaaaggatggaatctttaaaacaggaaccttgtgaatgagttacagtagggcacatcattaacggtgctgagagaactagcaaagaatctgataatagtcagatgctcaagaggcacagcgctaaccctacagtagagttgactgttctgcccacagggccactgtgagaaacaactgtggaaaataaaagctcaaactacagcaaaatgcctggcatctctgaaactcagagggatttgctgtagagactgtgtactggctagctttgtgtcaacttgacacagctggagttatcacagagaaaggagcttcagttgaggaaatgcccccatgagatccagctgtaaggcattttctcaatcagtgatcaagggggaaggaccccttgtgggtggaaccatctctggactggtagtcttggctggtagtcttagtcagagagcaggctgagcaagccaggggaagccagccagtaaggaacatccctctatagctttctgcatcagctcctgctttctgacctgcttgagttccagtcctgacttccttggtgatgaacagcaatgcggaagtgtaagctgaataaacccttcccttcccaacttacttcttggtcatgtttgtgcaggaatagaaaccctaagacagaaattggtaccggaagtggggtattcctatgacaacctgaccatgttttggggaggactgtggaaggactttggaactttgggccagaagatccattcgctgttaagagctctgtgagatgttgtgtaggagcttggaagataatgttgagaacattgcagaaaaatggaggcctggcttgtgaaacttcagaggtaaaattaaagacttttttcagggccactgctattttggattgtgaaggttctgtggttctgaagaatcagctgtgattaacaagatacaagaactactaaagttaaacctttgcattactggaactattgatgctggttaactggagctaagaaattagcggtgattaagaagagaccagcatcactgaggtgaaatcttctgggaagggttttctgagagcacagaggctgtgttccagagatagccaaggttgtaccttgtgctgtggctggacttggtaatatgtaagagtcacccaggtggtactggttttgaaggcatgaaggggtcacgcagagcacctaaggctcggcactgtgagaggccatggaaggccattggtgaaggtgcagcctcagttgcaattgatggcccaggactgaaggggtcatgcaaaggggttgaggcttggcaccataaagagagcctatgagaggctattggtgaaggagcttcagttgaggaaatgcctccatgagatccagctgtaaagcattttctcaatcagtgatcaagggggagaggccccttgtgggtgggaccatctctgggctggtagtcttggttctataagagagcaggctgagcaagccagtgagtaatatccctccatggtctctgcatcagctcctgctttctgacctgcttgagttccagtcctgacttcctttggtgatgaacagcaatgtggaaaagtgtaagccgaataaaccctttccttcccaacttgcttcttggtcatgatgtttgtccaggaatagaaaccctgactaagacagactgcttaagagttaagaggactggggtccgattcatagcacacacatggcagcttcactctccaactgcagtggcaggggatctgatgcccccttacagccttctcaggcaccatgtatgcacacggtgcagacaaaacacccacacacacaaaggcctgtcgttaagacaggaggcctgggttggagaaacttccaagtcgtcctctgacctccacaccaacaaggacacaatgattgtctaaataaaagttctctgccaccccgaaaataggtaattaagatttcaccaaagcctttaggattccagtctttacttcataatctttcccagactgtatcactcagaatatttaatatatacaaaacaaatgactctacctttcctgtatttcgtaatcatcttccaacgtcacgcatctcttccaggcatcaccgagaacacaattcctgaaaaaagattgtattttaaatcgtgtgccaggggctgaggcctgtggctgccgcatctcctttaggaaagcttgcatatcctcattagttcctcaataatcacaacggctcagtatgtgaacagcagtgaagagtttaatcatcggatatgcagccactagcggaaacagcaaagagctcagagcactccatgcccaccaagttctctaatgtctcttaacgttgctgttttagttaaaggtctatgacatttaagtaaatgccttttgcagtcccccatctgtcagtattacaatgtatcacattaccagaattcagagcagtatagccacagggcttgtcagagggactctcaggacccctgcatctctcctaggagaccctcagcagcaggcacccaattaaacaggcatctcactgagatgctcccaggctttctcctcagctgcagcacccccttttgtgagaatctcagcagattatgtttctgaaaccacttagcccgtgtggtggtctgacatggcccctcatgtattcgcatgatctgtccccaggtgagctgtccgggaaggattaggaggtgtggccttgttggaaaccaaaagcccatgcagtgagtcttgctctctgctggcaaagcaggatgtgaagcaacggtgccagcaccatgccttcctgcctggctgtcccagcatataggactgacccgtacaacggtaagccagccccagcacaacggaccaacccctacaactgtaagccagccccagcatgatggcttcctgtaagagttgctgtactcatgctgtgtcttcacagcctaggattcctgcttctccggtagtgtcgtggcacttagtacctcatgttcttttactatgttaacaatgttggaaaaccaaagtattcttcgggtactattcacttcacaaaattttctccaatcataaccttgatactttttgaaaatttttatttttcggcatagctgttttacctgtgcgtttctttgtgtagcactgactggctgtccaagaactcactcactctgtagagcaggctggcaagtgctctgccctttaatctgctgcctctgcagggattaaaggcacacactgccaccgctgctggcaataaggatgacctcttaccattattctgtaggagaaaagccagccacaaaaatcctatgtactaaagaaaaaactccgatgcactagtctattatcccatctatgtgaatcatacagaacaggcaatctacaggtacaggtgctcctagggactgggggacaaagggacagctaatgtgaatggagtttctttggagaagagatagggtgcagctggtaaagcctagtgttcccagagccctaaggttcaaccttcagcacattaactgggcttggcaggaacacacaccactggggaggtggaggcaagatgatcaatagaacagtcatgccaagctacacagcaagtctaatctagcccgggttacatgagacctgtctaaaaaaacaaaatgaatgtttttacagggtggggttagacctctactctaaaactggcctgaacctttactcccagcttcatgggagacccattcagaaagatcacccccaggttgaaaacggactctaggagacaagcccagctcagtaagataaaattgtatctgttctaaaggcaagcgtaggttggtgatgcagtgactgaaatcatgcacaaatcctgggcttgagtcccagcactgcaagataaaaaccccgatgtgctgagagctgattacatgagaccagactgaacttcacttaactcactgccaattgtgaaaaacctcacctaaggataaacacacagccttgtattcttgacagtcaagcaaacacttgtaccatagcacccgattccccagaagttcatgggctgcgttttatttaaaaaaataaaaataaaaggaaaaacccagcaaaatgttgatttcatccaaataagataaaagcatatataatggaaaaacatgaataaattaattccttgatgacttcaattctcagtaaaataggaggtaaaaaaaacttgttggaattgaattttgtatcatttgaaggatacaaagaagtcaaaggttttaatcactgggctccaataaaatcgcctagtcctgaaagctatccaccctcgatgccctattcccaaactcaaacaaagttctgtgggccctaagtttccgtacccgtgcagttcccatcgcactggagacagcaagggcccgagagacctcaccttctttcattagccacctcccatcttcagaaaaagcgttctctcatgaggacagcggagcagtcccactcaagctgctgtgcatcacatccacagcgccaggtcacatcgagagctcctgtgccccctcgccatccgtgacctacaaaagagacgagatgaggcctgagatcgctcttttgtcccgcctgctacacaacattcggcggacatcacgacctgttcctacccatttggcgccattctccaatcagtccttcccggcgcgcgccaccatcgccagggtcaggcaggcgtcagctcggtttccacctctctactccccatggccatgctcgcccaaagcgcgatggcgccggattgcgcgggagctggcgtagacatgatgccagagcgttaacaaaaggaggaccgaatgga

SEQ ID NO: 258 - DNA, 25002 bp, Mus musculus
ccctaagctaaagactaccagagagtcagactccaatctaagtcttcataatctgctatactatatctgtgggtttgctttgtctgtgacagtgtcatgtcactaaaattgtctttacagttaatgcaattatggcaatgatgtgcttctcagtcataaattcttgattctgattaatgcaatacaagatgactatggtggaatatacagcactgtgaaaaacactctatctctttaagggccaccattgtttacttagttctcaatcctggacttctgaatacaaaccattgaactgaagtgagtcttctcttctctaatggtcttacagcagatgtagctttcaaacacaagattctacaggagggtctttttgatgaagcatgcattctagttgtagtgatgttccttgcatatgtagtcacaaataagcatacagggcaactgccatgggacccttaagaagacaaacaggggctaaacagattcttcattcagtaagagtgcttattgcttttgagagaacctgggtttggttctcagcacctacatgctaacaggattgtttgtgattccagctccaggggacctggtatgctcttctggcttcctcaggtatctgaccgacatatggtgtatatacatacatgcaggcactcatacgtacaatacattaaaaataagtgtatcctttaaaagaggataaaaaggaaaacctctgtaatgacataggagttacaattaagattcttgaatttttttatacagatacctaaaggatataaattcttcatttggtaaataaataaatggtaacaatgggtgtgggtagtttgctcagttgttaagatcacttgctgatctcgcagaagaacctgggatcacttcccagcactgaaattatgaatggttacaagctatcatgaacatgctgggacataacagaccctctctaagagaaacctgtattcttactccctgagccatctatctagatccttattttatctttggacacagtctcactctgaagcctacactggccttggactcctgataaacatcctgactcagtctgccaagtgttgtgattataatacttttttctcctgttttcctaagaattgtctgaaagcattggcttgtcaatattttactaaaactaattgcttgggatgaaatggtgaacagacaagaggaaaagagagaagatgtaacaaagagagatcatggctagatgcaggtcgtatagagaagagaaattacacaaatgcaacacttgaaagtaaaataatgaaagtatcatgctataatttactggaaaggagtccaaagacaagcagattagatgagggaggtggggggggggggtgacacgagatcttttttgggcataccacatgtgacttatcactgaaatgttcaaaggatataatgcagcccttcagatattgacatattgacattggaactcagataagacattcaaatagaaacacgaatgcttgtatcatttgcatacagctgggcataggaagaaaagaatgtgaaaaaagaaaacaaagggccattttggaggaaaaaaaaaaccaaaatggtagagggaaagttgaaccttaaaggaaatacttaaataaaaccttaaatagaaacattgggctatgggggaaaatgccatagaaatgtttcataaaaatgtcaggcaagggacggtaacttggaagaagatggcttatttagaatgagtgagtacttagacttgatatccagaaatgaaaaaagaaagtacaattaccagtaacatttactgctgataaattgaatgccatgctactttcttttcctgttgctttgataaaacaaaagcagttgacaaaagcagtcgagggagatgggggttatttcagctcacagtgcaagggtcttgtccacgaaggcaggggagttggagcagccagtgcttagagtagctggtcatgtggcatccatccttagggttcagagggccatggatttctgagtgcagctcacttccctctttatgtagatcctagttctcatcccaagggatgatgtcatccccagtggtcaggtcttgccacttcagtcaactcagtcaagatcgtctcctcataagaatgcgcagagatccatcttcaaggcgactttatatcttatcaagtgaataattgatattaatcaccacaagatctgaaaaactgtaaaatctattgtatacttcaccttattttcttctgtgctttaagtatgttgggcttaattcatttttgtatatgcatatatttaattctcaaaataacctatagctaatcaaacatgtaaaccattataaatactgatatcctggtagattcttattagataagaaatgtatgcttcatgaaaatatttcaaatgttaaacagtgaattgtgattgtaagataggagtcacacaaacacataatcttagagcctctacactgtaaaaagttacgtttaaaatctttattttgtgtatgtgtgtgacttggatacacagcaagtttaaggcctgtgctatgtcagatcttgtctcaagaaaccaaacaaaggaaaaatcaaattcaaatatatgatgttaaaaaaaaactatcaatttagcacaaggctaattgcaaaacctgaagaaaacagaaagaaaataaaaaccatatttgaatgagaggggggtggagaggaagagggagggagggagggagggagggagggagggagggagggagggagggagggagggagggagggaggcatagtcaatggagtgtttgtctggcttgcaccaagccctaggttcattctccaaactgggcatcggagaaaacttccactgcatagggagtgtgaggcccatctgagacatgatttgctgtctaagaaagaaaagagaaagcaggtggagggagggagggagggagggagggagggagggagggagggagggagggaggaccaaagcacaagctgacagatggttcatttcatgttccaacttgcctaggacaagggatgccccgatagctgggtgttcctgggagggcgttcctggaagagcttaagatctgggtcatcaggctgagttaagaagagttgccttgagtatctgagtgaacatcatccagtccattgacagcccacctaggaaatgtacagcaaggaccccctctctccttcatgagctgggacttctgctgtttggacactggaggtcatggcaagtctccacctttggttttgtttttctgatgcactatgggagctctgttcagtgagttggcactgtaatgccttaatgtgtggtggccagcagtggcaagagcaaggtagtctctgcactgaggaggaacctaagtgggcagcctcctctcctcccagtttaattttccatatttccagaaactttaaattgtctgtgtaggtaccaatgcataagccttatgggaccatcttacacaggatgtattgtaggatttttcaactcctatattttcaggaactgattcccataatctttccctccccctctccctcctcctctccctccccctccctctctctcccctccccctccccctctctttctccataatctaatagggtgaaaataaataagagtgagttcctgcactgttttcataaatggattgccaaaaactagttaataagctaaccctcaattaaaatggctaatcaaaatacaaaaggcagaagctcccataatacaatggaaaaaacaaaaacaaaaaacaaaaaacagaggacagtcaggatgtagccacctctctcctctaagttcatcaacaaagttatgttcttgttccattgatatgaaactgtaaaaatctggaaaaaaactattatttttaaaaatatgaatactacaaaagaaattgaacaagaaattcagacaaatgtgcattatttgtaaatgtacattaaatgtaaatctgagccagttggtgaagtgcctagctcctaaagaagtgtaaatatctctctaacttcacagacaggtgatttggttactcaaaatgaatagaggtacttgtggccaaacctgaagacctgagatgagcccctgatggaaggagagagctgattctctccatccatttgtccttgcatctccacgtgtgcttgtacactcaaaatacacacaaacacacacagtagggggatgtatttttaacaaattaacttcaatgatatttagcttatctccaccctacagagaaggggaaggccaccactactaatttttaagacccctccatgtcattgtttcaaaccaatctagcatgccctgtttgaacttctggtgttatcaaatactagaaccttccacagtgaataaagaattctccttccctcagatcagtggcttagagacttttgctttccctgacttctttcaagtagggttaagcacagattccaggcttcaccagtcagatgtggtcacaatgcagtgagaatcagccaaccattcaggatcagagcttgtgcccagaagcctgacagatgaaccatttgtattcacttctggcctccagagacagcagaggccactgctctgatgtaccatgggggctctgtagggtacattgacaaagtaatgcctaaatgtgtagtgattggttgtggcaagaacacagtggtctcgacactagggaagatcctaagtgtgctacctcctgccagtttaggtttttttgttttgttttgttttgttttgttttgtattcccagaaacttccaaatgtcttcatgaatccctgtcttcctttcttcctccaccctctctactttgcttccttccttctttcttttcttccttttctttctcctcctctaacttcattgtcttcatcatcatcatcatcatcttcatctttgtcttcttattctctctctctctctctctctctctctctccccctctctctctctctccccctctctctctccctccctccctctctccctccctccctccctccttccccctccctctgagaaaaggtcttacagtatagtcctggctagcctacaactcaatatatagcccagtgatcctttgatcctcagcccagtgagtgccacatctgtactggataattttataccaaattgacacaagaaaatcatcagacaggaggtagcatcacttgaaaacatggtctataaggtcaggttgtaggcaggactataagatatattcttgatcagtgacagatgaaggaaggcccagacaattgtaggcagtaccaacccttatctggtgaccctgggttctataagaaaaccagatgaataagccattaagagcaagacagtaagaagtactcctccagggcctctgcatcagctcctgccctgtttgagttcctctcctgacttatttcaatgatgaacagtaaatgaacgtaagccgaataaaccctttcctcctcagcttgctttggtcgtgcagttttatcacagtaacagtaatcctaactaaggcacacctttggtgtggagcccttttcatcagctggaaattgtttttgctttctccaaatgagaattcaggctaacaaacaatcaaactgcagaagcaaatactgacaaaggggtgatctaagactacagtcccaaggctgaggcaggaggagtacaatgagttcaaggccacattgatctacatagaattgactaaatgtgaggatataaggaacccacgtctcaaacaaagaaaacacatataacctggagcagagccttcttccccaagacgatcaaagttagtggacaattgcttagtaggatagaatgacactaaaaaattaaataaataaaaaataaataataatcaattcaccatgactcataggggttttcccaaagaagaactttcagcattaagaaatctgttggtataatggacataattaaaaggtcaaaggaaataagccatttaatcctgagcaatgccagaagaaattaacattaactgtcctccagtgagtcaataaagcctctagacatctggaaggagagggtctttctcagatagctcatttcaagaccaactgcatcatccttatagggatgctacagtgacctttccattaacatggagaataaaataagcacatatactactaccttaatatcaggtactgtagtttcctaagaactgaataattaagaaaagaaaaaatgaacccaacatcaggctcatgtctctaatttcagcatttaggaagtgaagaaaaaggatcagggttcagggtcatcctgtattacccataatccaagatcagcctagaacataccccaacttgaaagaaagaaagaaagaaagaaagaaagaaagaaagaaagaaagaaagaaagaaagaaagaaagaaagaaattaaagagcaaaagggagagaataaataaaggtaaaagggagggagggagagagggaaggagggagggagggagggagggagggagggagggagggagggaggaagaagtaattaagccatggtggtggctcacatttgtattcacatcatgctggagcctgaggcaggatggttttgaactttggtttttagctcagtgatgaagggttcatacttgtctgcctcaaatttcagtttgactttaggcaaataatgtgacttttctatgcttttgtgtctttatctgtaagtacctgataaaatgggagtgttggggaaggactgtgacaaatgcccttggaaggaagaggcaggagaatctagaattcaaggtcatacttggctgtacagtgaggtcaaagccagaaagaactacaagagtctgcctcagattttaggagggaaggaaggaaggaaggaaggaaggaaggaaggaaggaagtaaggaaggaaggaaggaaggaaggaaggaagcaggctcatcttagggtctgcctgtaagcatatcaggatcaggaacccaggtcattctgaaaggaaataaaacgtgagacatgtgattcatgtaatttatgtcaaatagcccaaagagttgtttgtgagctttgaaacctgggattgagaacatagcagaacaggccaggtcatgcccgggcaggcccgtcgttacatgtcctgactggcctagtgcctccctatctcccgcccttctgacagtctgttaatgtttaaatggaatttaacattaaattaaatcatggaaattaaatcatgtgaaaccgcgccaattcctcccccagccccaccccttttctataaaagtccctagctcccaagcctcggggtcaaaaccacggtctcctgtgtgagatacgtttcgaaccggagctccgccattatggctccaccatgtggtcgacacctctgtctcctgcgggagatatgtgtcggccaggagctccgtcattaaactacctcatgcttttacatcaagatggtcgtctgttcgtgattcggtcgtctgttcgtgattcggtgcaggccgaatcgagaattgagtgggggtttccccactaggttctttcaattcttagctatacagcaagttcaaagccagccagggctacaggaaacgaagtgtcataaagggaaagaataagccaatacaaggtgtgtgtctttattcccagcctcaggaggcagagactggtgtcctgctggagtttaagaccagctttgtctacatgtaagtcagtgagatagtcatggtgagatcctgtctttacaaaaatcagtgctggacaggataggggtgagcttataatccccgcgctggggatgactaggcaggaaaatagaggagagctcaggttaccacttgggctacactgtgtgacccagcctcctcaaaaacaatgtttcttaaagagttaccctaaaatcattaaaacagaaaaagagatgttgaaaatatatagtatgaagcaaaatctgtaagaaaaacatatgacatataattagttcattaattagtagtgttttcagttttgtaatgattatcaatttttaatttttaggtttgtttgtttttgtttttggtggtggtgctttggttttttgtttgtttgtttttccttttttcttttggttttttcgagacagggtttctctgtgtagccctggctgtcctggaactaactctgtagaccaggctggcctcgaactcagaaatccacctgtctctgcctcccgagtgctgggattaaaggcgtgtgccaccactgcccagctggtttttttaaaaggggttttctctgtgcagccctggctatcctgatcactctgtagacctcaaactcagagatctgactgcctctgcctcccaagtgctgaaattaaagcaatgtaccaccactgcccagctttaaattttgtattgtcatgtactatacattcatggttttgacctacctttctttcctttcctttcctttcctttcctttcctttcctttcctttcctttcctttcctttcctttcctttcctttcctttcctttcctttccttccttcctttctctctctctctctctctctctctctctctctctctctctctctctctttctttctttcttatattcttcttttttcttgagacagttttatcatgtagccttcactgactggcctgagatctccctgctttgcctcttaagagttgtaattaaaggtgtgccaacatacctggccttacttttacattttaaactgtgtgtgtgtgtgtgtgtgtgtgtgtgtgtgtgtgtgtgtgtgtgtgtggtatgtgtgatatgtgtggtggtgtgtgtgtgtgtatacactacagctcaccctaaagttggagtcagttctctccttcaaccatgtacaaaccaggccatcaggcttggtgaaaaggacgtcttaccctgagcattaccatcaaccccatattcaaaatgtaaatgcattctttggcttaatttgatattttacatctcttttcttaaaaaggctcctctttgataggcatggtggcttgcatcagtactcagatggccgaggaaggaagaagactgcagagcttacagcataaggtttaagcacccagatctttgctacctaacattgtacaactaatacgtacttgaatatttagtgtacagatatttcatatagagtaatctgattcccaaatcagtaatataaaagacattagtacacatattgggggaggtgctggagaaacagtttagtggtcgagtgctctgtagtatgtgtgagtcctgtgtttggtccttgttaccatgaaaaactaaagaagtaaataaataaagatggaaaagatgtggtcagctttccccttaagaaaattaaatcacacaggagttagataccaaaatgtaaaatacttttcatctgttgttcaagtttaacacctaaatatatataataaccaacagctacaagaagttcacatgattagaaatgttctagatgtggcccctgtggggtcctataccattccaactaaaaatgagaagactagaacacaaaacactcatatactttttctcagaccaagcaacaagacattcattaactgaacttaaaactgcacacgttcctactactgcatagtataggcaacagaagggagtaaacacctaaacttcctgtttgcagttcactaggggtgtggccttaccatctgagtggtttcattagtctccccagcatgccttccttcagcagatactcatcaatgctgtaatgtaatgaagaaatcagtgaacaaaggtactagagtaaacatttgatagcagttattttttctgtactaacaattactggtataagagtgactgcctgcaccaaagtaaaggggtttaaatgccttcactgtcattccatctctccgtccttccctccctccccatcccttcctgtcaaacaatataaagaatagtatttatgacataggttgttatattagctcaccctagcttgactggaagaccctgcctcaatgggttaaagtgcagggaagtaaagcaggcctcaccatgtcctcccctggccttggtatgcacatccctgagtgctagtacttgtacacattaccattaccatgcatatggttctcacacacatacatacatacacacacatgtgtgtgtatatatatgtatgtgtatatatatatatatatacacacatatatacacatacacacatatacttgcacatacacacacacatatatatatacatatacacacatacacacatatacgtacatatacatatatatacatatatatatacatatacacacatatacacacatacacatactaatgcacacatacacacacatatatacacacacatatacatacacacacatacacacacgcacacacacacacacacacactggagtctagcatgtagaagccagtagaagcacttgctgtgaatcctgacaacctgagttcaattctcaaagcccacacaaatatgaaaggagagaactgactccatttcatagaagctgtcctctgacctctacatataggccaggaaccatgctctaagccccttcacaataatagctgttaaaaaagaaatataaactgtacaaaagatgtagctgaatgtatgaggattactttagattaaattttagaaatactttatctccacctagcttcaaaattaaatgtattaaatgtgcctattaagttatttttataacttttaatttttaaaattcttttgttgtcattgtttgttgtttgggtttttgaggcagggcctcctatagcccaggctgtcctggaactagttatgttgttgagaatggccttgaagtctttatcttcctgcctcctccaacccctaagggctgggatgccagacagacgtcagcacaccaggcttcaaaattatttcttaagtgaaaatatttgataagaaacttaaaagtgggaggttgacatcttctctaaataaaatttttccattcattactaaaataaatgacattcgacacttataagtgaaaacagctgatttgcacagccagcttttattcaaatgtcaatggaagaacctaaatgtaaaagcatagcttgatgctcttgtggaagtggaggctgtctctgaccctttttgcatgttttggggaccctgttcctcttacttatcaagccttgatatgaggatatgtgcctggtcttactttagcttgttaggccctgtgcgggtgacatcctttgcagacctgctcttttttaaaggaaaacagaggagaagtggatctggggtaagacatgaggttgggggagatcatggaagaaaagagggaggggaaactatggctaggatgtagtatataagagaaggatagatagatagatagatagatagatagatagatagatagatagatagatagatagaagcaatgtttgcaagcctacacatggcaccaaaatgaaatcatgatgaaccacattaaaccatgttctggctatccaagattaaaatcttggcaatgataatctctaaagaaggtacttctcccccctaataaccatcagcccaaagattgatctgagagtattgtaaggatccagatgtgcatgggctgccagtgtggtatctactaactgcagttctggttacttgccctcgtcgcatggctaggtatttgtttagttttatggtgcccaggacaaagtgggtacaagagagaaaaagtagatattcaagaggaagaagcaactctgaagttttacctgtggatcatggtaatatttatggccttacaaccttgacctggatgtcacagtggtgtggcagtatatggctccaattgcctctctatgaggtccatggctcaggcactgttctctgttgcaacaggatccttctgcacatgtttattgggagagcattgactgcataggcgaaagaccctgagcccagaaatggtgctgcttatatataagcctataggcctaggagtgacatatccatacctgattggttatgctaccagtacctcattaatatgcgtcgggccaggcagcgactctgcaaaaaactcttatgcacatgcacacattggttgtttacccatattcatgggcggtggccagtggtagccagcgccaccctgcaaaggcacatgtggcttcccacagttctctgaggatagaacatagaacaacacagtacctgaagtatgttttctctgtcatctccatctccatcatgtccatcatctctgccatctccaagctaagactttgactctctactgggccagtagagttccagcaccagagcacaggaagaaaggagtcaacaggaagtgtggtagatgaagtagctaaacccatcattattatggctctaggcttctgtgtgatggtcgtctctcttaagccacttggccccatgcctggaacaagtgaagtggatacaagggccaaaagcagcccaaagtatggaattagtagataaattgtgtagagtgtgattcaaaggataaagtcaaatttaaaagatgataactgagagtcaagaatgaaatgatgagttaaatctgctgagcaacacacatgtggcctcaaggcttgggcatgaagggacataccatgcctggaagcagaggcatgctgtagatttagatttctccctagacttcaaagccgacctcagaagtgacttatctttacattaactttgagcaaacggggaaactgaggcctaacccatgtaagcacttgtccagagtacaacatcacatacttccttgtctgagaccatgccacatgcttcagttgaaatacttccttctgaaaaccacatacgtataaagatgggcccttgatagaaacaggacctgagtcttttacataaaaccaaatgatccatgacagatgcagtgacacacccctgtaatcccaacacttgggaggctgaagcaggtgactcaggaattcaagccagtctgaaataaccagacccccattatcattgtcactaaacaaaacaacaacaatgaaattgaagtacacaaataagacacccgtggcaagacagaaggagggaaactattccactttacatatgagaattaggcatccttagcaactaaatttatttatttgtttgacatttattatttctttgtgtgcacagttatgggggggtgtgtgtatgcaacttgtgggagttggttttcaaatttcttccttgtgagttccagaatcaacctcaagttaccagattagtagaaagcaccttcactgtttaggtggtccattttcagtatgaaatagaactcatccctcaacacatatttacagactaatatgtttatttttattcatttacaagtgttaatgtagtaggctattaaactatagttatgctatctcataaagttattcctaagaatacttcaagtgctaaaagtatcggtaaaactggcccctctggaccagccctaaattcctatatgatatgatccagaactagagattgactgcctggccatttcactgttactactccacttctataaacaaggcttgctcgttgcagatgtctagagcagtctctctgtacacatcataactgcaggttttcctgttaatctgcttgggacagtcctgtgagtagctaataaaggctccattcaatttattcaggactttctcaggagtttttctcttcaggtaccccatgacataattgaattgcttgccccctagtttgtcttttaattatgttgatttggtacacttaaacctgtaaaaatatttagcatttacccttcccccacattcacaaagatgagaccctggttctcttctattccccctcaaaaccctgagacccttaaaatggacttatattgtgttttgtcttgtcttgtctgtcttgtcttgtcttgtcttgtcttgtcttgtcttgtcttgtcttgtcttgtcttgtcttgtcttgtcttgtagaggataggttgagtttttagtatggtgagatgaaaagatccagggggggtaattagacatgtggcttttgagattcatgtgagagtatagaggagatgctgtgaagtggccctggcgtcatgggagggatgcaaacctgggagactggaaggcttattcaaaaggaggggagaaggtgtcttcactggcaagtcctttgtggatgtgggaagagggctaggaggagtctgtcccttacgtatctgtccttagggcagagtgaggctctggctgaaaaggaaatagacttcccatctgtgctcagagcataagcagctgtcactgtttagagctacgcattcctccttgaagattttctccagtgattgtgaagagtcagcacacaaacacgcagtgccttcagcacaggcatttccttacagcagtacagatgcagagatgggatcaacaataaagaacagccaaagtcagaagccatcattcataggtagaagttaattttaaaataaagcttatttgtagtctagaaataaagagtagctagatcgtctcagtacctcctctcccgcaggctcctagcaacagcttctgcctgagtgcttctagtgttgttgtcaatgaaaacacactgggacccaaatccatcatacacactacagtttattctacagttgaaaataccatttgtcgaatatgtgatgacttctccccagttgtatgttgaaatcctgtagtatactactgcctcttatattggtgtctgaagttctcaagaaaagaagaagaagaagaagaagaagaagaagaagaagaagaagaagaagaagaagaagaagaagaaccatattgtgttcgattctacaaggaggaatgcaaattagaacttcccgattgagcagtagaatctcacaggttatctgggccacttttagttcctttaatagccgttcattgtccatccttgtgggcactacactaacatccctttcactgtcatataaagcctgttcagatgtgttcttagcagatccccagtttcctccaatcccaaagctaggactatcattaggacacatctaaaacctatagttagagtttcgcttgccttgcataaaccacctacctttggaccctcacaattaagtaagagtcttgatttagactctcttttttctggaagtagtagtttcatgtacctgcatccatagtacagggtattcaagggtaacctgaattcctgttagtatagggccaggtcacttatattgggctcagaataaacaatcccttcccccctttaaggtatgagctattttgcaactacattcacttagtaattaatatgcactcagattcttcattctcttttcacagatcagatctcatttcctgttaggtctgaattatatcccaggactatagtctagccattccagcttagccttttggtaaatacccagtcacatggctgccaaatcatagtaagggtctgtttacttttgtgaaaagaaatgcaacagctgcaagtctctcccacaggctgagccattcttcattcacacaggcagggacggagggctcccttttctctgcagcctttgttgttgtaaaggcactgggtgtgtgccattcttatagataccacagttcattttatctaattgtgtatcttttgtgcttgtgagatttatttatttattttgatttttcaagacagggtttctctgtatagtcctggctgatctgaaactcactctgtagaccaagctggcttcgaactcagaaatctacctgcctctgcctcccgagtgctgggattaaaggtgtgcgccaccacgcccggctgtgagatttatttttatctattgtgttttgtttatttgtttcaagaggtctctttaactagctcaggctggccttgatgtccaagctggtctgaaactcacaatacttccacaggctcaatctcctgagacctgagattacagatatgaggtgatgtgagtgcgtgtatgtatacaaatatatacatgtatgtatttatgtatgtatgtatgcatgtatgtatgtatgcatgcatgtatatgtattatttgttctggtgtctgtttaggtttttgattgacttgttaataggactatttaacttttaagaagtcttacatttttggtagataatatctgatgctttctgcaaatattttttccctatggttgccttctcattctcctaccatcctttgtaaagctgaaattttaaatttcactgcagtccagattattacatttctttaatggatgaagcacttaacatggcattaaaaattgtcattacacttgtgatggttgttcttggttgtcagcctgcctatatctggaattaactgaaactaagcagctgagtacaccttggagagttttttgttccttaaatagcaggaactaattaaaagtggaaacacacacttttactctggatttctttttctttttctttatttttttaaagatttatttatttatttatttatttatttatttatttatttatttatttatttattatatgtaagtatgctgtagctgtcttcagacaccccagaagtgggtcgtcagatctcggtatggatggttgtgagccaccatgtggttgcttggatttgaactcaggaccttcagaaaagcagctggtgctcttacctgctgagccatctcaccagccccttctctggatttcttaaggtaggaggatccaactttaacctgggccacaacttctgacggcagcctatgtaaaagacatggaaaaaggaagatttctctccgtccccacttgccaatattcttgttctggctggcaagtccatccctccattgacattagagcctacttcttcagggttcctgtgtatactccagagcagctgagtcctccagtcttagggattgaacaccttgggaggacttgaagcttcctatgactgacagctgttggaggactagcaagatcacaggctgcaagccattcatataaatccccttgatagataaatggtagatacatagataaataggcagacagacagacaaccagatagatagatagatagatagatagatagatagatagatagatagatagatagatagatagacagacagatagattcattgtttcagtctgtttctctacaaaatccttacgaatacaaatttttggcaacagaagttgttctagaacaaaagaagtataggaatgaattttttaaaagtacctggatgatgctatccaatttgccaatgtgtactatggttaccaaaggctcttctagaagcttggagaatattgaaagcccatagggtgaactattttacaaacttatctgggcagaagcagtagcttatctagatttaccaattgtgattttgtgattttgtgtatacaaaaatttgacaatttgtgggaaaataagaaaaataatgatgctggttcattgctcttatcatttctatataaattgacaatggaaaagaatgagctctctgataaaattaaccaacttgaagcatctcagaatacagtgaaggacagcaataaactcagtgataatactgacaggctccaaataaacagtctaaaggtttctaaatgtgctctggaagagaatcttctctgtagcacccacagagctcaagttgtagaaatcaagctgaaaccctcattataaagttgactaaattacaaagaaaatttaagtgccagccttagagggtgtcgactgtggaacctttgactgaggaaattattccttcaacatctgttaagccaattccctgaaggagatgccagcccaaacaatactactgtcatctccaaggcttacagctaaataagctcaccctttctagttctttctgaatgatggctggctggttcaactcagctgttctggctcaaactcctcttcaagctgactgattcaaataggcttctctcggcttttcactgaattattctgtttggcttaaactacttctggaaatttgttctaatcttctggtccttctcattctctggcttcagctgcctctgctgacctacatgaacctcccaaactgcacggaactcaggaacgaactcaactgaacctgactgtgctgcaggaattgcactgactggaatgattcaactgagatgattctactgaaagttactgtattgcctgaactcaactgctctgcactcattgaactgccctccctcactcaagtcacctccccttcctgtgctgttctcccgggagttggtcgtatcttatctctgattcattctgtcaaatctttctctgactcttcactttgtctgcctctcaattagaagtcattttcaaacatgtctgcttccatctacaaactaactttaccttcattgcttgggattaaaggtgtgttgatatggtagccaaagggattaaaggaatgtactaagggcatgtctgcattccagtcagagcacacagacacagaaggtctttggatgtaatgccttggtagaacagccatgttgctggattaaaatttctctgtatcttccaacttagtttcaggaagattttgctgatgattcttatggacatcctatagaaaagaacaagtatctgttaagatgattttattgctatcttactctattactaagaaaaaactcacacacatttatttatttatttatttattcattcattcattttttttttaatgacacaacatgtcatgtgagcaggctgaccttgaacttgttatgagctgagaattactggactccagattgtcttgcctcaactcccaaggatttggaatacaaatattcagcatcatatctggctggtatacagtttaaaagcagcagcaagggagtaactctggagtggtggctcagtgtttatgaaagcttgctatacatgaagaagggagttagatcccagtaataagttgggcgtcatgactctttcttccagtctcagggagtacacagatacatcaatttacactcacatacctgtgtatacacctacaaacaaacaaataaactttttaaaagagcaacaaacagggacaaaattgtcttgtttggatgttactggaaatgtttctaattccttaccagttatggtattagcttcaagtttggggtatatcttggcaggaatggagacatttaccttctatttccaattacctggagtatgactatctttttttttttccttaaggttgtctatatacatttgggatagtgacatagctttgcatagaagaaataaattccacttaatcatgatgtataattaattatatttgcaggctggtggacttgatttttttaatgttgtgtttaaaagcttatgtattgatatatattgcctacattgtggttttgcctatgttttgtctatgaaccacatgtgtgtacctcttgtcctcagatgtcagaagaggatgttgaatcctctgaagtaggaattccagaggattgtgaaaagtttggtgagtcctgggaatcaaaccccagccatcgggatgaagagttggtgctctgaaccatcttttaagccatctctccagcccacgcgtttaaatcttgcttggctattcatgttcaatattacgctgtagtttgcttgttgattttagtgttagggtcatgctggcctcatagacagagctaggcagtcatgcctctattcttattttctaatacagactgtgtggaagtgatacatgtcctttaaacatttgatggagttcaccagcaagcctgtataagcctgattctttctgtttggcagggtgacattgattcaatgctttaatagataaaagccggcttagcttgttttcttcatacatgaggttttataaaatttgctttcaaaggttggtataaggggctatagaaatggctcagtgattaaaagtactgactgctcttccagtggacccgaattcaattccctggaccaacatggcagcttataactttctataactatagttctagggggtatgatgttctcttctggccccaacaggcaacaataattcatgaagtatacagtgatactcacagacaaaacacacacaaaataaataaataaataaataaataaataaataaataaagcatatacacacatatatatgtgttaaaatatatgtacaaataatatataacaatacataatataatatgatttgtgatatatggtatatattataatgtgatatatgatatatatgtatatgtatgtatatatatatatatatatatatatatatatatatagagagagagagagagagagagagagagagagagagagaaagagaattagtgcaaaggtggcttggtggataagaatacttatttggcaggcatgaggacctaaatttgaatctccatcactcacataaaaaattggacaatcatataccaataaccctagcacttggcagtagagacaggaggatgcaagaactcattactcagtcaacctagcccagaaagcatggttttcattcggtaaaatgccctctttcaaggtaacaaggtagagagcaattgaggaaagcatttatgtattgcactgacctccaaaagaggaagagtctgctctgatctccaaaagcatgcgggaggaatctacatacttacttttaggcaccccatacatacaccatataaacagagaaggaaatcagaggaaacggagatttatacattcaattgagaccataaagccagtgaatagtaatttttaataatgcacctctttgttgttgtttgtttggaaccaggtcttgacatgctaatcttggctgtcctgaactccctctgtagaccggggggctgcatgtgacaatcctttattcctgtctctcttgttcagagaatacttttattatctgcccagatgtttatggtttctgtatggcttcatcttcctgaagtgtttgtgattaggttaatttttatcttattttttcttagttggactggctagagacattgattttattggcctttcaaaagtggcctgtttgtgttgactctctattaatttcctggctttaatttcactgatatctgttcaaatgttaattgtctctgtgtttctgtttactttgggtttaattgatctttctactgcgatgacatgggagccctgacttctgactttcagtctcctttgctcatccatgtgttccctgctataacctcctatgctgctttctctgaattctagacatctcaagttatactttcatttgactcaagatattttttaatatcctctgagcttcctctttaagccctatattattaaaatgtatcttgtgatatccagatatttggggattttccaggtattagtgattcattttcctttttttatttttcccttcttcccctcatctctctcccctccccctcctcttcttccttctcttactccttctcctcttcctcctccttttttaaccttttcttatttatctttttttttgtgggagggtctcttgtaaataagactcagtctttctatgcagtcgaggatgactatgaagccctgatcctcctatctctacatcctaaattattgagttaataagcatgaattactatgcccattttattgccctcagtgattcatattttaattttactcatccatagcctgagaatatacattgtgtagttactattttaagtgtattaaggtgtgcttttatagactaggatgtggtttgtcctggtatatgttccatgtaacttagaagagactttatattgctgtccttgaatgacacagcattagatgttaatcatggccagatgacttacagttgtgctcacctcagctatctgctttgtcatagaactgcctacctctggtgaggagtagtgaagggcgcaccatctctttccccctgcagttttattgttctgccctcatgtgtatgaaggcttcattgttgtacagtgcccataaggatcactgtacctattcttgaagaactgactgctatcaaatgcactactcctctttattacttctacatttctttcctctaaagaatgctctataaaaacaaataaaactattcttgctttcctctattaccacagtatatctttctttttacttttaactttctctttgaatgggatattgtttgaattaaggaatatgtcctttattagccagatggtggtgatacaagtcttcaagcccagcatgtcagaggcagaggcaggcaaatatctgagtttgaggccagctagctccatctatggagtgagttccaggatggccatgactacacagagatacccgtgtcgaggaaaagaaaaagaaataacaattaataaaaagccaaacccaaaacaaaaacaaaaatgtcatttatttccagtgtatgcatgaactttacatttaatatcaacactgcatgtttaattatctaagtgcattataaaattagaacgaaaatctacctaacaatctacctagcatcttaggagaaaaaagttgctgaaaattcaagcagcagaagagggcagtaaaactcaacagaatgttctcaaaggtgttagtacatttccttattttccttttttagaatctcaaaactctttcatatactaacaaaatatattttctacaacagacacttaaatatgtacccaagtgtacagagaaccaccaaaattccacacagttcatcactacacttgctatataataaacatcttattaaggagcctcattaccattgtgctttgccatacagaacagtttgaaccatcttgatttggtttgggacagttaatattcccctgtaaccagtattccaattgtgcctgtacagtgtgctctggcatcccagacttctcaaaagcagccaattacaaaatactttccccttatgtccttatttggacttcctttcaaaactgctcttgtcctccaggtctgaatttcttactgagttctcctgtcattccgtagtatatggaactctccttacatctgaggttacagattagatcaaccaactcaaccatacagataattttacttgcatttcttctatgattatgtttaatgtctttaaatgtcaagtagtctgaaggtgattattctctatgccctgtttttcccctcactttgaatttgtaatgttttctttttttttttttcttttagtttttgtgagacaggatttttctgtgtatagctggctgtcctgaaacgtgctctgtggaccagggaggcctcagagatctgcttagactcctttttctccctcaatgctgggattaagggccaacatcaccatccaccaccaccccctttgccataatctcttttaaaacatcagaatatacttctctacataatgggcatacaattaatattagatgaggatggagttggtcaaagtcagttgaagatttcactagaaaatgttcgtacacagtcaagaatgtggaattttatacagttcctagctgaagttcgtatcaggagctctaacaaacttagtttgacaccatgcacttcccgcatttaaaataaaacagaaaacaagaactatttaaagggattctccaaaagaaaacagtctgtgctttcagttgaaatttcccataagactccgtgtaagaggctgggagtgccatacctggactgattaaacatgactagaacaaaggccctgggtgacatggagttttagtcactgtgtctcatgtagcatcaaattagcttgcacatgaagcaaacagttaaaaaaaaattccatgagtattcttactttctgggagacttccgcagagtcaggtatttgctagagtttcctaagtgctgcttctcatggtcgattggattcccccatgtggatattctcccctttcatttttgttttgttttgttctgttttgttttgagcaggggtcttgctgtgttacccagcctgcttcaaaccattttcctgacttaactgtcctcagaatatagtgtaatttcacactctgtgtcattttttttatccattcacgccaagaacgtacagtttagttgaattttttagtttcctccttttcttattttgctccttttcgctactccatcctcacaccccctccatggccaacacaaacacagtaggaagatatccaacactatcaaaaacatcacctctctaggcaaataattttttatcaaacactgtttctgaatgaagtgaatttttttttaaggttagggagaataaggctagttatggaaaaataactattaccttttgatccgttgccataacatactttcttgtaaacatggacagaaaaagtttttaaaaggtacatttgaaaacaaattctttctagtgatacatcccgtgaaaagagttgctgatcaaaatgataaaagctatgtaacagcagggggaaaataccttaaagcaatgctgtggacacttagcattccgatgaagtggagctcagcatctgtccctgggaaaggcgagtgccaggggctcctgtgactgcagaacccggagggtagttccatgaaagacttcaacctaattccaccagtacagatgtggaccctgacagaggacactcatttcattaaaaatagaagaaattaaattaaccggtagctgtgtgcgtgctctgagcagcgagcacgtcagactgcgccccagtggggagaggtgaggggattcccttagttaggaccttagatcccgggaggggaagctgtgacactcttgagcttttaggcccccactggatgcgcgactgggaggaaaccggagaccccaaagagcgccagactaggcgcagactcagcgaaccacagggcgcctggagggatggagagggcggtgcagctc

SEQ ID NO: 259 - DNA, 170071 bp, Mus musculus
aggagtttgcccagatcattggctagccacttgcttgcactgccttccttgctgctctggattctcaagggtgggcagcttatagccagacagaaatatgttacaaggaggaatcacagcagaccattaccaggaggtaagagggagaggttgctgttgttgaggagagctcaaggtgctttgggggaagagagagaagtgtatgtgggggtggaaacagataaaagggacacttgaagctggggactgaagatgaggtaggcatgtccttgctgtgctgcttacaacatgtcttctggcctctcctggtcctggagcatgggtgtgcaggcacacatagacacattgcttacacacgctgcacagacacatatgtgcttttctctttggctgtgaatttaagacccccacagagagaagcccaagagggggttcttcctaacaaaacaggctctggtttttcttttgttcttaaaaaggcaaatcaactcatgattattctttttgtttttgctttagaactacagggattatagaagaaggaaaaaaatcagcaaaacaaaatcagtgatcagagctttgaagagcagtgtttataaaccaagatcagtctctgcttctgatctgaagccattctttggcagccatgggggatggagatcaatgttggggtgggatactctggagcacagctatgctaagcactgtgcaaccagtgtgtgaactggggggtactgtaagcagaaagagcagtgcctttcctctcgacacactaatgcactgtctccatgtctacaagcactggctatagtttctatgggtagattcttgcaggttgtagcatcctgcctcttgtcacaatactattatcttgccatgctgctcagacaatagttctgtatgcagcatgcttactgcataagcatgatggcctgactgaccacaaccccagcagccatgcaaaatgctggacatggtgtcacactttctaatcattggggacacagtgactggatccctgggtgttgctggcctgtcagtctacctggactggtaagccctgggtgtcagtcagaggtacagtataaaaaagtaaggtgggctggggagatggctcagtgggaagtatgaggtgctgggtggaagtctcttgcacctacataagaagctaggcacagtggccttgtgtgtataactccagtgctagttatgtgtgtgtatgtgaggggaaatccctggagcttgctggctgaaagcccagctccagggtcagtgagatacttcgtctcaatagaacaagatagataatgatagagcaggacaccctactttctcccctggcctctgtgcacatgtaggcatgagtacctgtagactcagacttttgcacatgcatatgtaccatatataaatggacatacacaatgtctctgtatgtctctttgtctgtcacacacacacacacacacaaacacacacacacacacacacacacacacacacacacagaaaaacagacagacagatgacagagtagtcgatggcttctgagaatgatacctgaagttgacttcaggcttctacatgcaagtgaacacacacacacacacacacagatacacagacatagagaagcccaggcacacaaacacacacagacacacacaccagctcctacatacccatacaataaaacatgtcttaacatgtcttagggagcttggactaatattccctgtatctgtcagacatagctagtatatctgttcactggttacctgtcatctggtttgactattaaaataattacagtcacactgtcacaataagcccattatagcagcctgaccttaggcacagtacttcagctttctgggcctcggattcttgatgtatcaatagacaaggccaagatctttggtgtgtggctcatcacttctcagtgcttctcctttccttgtgattttctgattcttcctcagattcctttcagggggttgtctctatgcaatgccatcttgactattcctccaggttttttttttttttttaaagtactgcattttcaggtctttgtttctccctctaaagagtcacataagttttatgaccatagtaatgatgtgtctgggtatctttgcctttctccttagcatagctgataggaaaaagggtcttatttcccccgtggagggctcttacacgcagtgtcggcttgtatttgtgagcccaagaagaccgtcctgctagccttaccagctccatccttcagtttgctaaccacagtactgatggctcacgtgggacattttataaacatgtcataatcctttcaggtctcggttccatgtctccactgtccctcactcatctagtgtgactgtaacatctgaccaaagaacaagggatcatattctccgatacatactattcaatagaaggaagtttttggaatttaaatgtctaatagttgatgatctaggagagacactatgacgcccttactacatcccaggtcttatgttgttacttttacatgaatcagatcactaaatcctcaccaccctgctaaggaaatcatactctttttatggtgcagagatttgtccacacagtccaggagaacacagtctatgcttaaaggaaccaggatctaaacagaagcctctctgtgctccagagctcttgtgattatgcaaccctataggaagaagaattccagtcttggatttccgttttcctctcctgtttgtgtatagatcccactgttgctatggcacctgcttgtttacagtacctgttgttgctatggcactgactggctgggatcgccttccgcggcttattccatagagttcaatttcgtactcagtggcctctctgagacctgttatgtccctggtacgttcgggggaagggagggatatttcttgtggctcagattgctttttggtatctctgatcctgataacaaaactgtcgaatatcccttcatcagcagtccaggacagacggaaaccgtctggagtggcatctgaaactagaaggttgtcaacttccggttcagcttctagagggagagaagatggtggaagaaggaggagacagagcattaattagccatccatgcagtcttccttctggtggagtatcagaatgcagtgctgcctcggttttcagagacagagtgtcctgagataccaggaaagaaaatcattccacattaaaaaagtctagtagggggaggagaaggaaaacacggagctgacacattcaatacaagccaagcattcgcttgcatctgtgagttttgtctaaaagtaactgtatcagtccacatctggactcggccttggcccctcccgtgcattattaaacaagttcaaagccataacttgtttacatttgctctttgtcttccagtggctgagtgctggtctgctgggagctccttttcttttccttttgaaaagacaaataaaccgactttaatgatctgtggagctgtccatgacgattctgatgattatatttccctcgagcctgagcaaaatgatttagaatgttatggtcttttggctttgttctccggagctgctatccagaagagggctcctagtatatcctgtttaattttatttccttgctagtttaccatttagatggtaggatgaggcttagaacctcttgagatatcattatatatactttgtactccagagtttcattttggtaactagacaaaactcagtgtcaaaataaatttgaagctgagtttcccaaagtgtgtgtgctcaaagcaaactcttcctgttgtatggctccatcctttacaaagcattccttgtcaaacaagtttgggaactactgccctctgcataataagagattctgaaaagcctgtgtggtcaaagatcctagttccaaatttaactgaacatgaaatgttatcaaatgagatctttaaacagccatcagcgcttgttttctctagaaatactttgggaaacacagttttctgactgttaaaattattaatgtgatatttctataggaagtattagtcttgagaacattatggatttagtctgggttgaagaatctctctggtattagttgtttttttttttttttaaaggcctgtatagtaagtttcattcagttcccaatcataagaccactgggtaagttggttaagatcacaggttgagactctgaaatagtaaagattttaaaatactttttcaaaatatactcattggcatatttcttttgagaaagctgaaatgtagctggcaaccagccaggatgaacacaaacgaaggtgactgtagtgagcacgtgagagctacaggcaagacgtggactaaagggtttgggacattaaagagacacgtttccatcttctcctttctaggatggggtgtgtgtgagcactcaatagattctgaaaaaagggaaaatgtggaggacatgagagaacaaggtacgtgtgtggattaagtggagaatacagacaatgttagaaaccacagggatccgaagacagactacacaggaaaagggaccaggaagaggagcagatggctctcttgaattgaaatacctgtaatggtctcagccctcaagggctttgtttggtgcccttgagtgaagccagagaccaggacctcatagccaatgccagttatgaggcctctaagctccagcttcctctgggttcctgaaagtgtgaattcctgggggtccagcagcttcccagaatccaccaccgttactagaaagctgtcaaaggcattctccgatgccgtccaggaaactgtgaacccgtagggattagtgtcggaaatggttaaattttccagaaggggcaaggcctctgaaagaagggaggagtgaaaatgactcaggttagcagcactgatttgactaaggcagcgtgcagccccaagaacacagatagattcccagtcaaccatcctgtgagttcaatgctcctgactccaagaacactgatagattccctgacaatcaccccataagttaaatgctcaaatactaagaacactgatagattctgagtcaagcatcccatgagttaaaatgctcaaataccaagaacactgatagattctgagtaaatgctcaaataccaagaacactgatagattctgagtcaagcatcccatgagttaaatgctcagaaaaggaatatttagtaataatgtcttgggtgcctgatattgttacatagagtaaatttcttaacaagactgtacagtaactatcattcccaatcataggtcaaaagaaaagtttctaaatgattaactgatttagcccaagtctcaccttagcaaggtatgatagagcaaggcctctagctgagcctaacttgggccatccatatctcactatacaaataggacaccttgtgtcactttggaaccttaatctacttcttgctgtttcttgttttgaaacaaatcagatttttaaaaaaaattggttgttgcaagcatacttttctggtatatttcatatcttaatctggttcatattttgaatacaattatttgggccaactattgagttcataaacttggataacaggagtaataagatttgttgtgttgttacttatccaaattaacgatttatgttcttaaaccaggaaggaattctaagtttggcaattcttaagttgtttggtttttctaggttaagttagaaagcaagaacatattttgttatcttggttttatgttttgtctatctgtgtcccagcccacttattccctagttgtggagggatcttttcacatacttgagctttccaaaaagtgaccttatggtggccaaaacaagtcccagtagaggaggctacagaatgttgatccagtctaacacaacgatgctgtaaggtaggtgttgctatctgtctgctggcctccaggacatcaactgggagagaaagtctctgacttttccaaggccttcttgctgcaagcttggtattctttgcacatcctaacacaatgctaaaattagtaaatgctatcaagtgctctgacacactcagagtggggacacagcgctaatagaaaagagagagaagaccgatgcatactcattcagcacttaggggagaagggtgaaaatcccatgcccaagtctgctttagcaacatgtaatttagagcctctcttctcttctctctcttctcttctcttctcttctcttctcttctcttctcttctcttctcttctcttctcttctcttctcttctcttctccccttcccttgctcactcgctcatgttgttgcatctaactgagaattttcaaagtgataaatgaccttgtactaatgcttatggtcaaatttccctaggatataaagacaatgtttaaaaagaagttcttggcacctggatggctaagtgaatgcatccataagtagagaattagactttgttgtggcttggacttcctgtgctgattttgtaacagttaatgtttatttttagagtttatttttctcataagatttcccaagagctgtaactctatcaaagcaaatatgaaattttttttttaccatgcaaacagtcttgatttgtaaaacaaggttctcaaatgttggttttgtttagagaagtggtgcccttctttgatagctggcctctgttaactccatgctattaaagcagtgaattccagagaaaacaggtactttcaggctaattagtcaatcaagggcttgtttttttcctcccacagtctttcctattcattttcatttcttctttggtatgcctctttcaaaatgtagagtcttttcacaccagggattagcagaaacaattctgtaactggatctctgtttccctcctgagggctgctctttcagcttccctggcttctctctgacttgtgggaggtccttcagaaggtgacatgtaagggcctgatgagctctgggtgctcagggtagaaagagtcttcctctcaccccattctttctgctgtacttaaaaaaaaaacccagcttatatttacatttgataattgaaaggaaaaaaatatttaaaatcttagactaaaacatacccagggttctaagagtaagttgtgaggcatgtttccattgtttcccttgggcttgtggatggggaacaaatctaaggtcttactcatgccagacatgtggacttaactttgacctacaccccaattgacttttaagaagcccactctccttatactgttgggaagcaacaggaggacataacactagtagaggatccagtggaggctaggcggttacttttcactgtgtctgctagattcctaatgtagatggccagcagcaccagtgagtgccctcttccctaacataaggacatcaggctccaaacaaatttgccagggctatgtgtaggtaagatgatgtgggataggtttagaaatcaaccagatttgatctcagctaccacaattagttagctgtacttattaacacagctcatttatagtaatttagactctgggagggactagcttagtttaagggtcatgactacgtctatctcctgagagtttagtagaagagaatttctaagcattttttagaggtttgtcaagctagagatttacttttatgaaaccatgcacagcctttaccatcgacttaaggtaagattaggaaagaaaataggcagtatctctttatatgatccatagaaacatcacagctcaaatttaataagtgtataaagtttagcatgtatctatcttcctaggttgaacatgtccgtttctgtgcttgactgttttaagagtaaggtttttgttttgtttttttgtttggctttgggttgttttttttttttttaaattgcaaattataggatttggggaccctctaggacactaggcactttacaccgtacatacctcaatttatggacataattcctgctctagatcatcgctaatttaaatttcactttcttcagactctctgcatggattaagcattctagaaaacaggccaaaagatactcgaagctctatacatgtctaaagagcttccaagagggtctgtaagggtcctcctcctttcaggagtgccattgcttttagtggctagaaatttacatttggcctctctgctattagaaataacattgcatagcaatccgtttccctcaatggctacattagtaacaacatttgctgagtacatgtagaagaatactatatagccataaaagaagggaattctatcattcttgatgtcacaagtaagcctggagaacattaagtgaaataagccaagaagaggaagagaaaccatttcaccatctcccttttatggagaatcttgacaaattgaactgataggagtagaaagaagaatactggtcaccagaagtggggttggccgcttgccattggtcaagaggcacaaagttcaactggccagtaggaatacgcttcagtgaggtgcagaataagctaaccaaggcgcagaatagttgcctcagttaataataactaatagtagccgatgttccaaacagccgaaagattagattttaagtattatcacaaaaggtaggtgacatgattgataaattaatttgatctgatttggtgattcttcaataaatacatatgttaaaatatcactttgtaccatatgtatcctaatgaatatatatgtatatatgacatatatatgacatgaatacatatatattcatttcctataggttaaaaccaaaggcctttatatttggagtcaagactatgtttgggattggagttttctttagagtgcctatctcctttttccagattcctaaactgacagagagaacctttgaatacctgtaatgacaaagacagtgaggggtgtgaggggaggggtcctctggggtcaccagcccaggtggtccctgtcacactgacatcataggcagtgttctctaccaagcctgtgatgtgagcttgctgcgcatctcctgggactgtgagttgctgagactcatgaagtgaatgagtatcgctcacagtgataacaatctttgcaaaaagcccagcttgtgtggtccatgacatattgaagctgtcaggagtaatattgctaaagattagcatgcccaactatggttctggctctgaagggaaagaacatgggcagaaacagaaagagagaaagagagaaaaagaggaatgtctgtatttaaccaaatacttgcagaaaaaattgaatgtcaggcagtatctatgcctacatttactatatgacaaagaagttactgatttttctgcagtcatttatttgtgttcttttaaagtgtaaacacatttggagccatttgtaaaggtaagttagccagccatcagaagtacagataggacgaataaaatatattgtgactacatttgccaaaatctctgaggtcaagatgtcccaggtaaagacagcttcatgttgaagcatccatcataaacagcaaccattttcttttaccaataagattcacagagcacatatcccttcaaaggctttgaaaagcttgttctataactaaatctatgcagtcttgttgactccaacattgctaggctatggatcccatatcttaggaatgtctctaaatgcctcagtgagatggtatcccactgagtagtctttagaaagtgcttctggagggttttcttagtgttcatttgatctatatggatgcacaaattaaaggctagcatctgcatctatgtgaaatttcttcaaggacattggaaacttaaatgcctgcataataggaaaatctatacctcaccccaaatgctatacaagtgaagatggattatattaaaaatgtctagtagatatgtaagatgtaggaaaacttgaagttaaacatcaaattccttgattagggagtttgcttaatagaacctttgtaaagagaaaattctgttgaggtaaaaaaatgttttgttcagcactcaggaggcaggggcaggtggatttctgagttcgaggccagcctggtctacaaaatgagttccaggacagccagggctatacagagaaaccctatctcggaaaatcaaaaaaaaaatagtcttgtttcttaaatagtaatatgagaaactcatttaacataataggctttcatagctagtatcaactgagatgtacgtaggtccatactcctagtcatttagtaaaggatacaaatgtgaagtatgtcaaaccaggttgattctaaagagaatcagtagccctagaggactgagctattgataggatttagagttggaaagaggcaaagtatttttccaacctgggagttgttttgtctcagctccaatatttagagataagaataggctcatttgagcaatatttaactacaaaactccatggcatggatgctctaaagtctctaaggatcccaccaatctggctcagaaacagcttacagtcatagcgctggcatgccttttctgtcttgtcattctgaggtgctgataaagctgtagttttgctaccactttggcagtgtttttacaaccacacaaaggataaagtcctccagatggaactcagctcttcactgtcttctgctttagaagctatctcttgaattaaagatacagtctataattcttctcatgctacagtagggagtctggcagtgctaacacattcatcatgcagatggagggagggaggccttggttccagaggttagcattaccttcagtgaactctcagaggatgcaaccatggtgaattgtgagatataagacaaaacccagaaatagaatgctagttaggatttggtcagtgttccatgcaggcaagggacatttttctcctatcacttcccttacgaacacttccttgacatgctgtctacttccaagaaagatagacatatttaaagatttaatgctctgagtattcaccacatgcattgcaactttgacaagatgatggatgggaagagagttctagtgctttggaacagacaacagcagatgacagtgcatgctcaacagagtagatgtcaaaagagacatctatcaggatgcctatctgtcaggaatccagaaaacgaaaatctcaagaacaagatgggcaccactgggttttctcatgagacttattgcttgcaatttagggttctttcttagcatcccaagggtagcaatcaatatataaaatccaggcaaatgaaaagagactatagatcatgtttgactttgaacagcatgtagacattcctttgaatgggacacaggcaagctttgattagaaggactacagacaggtgagaatgggttctgtgaggggatattgttaaagagaagaggaaaagatgatttaggacttcaaacaaaagcaagacatattaactcatcacagagcaactccagattgcaaggggtatatgggagaaacagactatgaaggtcccttatttggcatggagtgtactttaaagctttaaagctttgattagatgcctacattaaattaaaaaggatctggtagaagtaagaggatgaaaaaggagcagtggctgatttttaaaatgttgctcaaagggagctcaatggagaccgaagaacctctaatgggtagtatttgtgactgcatggaccatcagggtctgaggacgctatctgcctatcagtctgggcagctaagtgctgtaattagaagatgccttgtttgaggctggagatggcagagtttcaggttgactgatgatagagtataccactgtttggtgacaatcaaaccaactaacttctataagaaagctatttaaggcaagctcctgaggtcatatttgaggcagagatgtggctaagaggagagctgtctatgacagcaataagattacatataaaagtataatcatcaaattcaccattagagaaaaaatttaaaacacagaagactaagtccataaggttttagactctgcctttcaggcaagaaattattctttgttgaaaaccaattcaacccaagtacacatggtcaacttacttttgtcccctctgtgttactatactttaacatgaatagactaggaaccaagtatccctagctcctttttttccaggactaccctgataacagtctaaaacagcatataaattaggtctccatcaaccattggtgatctaagcagaaggtaattttgatgctataatatcaatccttttcttgtgttccctagaatatggaccttcttttgtgaactataaggaaaaactgcattccttacattttttttctagtctggaccatgttaatttatctgtaaagtgaagatattgccccaaatgtgctaagaatgttgcttgagtgggcaatgctctcctctctggagtcttcctcaaggcactaaagaaatcatctggcacagaacacatgccacaggactgcatatgcagagcaagaacagtttgctccctttggacccaggtttcttatctgagaaggactattatcatctttttgctatgtgtctctcagcattctagacaggggacatcttttcctgagctggctttcaggttgaggtaatatggatgacgtgggtacctcttgcttagctgatgagttaactatcattgctctttcttgccattttcccagctggagaaaaaaaaaaaaaagcaaaacagggcaccgttgacaattatcttaaatcactaggatatttgggtatgaggatattcaagactttacagagagacagatattaggataatcaaaaaaaaagaaacgtaaatttgattagaagagacatctttgcaagcctaggacaattatcatgatgattttaaagttaccaaaggagggaggtccttatttgtggccacctggacaaaatttcatatgatacttagaatggtctgcttatgataatcagagatatggattcatgcaaatgtaccatttaggtggctgtcagaagaaaattttgttagacaatgatgcagcccagcaacctaggaaagttgatattcaatggtttatacctcattggccaatgaaatcaagtggcttcatcctgctgagagagactgtggagagaaagcgtcagaaactagagaacgctcatgtacctgtggtagccgtggtactgatggttttggtacggatgctgggagcaattccagagaggtagacaatgaaatcagtactaggtggaagccctgagatgtgggcagtccgttcagcaccagatatattatgttctgctgtttgcagcaacctattagaatcaataatttcaatagtaaacatgtcgaagatcccgtcggtagctgtccaggagagattgaagctcttaggagttacatcagaaacatttaagtttccaatttcaggttctctggctgaaagatgagagggaaggagagagagagaaaaaatcaaatgatttagttatttggctgtgtttcaaggtggaggtggttaatagaatcatgcccggggagtaaggtctgatagttcagggttatagcaaggcaaagtgatgctgccactactaatcagtgccagggaaggagaaactggttttgttaagaggaagctgagcaaaggaggggatagctgttagacttttctcccctgcatttgccactgatgatcaggcctggcaagatacctcagcacagaagacgggctggctagtctcagtggaattggcttcatcttagctggatctgtctctgagagccctgcctcagggccattggcaatcagtcaaaagatatgagggctgacagctttcaggctcagggaccaagattatgtggattcctgcattagctttgagagaatgcctatctatctaaatgagtgctaaataatgctgacagcatgggcctccctgagtgggacctggaggcttctgattttgtcacttgaaaagatcctcccacctctcagggtaactcttgattatttttttccatactttagataagggagagccagctgttctcatcatctgttaaaatagcatgttctcttttacttatgtctatgtaggccaagaaggttggtcctgtattggcagccaagacagctcagccaaaccgttcagacaaccctttttagctaagaaataatatttttctggggagatgtcctgccagagcttttactttcctgagaagtggtgatatagcaagcagtgtgtgcacatgggaggcatttgtgaagccagtacaatctatgtagcgaggagaaagacccttaatcccagattcacagattaattatagcccttcccctccgtgggccaactcctcagagacaagaatgttgctaccataaaaaagaatacagatggcatccaaaccacgagatctgcaggaaagatcagaagtggcgggtgattgattgctctgccttctgggacagaatagtttgtggatgtcagacaagaaccctggagaaaagtcagcagatcctcaactgtaatctctggtcagcctgaggtcactgtccaccctggggttgcttacgttttatgtatgcatcagtgacagtttctgtaacaactgaggcaaaatcacagagttatccttttgaatcaacaaagatgtaatggtttgctatgagacacagtgactgtataaaaaaagggaggcattttcatgagaaagaactcatcagggcacaccataaagacgagccacagaaaacagggttaggaaaggccgttcacttgggaagagtcccattgaaagctttataactgtaacagtgtaacgagtaaaccagaacgcatccctggtgtaggaattgggagcttgcttcgggaaataactcttgattcacagagcaaaaagggggtagcaactctgttccgtttatagcctgaaatacttcttgctctgagagctactgagtgtcctgctacagaacaacagtaactttggtatattatccattcagaattgtatgttttctctctttgacggatagcttgatagtttgatgttctagcaatgactctgcagctgagagaattttgcctactggagggtaattcagttctcctgttgtgctcacttcatttcaaagaatcactgtgtaagtgtaagcactgtaggacacatctccacgagaaattttgaaataatgctcaaacagcaaaagagtctctaaaataaatggtctgtgctccatcaaactcacatgtggggagggtgggcttttgattctctgccaggactacagatggaagttaaaaccaaacaggctggttctccaaacagaggccgccgtgcaaaggtgccattgtggtactgactaggtgaatcaagaaagtggatgtcggaggccagaagtgtgagtatcttacatggctcgtcactgctgtggcgaaggcattggaatgatggaacagctcaccgaaagggctctgagcatgcgtcatgcgtagaaaggaattagccaggaagaaaagctagttcccttgccatctcagagagagagagagaggagtggggagagagaagggggagtgaagagagagagagagagaaagagagagagagagagagagagagagcgcaagagcgagcgcaagagagaaccctaagcatgggcagtggagatgatacctgtggagacgtcagtagagagcatcggtgttctatagccctggatgaccccgtagatggagactctataaggggtgtcggccttgaggcctgggatgtccacagctctgaggctgccgggtaccgtgaggttctgagcggcctccacattgttggcctcctgcacctgaacgacaaagtgcttataggccaggtcatctgtggtccagttgagtgtgaggccgtcccagctgacctcagtcacagacaagcctcccagctgagggagatcctctgaagaaggcagagaatttgctgttagtgctgcaaaccaagcaaggcagccgaatgccccacaaccctactccagaaaagcagaaggggagagaaagagtgttttgtttctgtagctcctgatctccgggtatttctgtattcagatttttgctactctggttatggttttggagaagagttgaaacaggcagaaaaggaaactttgcatcattcctccttgaaaggccgaagcatggaaatctctgggaatgcacaggcagtggctagaggcaccaggacaatgtgggattgtagaggggtaaggaagtaggagtagtcaaagcacaggagttggaggtccacagacctggcaagctgtatcatcttgggagtctggctttctctctgagcctcagttttaagtagaagtgacagtaccatctcattgggttctgtgattacctgatatttattagcatcttcatgtcatacacaaggcacagaaactgtctgataaatggcaacataaaacatagagcctgttgatgtgttttggaatatcttagtcatatgcgaagccatgcctcattttattacttgaggtgaagggacatcttgtggctggctacctgctctgtatttgggcttctgaagaactcgtgttcccaagttttgacaggtggtctggtttatctctgagctttttctgcaactttcaaggacatgatgttacgtaatagattcctggcttggcttgcactctcccactgtcttaacccttggcatgaagcatggctgcatcacaaagcaaggctgtgtgaagtcagcttgcttacttttaattaagagtgagtctgtattgcttagtacatgtgcaaagcagggcccactgttagttgttctttttaactgtgtaagaacgatcttcagttattgctgattaagaaagtctaactttggggtatggaaaaattcactgtttgggattcagtacagtctcagctctaatttgtgtgtgtgtgtgtgtgtgtgtgtgtgtgtgtgtgtatgagagagagagagagacagagagagagagggagagagagagagagagagagagagagagagagtgtttatatgtatgcagttgtgtgcaggaggccagaggttggcatcaaatgtcttcctcaatcactcctaactttagtttcaggcagggtctttgactgaatctggaacacaccatttcaactagattggctctccagaaatcatcaatataatcctcttgcccccattttctcagttgagattctaagtatttatacttctatacccttatgaggatctgaggatcaaaccctggtcctcaaggatgagaggcaagccctttacaaactgaagtatacccttatccatcttcctaaggcagaagtggccatgaattagaagttagagatcttagcctttttttttaagaagtgtataattcttgttcctaagtgtcccaggatcctttggggaagatgtcccaacactgacccagggttttctgagaggtctggggacagaagtgcacttgctgagaactgtttatctactgcacgaaagacttcaccagaacattccatttactaaaggagctaggcagctgcagcagggcttgcagactgtacacgtagctcatcagcatccctgacctagagcagacatcccagacgacctttgtttatctcaacccagtccaggaataaggcaacatgataacctggctgacttaggtaaatgaacataatcatcttccttatatctggtatgtgtgtacatcacagcaatggacaagtttactttatatatatataaacaagtaggaaaattgatggtttgaattaggtaatttgatggcattatcaaaatacaaggatacaaggcaaatggagaggggtacagcatcaaaactttatcaccacaaattttaccattcattccatcctccttggaatagcataaagctctgtgtgatagatggaacagcatatttcaaggggcattccaaggactgagatgaatttgtttttctcttcagcttaaatggaaaacatggaacttaaacataccatcttttcttagaaaggttcttactttaagtgcacttcagaaatgggcttagatgacttcggcataagatgactagatcagtttccagatctgaagggatccgactcggaattgggtattacttaatgtctctgagggcagtattgaaaagatttctctgaaaagttctgctctcctgcaccaaaaaaatacccacttcctgtgctttgtcttcccatggttgggttgacaactgtgaaggcgattcttgattgtcaacttgactacatttggaatgaactaaaacctaaccagctggacacacctgtcgggatttttttcttcatgaaatcatttgaagtgggaagacccacttgtaatccagctctcttgagacaggaagatatatctttaatccagctttttttttttttttttttttttttttttttttttttttgaggtaggaagaagcactttttaactgggccacaccttctgctggtaacctctatgaaactggcagcctttacaaaacacacagaagaatgaggctccctctctgtctgtctactctcactcttgctggtgagtccattctttttctggcatgagggcctgtgtattcaggattgcagtgcatactaaagaacaggtgagacacccagtctcatgactgaataattgttgtattcttggactttctgttggtagacagccatttttggattagctagactacagtttgtaagccattttaataaattcaatatttatattcataataaatcccatatgtattccgtaataaatctcatatatattcattctataatttgtttctctagaagaccctgaataatacaactactcacttagctgttcaacactggctagatgatgaacattttgtcaagccctttcatttcttagtccatccattgctcatggaaggatactaaagcagggtatcatttttgattcaatggcaagaaaaaaaggctcagagatgcaaaggaaaacatccagccagtactacagaattctaatccagacctgctaagtcacagtttcatgttgcctgcaaaccatattcaggcaagacctacctatgagggagttttgctattctgggaacagccagactggcatatataaaaatccagtccagaatggtcatgtacctgtgatgaactctacagcaggtgcattagtatggaggccccttactttgcagtgcagggtgactgtgtagggagtaccagccctgaggcctgggacttcaaaggaacacaggcgaccaggaataataaggccagcccattctgcctggctattctactggattcaagtgataaactggtcataagttctgtctggtatgttccagtccagtttgagaacatcccatctcagtccagtcactgtgaaatttcccagacttggaaccttctctgcatgagaatacacagggatgacgttactataaagggaactgctctctggggttcaggtgagatggggtttgactaaagttgagatgagctctttggtttgtattgactacagatgtgtgatttactgcagtactgagcacactccaattgttagaattaaagccaaggctttctttcagcctttgggaatagaaggtagtttttggaggagctcaaaacttccattcttgatataccactaggtttatgggaagctcttgagtatttgtaaaatgagctcagagtgattttatttttcacttacaaattttgctttcaagtttcttagatattataatttgaaacatacttttcgagagaagtcacctctcacttttgaaaaagaagagtaggtggaattttgtctggagctgtctactagactaagagcaggacctgcccaaataagggataagatattgaagtagaagtgattcactaggatttccccaacatggaagggtctaagtctcatttagagatgggattcctcttaagcagagacagggagaggagaaaaggagtgaaccggtctaaaatacctgtcaagacctcaacagagagaggggccgtgccgaagtcctgggtgacccctcgaagggtgatgtagtagcgggtggctgctttgagcccaggcaggtccactgacctcagtcctcctgggactgtgaggttctggacagtctgggtcgtgtcagcctctagcacctgaatgaaaaagttcttataggctccttctggagcagtccagttgagcgtgagggcatcccagcccacctcggccacagtgacctctcccagattgggagttgtccctagagaaggacaaagaatgcgtttaaaagtcattgtaagatataggaaatcctgaacccaagggcaggctttacatcccctgaaaacacgacatttgttagataaacatgcttcatgtaacatcttaaaccttggaaagagcagaagaagggggcggggaaatatttgctttcttagtttatcaatttcagagaattcaggaattccttctgtggctaatttcctttggactctagcacataatcagtccttaatgtggggtcaccatccttggtttatttggactgtctcagatgatggattccatacagcagcaatgtgttgtttatgtgaaatgttaacatggccttagaactatgtcacgcgatggcctggctatccaccatcagacccccatgtcacttcagcttgtggctgaacaaggccattctaaaatcaatgatgcgtgattatccttggtcagtttcctgttgagaaaaacagaagctttagatatgaaggaagaaagtacctgtggaggtctcggcagagagcactggtgttctatagccccgggctaccccatagatggagactctataagaagtggcaaccttgaggcctgggatgtctgcagcccggaggttaccaggtactgtgaagttgtgagcagtctccacattgttggcttcctgtacctgaatgacaaagtactcataggccaggtcatctgcagtccagttgagtctgaggccatcccagccggcctcagtcacagtgagattttccagggaaggcacttcttctaaacaataacagagacaaggtcagttacactattcatcaaatgcttgccttttaagaacccagcaaatccattggccaaggcccatagagtccagtaccaggatgctgtcactgtatgcccagcgatgctgtcccacaaaatgcaataaactggttagtgtagcattaatcttgcctttatacagttgaatttccttttggaaatatgtttacttgtttacaagtatcctagagaagactattctcatctgttaacgaggctccatgcctcagtttccagttggcagagtggtttttcactacacggaataacctcagcttggtcttgggtctttttccagcgctctgcattttgcagcctcctagatctgcttaggtttcttttctctttgtgctgccttggcctttcctagaaggtcattatagtttaatttggacttttcagttcctgagtttcaggtcaggttttaacaaaccacttcagtagagtagggataaggggaaagtactggtcaggccgaaaataaaacaaacaaacaaacaaaaaaaaaaaaaacagaaaaaaatttccttctcctgctgtctaaaaccactaatcagaaacttcactgacattgagaatttataccatggtgaagaggaagtaactatcttttctttccaggaatttatcttaagccttatctctaatggtgacattaatcatattgttccccatgaaaagagcttagatttgaggctgcataaagtaaggagacttgcctaatgcggaggagggaggagggtactatagatcatcacagggaaagctgttaaaatgctcacaggtacaaagagtggagggacagcacattagactgagctcttctgagactcatttcatctctgcacttcagtttttgcctgtgtctctggtgcttctgcttcatgaccccccacacctcttccctcagttgagagaactatcccacaatgctgtctccattgggactcagattccatcctgtttgggtctctagtcctccacctttccccctttcttttcacaggcagatcaagaaggatacagatagggctttcctttatgtaagtggtgtgtactcatatctacactggatgctgttggcacaccactcacactaagctgaccctaaacacatgctcacatatatgaaagatgaaacttccaccgatgaacttagagggatggaggggtgctctgaataaagacagagcaggcagttgtggactgcaaagctgtgtataagtgctgagtcctcattttcagggtgaatgacatccttgtgggctcactgcattgtctgtgtgcaccctagctttcctacaggccacagtgaaaaggctattgtcattctcttccagctgggctttggaatttaccctctgagtaatgccagtgggcccaggaagtcagaatttccaaatctcctgtcatctgaactcatggtgggccaagcagctgcaggaaggaatttctggccatgtcgtcatcccttcagattcccaccattgtatagatggtggttaccataggctggcaggatgcagagcccgaagctctttttgtgctttgtatgtgagagagtgattctcccacagcaagcagagaattcaatgcaagctggaagactacaagaatacttcaaatggcaccaaactcattttctagagaatgaaatacctgaaatatgaagtcttggctgccttggagctttctggtggttcttagtagctatgaagaataaagctaaaatccctgaacatctgtgctttgcacctgttccagaaggcctgaagccttagaaatactgtccttctacttagacacacagcagggctaagcttgtttgatgactacagaacatcccttgactctaagcctctcagatgctattccccctgctgggaaggacactgcactctccccgaaccttgcctcctcttgctcctcaaggactcatctaggtagctcttcttttgagactcctcagagccttttgttctctttttcaggtgtgtgatgaggatcaggtctgtcctcctgtgactccccatgcctctgtaacagcagaactacgttcttcccatgttggttctatctttcccactgcagtgcactctttctcattctctttgtcccgaatgtccccctcttctgtctgattcttagcatgtggtcatcatatattatataaataaatgtacattgaaaggataactatttgaatccacttcagtttactccatagaaaagtaaaatggtaaatcagagcgaagtgttgtttaacgcttgaagctgtggttagaaacaaaatttcatttttccgcctcccaaattcatgcgagacacaattgggttcttaggttgctgtgaaaatatgcctcatggcccttggctcttgcctattgtcctcctttatgtcttgtattgcttccagtgaatttgtagccttggctttaggcagagtttagctaacaggaatgtaaaagcagaaagagaaaaggaaaaactgaaggaggagagaagagtatgggagagttaggaggagggagcagaagagaacaaggctgaaacacacaggccttctgtgctggatgggagcaggccttgcctctacccccccccttttatgtctctccctctctccctccccctttcatgctctctccttttgtcatccatattgcactaacttaaagaattcctagggaataactaccttgccccttgctcctgaagggtgctagacagctgctacagcagagaaggacaaaaaggagaaaacaaaatgtggcaatgctgtccccagagcagctggatctctgcagatgttcctgaccctcactctggctttggatgtgttccaggcactgcaggcagcagtagacaaaggagattgtccctacaatctgctcacgggtgggtggaggtcagggacaatgaggtggttactgcccattctcaagttggtaagtagccacgaagccttggagcagcatcaggggtgggctgggggggggtgtatgtttcacagcttgctcagagaatgcccttggtttgaatagcacttgaaatggacgagactagagcaaatgataagtggaaaacaggggacagaataggaatataacaaagggagcacaggcctggtggaggaggcaggctcagcaaacatacaaggggacagtcatgtgttggccaaggacatgaatagtggaagctaagccagagaagccagactctggaggccacccagcccttggaaaggtgctgttatgtacaagtttggttttttttatggagcacaggaatgaagggtaagaagattaactctgctttcaatatggtgccacctcatggaggaggtctggacttgggccactgctgtggctggagcatggggcttccttggagaaaatgcaggaggaccagcataagaaatgttaatcttgcaacatctgcctttgattctggagatgcggggagatgggggtggggtccctccttctggagctttgtgaaagaggaaagagtagaagagggagaggaggaacaaggagagagttctttttcttcttacatttctggttctccctttttttaatgcctttggcacacaataataaactcatgcaagggtagattatacaagttattcaagctaactcgtttcaattctatttccctatctttgatgaacttttccttctaagcttctcggacagcctcagcaccctacagctcaggagggagcagtctgcactgttcccagaattaaccactgcactcatttcttacttgcttagactgtccttttgtctcacaaatttctctgttttccttcaaaatgcctgtggactttacagtggctattctgataggagactagccttctcgtgttatgtaagaacagccaatgagatatacagggaaattattgatacaatctctagaaagagccatgggttggagctttgactctatctccgtcctactgcctagaacctggatgatggaggattgcagcagccatgtagtgatactgaccccattttgagaatcggagctaaaccctaaaaaaatggtggaagagaaagagtgaaggagtctggatcctgaacaatttgaaacaattttactttctcttgtactgcctggtggcagatcaatttaatggaggagactgacatttgaaaattctgttgtattcagttgaagatattaatagataacttgggccctgcatgacatttctaaattgcctcattgtcattctctttcagatggctgagggtcagctgggtgacttctgtgttacatgaccagcgctagtgacccctgaacatcctgatctctgatagtcccagcttctagttttctccaaagactctacggagtgtgggagtcaatcaggctatgatggtcatgtgacacagcgttcttcaaacagcagcacactgcagtagatgaggtagctgcatgcctgcatgcatgctaatgaaatgggaagctaagtctgtcacttgtgaaaactcaaacgatcttgaaaacttcatggctgaaattggatgtgtcatttttcatacaggaagaaccatttttatctccagattctctctgcagttcagtccgtgaattaaagtgacaggagagaaagtcggtaggttagctggctaataggactaaaagggacctgggatcaaccaaggagagccagaagacgcttcatgactagaaataaagtgagaaggcagcgtggcaggtttcagaccaagtgccgttctcctgggctatcctgaggagggcaagagagctgtaataaaaacactcctaggaagatgttcaaataatgacgtccaacatcctgggcatctttaaaacaatgaaaagtaaagctgtcattagattaaaggggagaaatgggaaatttctagaataccatggagcacaaatgaaacagcaacaagagacaagacagacaatcacagctccctatttacattctcctagttagtgttgcttagaagtcagcgtttctccatgaggcaatttggttcaatcagttgactgacaggagaaaaacgtcaatcttcacgaaagacaaggaagctgccatttcagtgtggcagagagctccaggaggagagaaaggagcttatttctcctctgggcatcacattcctgacaagcctggcagactcaaagctgccacccagagttagcagagggcttagagctcagggtgacttacccgtggatgccttcacacgtgcaggcttgctcttgtgtctgcccttctcagcaatgaggagaacagtgtattcttgccctggctccaggtctgtcaggacatgggaggtggcatcctttggcagctggacttccatcgactggcctgtggggaggctgtagttgaggcggtaacgatcaaacttggccaggggtgtcgtccagaaaaacgtcagactgtcttgtgtggtttcagacacccgtaagtccttgggtgcatcaatttctggagagagaatgatgagacatctttaggctgccaggcacagggacttctggagctgagtgtgccctgaggagacctgtaactgcagggcagtcacctgactgacctcaccttttatagacaggagatgttacacactaccttttgggatttggagaaaattaaaaataatgtgcagtggtttatagacacacacacagacacacaaacatacacacagagagacatatacacagacacatttacacacagacacacacacagaaacacacacatacacactgtgcaacactactgaaatctaaagctgtgatgtatctagtagtagatttttttcagaaaaacacttcaggatggaaacaacagtctccaatccagccctaggtaatcttcacccaaggctggcactacaggatgctacgggaaccaggatgctgtagtagatgctgtagttaatctatatggttacttaactatctgccctagggaggtattttctcagaagctaaggggaaaaaaacttcacatatgtaccaattaaacaggcttattttaagagaataagttgacaactaaaaacaggcatactataatatttgcttccaattttcctttcttctctttcctctgtagagagttgtgctagggtagttcccttaggagtgagcttatgagttctgctttcgttcttttaaatgtagacatctgggctccatggcactagaggcccatttctcctctaatctcattctttgaatttgtagatagacttttctcaccagtcctgcctttcctgttcagtctacttcagcaacggtagcattgccatgcacctcacctgtggccgcattgatggttgctggatcactctccttgtctcccttgacagcagaaacaccaatcccatattcagttccgggccttagacctggaagagaatgtgaaggttgggcactagtagaaggcaggctcccagaagactttaaaagtgaccccagactggcttctggccactgtgaattgtatatgctcatcacatgatgcagtgacagtgagaggaatggacagaagctgggcctatttcataatctctacagggttgcaaaatagggacatatgctcctgtcctttcgagggcccctgtggcacagcaccgctgggtcacggctcacctgtgagtgtggttttggttgtggcttgctggctctttggaacatctatctcagcatggtcacctccagagataggggcatacttaattctgtaactgtcgatgtctgccttgacgttcctccactccaaggtgatgctgttgtctgtctgtgagacacggcggagattcctgggagcatccaggcctgtttaggagggaaagggaagatgggcattatgccaggtttgatgagtgcaggagaacttgacatttcaatcagagattcaaaaggcacccgccaatggacagaaatgtcagaattcccccgaagcccctgtcttggtaactgattcacaaagttaaagagcacagtcccagttcctttcttgaggattggtaggtggtaatttcaattggctacattgatttcattttctgtgtctgaggaataatacaaagcccccaacataagactgtggatatgaaaactgttctgttgaatcaatgtatttttaataacttagtgttgatcacctggtgctaccaaactcctgcaaaatgtgtatgggatatataattgacctttgaagtaatgccatttgctaagatgtcaggcaaatgcctttacccactgagccattaaactttaaccagaaatgttgtctaagaatatcagaccagcccttcctttttctcttttctctccctctttcccccatttctctctctatcatgcatgcacacatacatgcacacatatgcacacatgtttgcctgtgcctgggtatgtttggaaggttatttaatccccctttctttgaaaaagtcactaattattatctaaaatgaatgcacagagatgaaaaggccctcgaccatctttagtgctatatgggcctggaggactcatggatggagtggggcagaattggtactctgccctttcctcacctgtgatgaaggtctctttggcagggttgcttgccatgtccactctgcgggagatgagggacacctcatactccgtgtcaggtctcaggttcccgatggagtactggttgtcttcgtgtgtgaggtcgatggtggtacggtctccaggtacatccttgatgccataggagagctcaatgctatcaatttcagccaagggcttgaaccaggtgatcagtgctgtggtgtctgtgacatctttcacctcaatatggctgggggcatccaggcctgagaccaacaaaggaaccaaagggtcaatgccggcagaaggggttgagagtagtggggactttgcagcagaccacagtagacatttgactcataatgaccccttactttcttttgcccttgggagctgcagtttctgtctggcaagctgaaaggagggactgtaagatctacatggagggcttttgccctcatttttccaatagtaaaacagagaaagcttataaagcatcgagaacggaacctggcatacaggtgatgggtgatgaaagcctttcctttgctggtgttgtgtatgtctgtgtgtgtgtgtgtgtgtgtgtgtgtgtgtgtgtgtgtgtgtgtgtgagtgtgtctatatatgtgttgcttatgcatacatgtctctctttgtgcatgtatttctgagtgtgtctgtatgtgagtgctgcatgtctttgtatagcccacgtgtggaatttagaggaaaacgtcttctggggttggttctttcctagcaggagggacctgatgattggattcagattatcaggcttgacatgctcccttaccctaactgagccaccgagccagcctcaaaaaatgtttttgatgaaaggaaccagggcaagagtaatttctgtttcaagcatggcctgttttgtcctcattctggggattcctgtgtcatcctgttaaactcacttcctgccccatacacctggatttcatgcttcctcacctcctggtctcgacaaggctattcttttgttccatctattgagatttccttttcctctttgcctttcatgtcaaccaggtacatatatcctcttccctgtagggtacacagatcctcttccctgtagggtgcacacatcctcttccctgtagggtacacacatcctcttccctgtagggtacacacatcctcttccctgtagggtacacacatcctcttccctgtagggtacacacatcctcttccctgtagggtacacacatcctcttccctgtagggtacacacatcctcttctctgtagggtacacacatcctcttccctgtagggtacatacatcctcttccctgtagggtacacacatcctcttccctgtacagtacacagatcctcttccctgtagggtacatacatcctcttccttgtagctactgctgctcattgtcttgtcacagatgtttttacagtttggttgagaaggctaggctgattgcatgacagactccaaattggcagatgagttgactaggcctaagaactgggcaagtccaggcaagcccaagccagtcaattactaagagggaagaaaaatggccaagcttcactccctgataatgtctccagaatgcctaaagacagcgtaagacaaagctcatctgccctggaactccaatgtgttttaaattgagcctgcaagctcacttggttgtctctctaatttggtaatgggagaccccatcatgctgtacttctgcagaataaaacactctttgctttacatactatttgagtctggggtgtcattcttcagcaaatcatggacccttacaggttacatttagactgggtcattcattcattcattcattcattcagaaaatggatgtttggccttcacgatcctcaggtcatcctgggcatttaatgtataagtttatttttatctttaaaagcagtttagtctatgcttttagcatccatccactaagtgtttttaaatggaagtagccaggattcatgcagagtatgggaaaaggaccaagtttttgatagattgtgaggatgctgtgttgttcatttttgaagtctaagtggttatgtgtcagctagtatttaatgaatccacaaaacacatcatgaaaatgatgctattacctagacagtgacactgtcttccattctcagagctgtcagccacaaacccacttacactgctaagggtatggctagggatactgataaccccaactctgtgttcggaatagtgaagactgacataactctctgctgaccacatcccatggtgttgtgccatctgtgccttgagcttaagacaacttgatgagaaagatgctatgaacccagttttccaaacgttggatctaaggcttaaagaagtaggatgttccaaagtgaaagagaatggcaaggaagggatttaaactcaggaccaccacatcccttcatcatcacaggatgatggatcttgtcagcatttttttgtgtctagaatgatcacagtaaacctcaatgaggtgccagggagaagggatcaaacatgatttgcaccaaaaaattaaggtcctttaactctgcaaaaatgctcaaaaatggtcacaaaaggaacagagaagtgcacgtccatcaacgttggtatttacatattctggaacttcaaaggctgggggtttgtcccttaataagcagaatacaaagcagccaagccttaaataatttggattaaagaggaaagggcaggtaaaagtcacctgcctcttcagtgtactttccctacagtggataagcatttccttgatcttttctctgccttgctggtgatctaatgatttttttcctgtcagtacctgcctcctacctaccacagagagctgttgtcaggatgatggaaaacatttgcttatgaaggagacagtcctgcgtactggccctgagctatgcaaaacgtgcaagcatctaagtgcaagatgttcctttttgtcatgtgtcaacagatttaactttcccagcaccccctgccaaccagagttgatttcttaaagagctggcacctctgttctcttgaagaaaatgagacattttccttctaaatgccaatgcaggatctctttctccatttctcctgtatcttgttttttaaaaagaacaaaactgttagaacaattctaaattcagttatatcccatagaagtctctagtttattaaatcctacttgaccccacgaatttctaaggacattagtgtcaagtgaaagatgtatgagtgtgagtgtgtgtgtgtatttgaaattatctatgagactttgtttgagtatatgtgtatttttgaaagttgtgtgtgtttgtgagtatctgtgtgactgtgacagtgtgtgtgagtgtatatgtgagcatgtgtttatatgtgagtatacatgtttatatgtgcatgtatgagagtatgtgtttgatgtacgtgtgtgtgtgtatgtgtgaaagattgtatgtgagtgtatatgtatgtgtgaatgtatctgtaggccagagatcaaccttaggcatctttccttggactgtccaacttactccttgagccagggtccctggctagccttgacctgatcagcaagccttggggatcctcttttctccatttctcagctgtgcttgagtcatgactgtctggcctacatcatgttaaagtgactcaacttccccaaggcgtattcactcgttttcatacacagtaccatccgtatacacctcacctctgtcatgggagacttggtgttaggattaaatgagctcgtgtggtagatgacttgtgatcgtctccatggttaccttttctgcatctacagtcctgagaatatacctttgaggagcttcagagaggggatgcatctgtttctctgtctctcccatgtgtcctggcctgagaatttcctctgacagcagtgacagaaatgtcaattttgagtctactcaacagccatgccaccatgccccggctaacccaatgacaaggaggctccaaggataaaaaaaaaaaattgccatctcattatgctttgcttttgttttattgtgacagtgtctccttccatagcttatatcatcctagaagtcaccatggagtccaggatggccatgactcatgctaataccctgtctcagcttctagagtgcaaggattacaggtgactgtcttaactggaaccattctaggccaaacagtctcagttcacaaagatgcacaagtgatcccagtcaaggacaagcatcacacagctgagcccaagtccaaatcgcaaacctgcagaattatcacttaaggcactccatatggactttgtattggtaagcaaattctcactgatgcagatgctgtgtcagagggtatgctataagccagaagttgcaaagagacacaatcagctctatcacaggtcttggctggtactcacgggttgtggttactttcttcaagccggggcctcgggtgttgtttttcacaatgtgcagagatatttcatactcttggccaggagcaaggccagtttggcggtaggaggtctctggtctcctcagactttttgtgatctctccctcatcttctttgttctgcaggatggaaacaacaaagggctaagattcagaggcagggacagccatgcatctttatgcttcacttgtttctgcttcttgtttaatttattcattaggtaccctcctatgtagcccagcagattgggaggttagatgctgagaaaacagagatgagaacgctgcttctcgagtttgtttattcctcctgtagacacctgcacttatcctgttcctgtcaaacggcaccctgtgagatccgtaactcagcccttccttctgtaagtcagcagttttaagttggtggcttgcccaatgctttcccagataattggggacagggcctgggttataaccagaaaaccgatttacctaatctttgtgtcctaggaagatctactcatacttgagatgtgccaggaaatactgtatagggcagactggttctgtttctgttatcccaaatagagatttgcaagttggtacctatcgatgatttaacttgtgtttgtccggactctcatctctaaatgctatacttttctatttattaacagcagggaagaaattaacatcacttaaatacataatgatcacacaaagtgatagtgcccagtcttccacccaaagctaaggaaaccaagtaacataagaagcagcaggggcctttgaccaccttgtgaatctcctatatcaaagacttcctccagggagccccttaccatatttcggaaaatgatctcccatgtttcgaaagcaatgtctagaggatcccactctacttccacagatgtctccttgatagacttgaattttagaccttcaggtgcaggcaaatctgtaagtaacagcacaaataggatataaggaaaggcaagatcctaggtagccacacagctagggatacactaaacctgtgacagacagctgtctttgaggctagtaaccaaatctggggtctacttaaaggcttttctggcatgcagtctactgtgagaaaatgtgaatgcccctattatgaccaatcatatgactgcttatttatgatttcatattgttgaattagcaaagcatacataggatttggaatcagatggacctggatcagcatctaacccaccaccgataacactgtgactttggacaagatttatacaaagctctgagatcattgcttttcctgggagaaggtggtaactgtgtcttccctcaggtatgcaccaaggactgagtaatacattccgtgaagtctgctggcctagctcttggcatgcagtgcacactcagtaaggaaaggccaatgctgttattgcttagcaagtaagggccagtttctagccacagtttgcttctcaggcatgaaggtaattgtactgactcttaaaggaataacctgagacagtgaggtcaatagaggagaactccacacaatggtgataagaagattaagatctaatctcctaagactttccagggtaaagcccaactccatctttgttagctgtggggattgagaggagatgatgaactgtctggtctcagtttcctcatctgcacatggggttaacaattgcttctgtctcattgggtgaagtgtgttagtatatattgggcacttaaagtatgcatagtgctacacagcttggccaaggctaggtgagtctacccagaatcctctgcctactcacaggtggcaaccctggcactgacagggatgctcctcttgttttccaagatggcgaacacacgaatgaagtactccacccctggttccagctcccgaatggtggtggatgtctggtccccaggcacacggaactgcatctctaggccatcagcatgggtgggtgtgtacataatgaggtactcagtgacccgcatctcattgtcccatgccagatttacagtctcctctgttacttctgtcacaataaggtctttgggaggggacactgagaggaataagaaaggatattggaggtcaagagtattcgtgtagtaccctataggcttaactcccttgataagtctcttctgctatttacaatagagatctgaagttgtctgttcttaaaacacattgttcccaaccttctggactcagccagagctctactgagtgtactagatacaagttctgtcagtcaaggggctagagagattacgcagtggctaagagcacttttgttcttgcagaggaccagggttccattcccagtatccaagtaatgactcacaaccacctgtaactccagttccagggactctgatgcccttttttaacatctgcaggtacaggtggttcatacacatacattcaaggtaaactctaacacacataaaataaaataaaataaaataaaataaaatactctaaaaagtatttaaaagaggtctgtcactttccctataagaaaattctcctcctctatttctttttactttaaaaacattttcattagttctctgagaatgccatccaatctattttgaccacctggcctaggcttatcttgaatgtgacccaggcaggcattgaacttgatcttcttgcctcagcctctgtaggagctgggtttacagacctttaccaccagaagtagctttgtaatctattagcccattgcctttatgttgaagtccctggccaatagtgttgctttcaacactgtgttcgacacttttccactttctgggtcttagctcagagttataccagggtatagaaaactatcacctcagcctggcccctgtgacttagtcctatagggtttgtctaaccagactctcttgttccttagctgtgactaagggcaagaggtttccctgtggttgcctacatcaggtttagaacccacatgtctttactaagcttgcacagttcagacatactaaacagtggggctatttatttgttcctgcctacctttgtaagatgttctttatcatgatatgagggcgagaaaaatgaagagaaaacggtcattgagcatgagtggtttttttttttgtttgtttttgttctttgctgtgtactcatttagtcaatgtttcttgaacacatactatatgcctatgcttatgataactcctggaaacagtattctgggagatgctcacagtccttggataaggatagcaccaaacgcatcaggtctggttcccaggtaaccagagaccattctttagttgactgcattaataagttaatcttatttaatagaaatgtctgttgagcccagggaattatcatttccattcaaatggaagaactttgtttgctgttggttcatagccagagtagagaaagaaaggaaactgatacgaagtaaaggacaatgaatggctgattcaatacagttgaggtagataatatttaagtatcatttgagtcttttggacaacagtattacttctctgagcctttgatctaagttgcccagtgccaagagactgagtataaacccctcatagggtcagaaaaagagtgtgtgtttaacaggaatatactaacagggcacattaaaagaattggtatgttgataaatcccactatctgtctctgataggcattgcgtatatacaccatcatgaccacttgcaggccagcttgctgatactcaccctcagagcagtctatccctgtgtaaccttcattgcagatgcagcggcctgacacacattgtccttggttgctgcagtcattgggacaggagcgctgcccacagtccaggcccgtaaagccctcatggcagatacactggccgtcctcacagcggccttggccatggcaatcactggggcacctttgctctttgcagtctttgccagtgaagccctcgtggcagatgcattggccattcacacagcggccatggccgtggcagtcactggggcaggaaagctcagcacagtcagggccagtgaagccatcctcacagatgcactgtccgtctacacagcgcccccgctggctacagtcccggggacagcgccggtctctgcagtcttccccagtgtagtcgtcatcacagatacacatgccattcacacagcggccatgttggtggcagtcattgggacagctcatctcactacagtcaaagcccttgaagccttgttcacatatgcacttgccctgtacgcagagaccccggttgtgacagtcattggggcatcgccgctggctacagtcttctccggtatagccctcgtcacacacgcactgcccgttgacacaacggccatgcccactgcagccattgggacactggagatccccacagtcagcccctgtgaacccatcgtcacactcacactgcccgttgaggcagcggccacggtggtgacaatcggcgggacaccgcttttcactgcagtctgctcctgcaaagccctcgttgcaaacacactgtccctcctcacactggccacggccctgacagtcgttggggcaggtgagctcaccgcagtcttcgcccgtgaaaccttcttcacagtagcaggtgccattgatgcagcgaccgcggtcgaagcagtcgttggggcaaatgagctcactgcagtcctcgccagtgaagccctcgtcgcagacacactcgttctccacacaccgcccacgattgtagcagttgttgaggcaaaggggctcgttgcagtcctcacccgcaaagccatctttgcacacacacctgccatccacacacatcccgtgttcctcgctgcagggcactgggcagacttccaggccacagtcagggccggcatagccttcgaagcacacacagaccccgttcacacacctgccctggtcattgcagtcgttcggacaggccagctggctgcagtcttccccagtgaaaccctcgtcacagatacactggccgtcaaggcactggcctctgagattacagttcccagggcagtcaggctcagagcagttggggcctttccagcctggttcacagacacagccgcagccttctgcactgaagttgccccgtccgctgcagaagggcctggtgtccagacgacctgcattgaagataataggtatttagctgggtacatcagagctggcttttggtactcacatgaaaaagccctcactcaaattcagctgcatgcctaggcatcaactgggtggagagcagaggcttagtggaaaaaatgagatggaattcagtcacatttaagccacactgacattaaacccaccaggtcttctcagacacatgtttcctcaagggggttgacagagagaaaatgaattgatttattaataaagataaacttttgaaaattgccttagaagcctagagtcccacagtactccctgcatatggtagtcaggtccactctcaacatcattatcaatgccctttctgatagtattttctaagtggtggaaacagatactcatttctgacttgaagttaatgcttttgtattcctctggaattctgggaggtggggcggggggatataatgaactcctaagcagcaggattactggaatagatgtgcaagggtcccgagtgtcctccagagagagtgaagttcccgggcacatccaaagtctatgcgtgttctcctttatcactgaatcatcctgtgaaatttggtcgacttttaaaacctcagtttttagattcacatagagatgttaaactttaccttaaagggttgttgggaggatcacagaagaaagttactgtgtctggtacatacaggtggctgtgtgggcagctctgacctgaccaccttcccattatcacgctgtgtttgttccatcacgttagaatactctcctcctgatctcacaggctcagtaccacccaggcagaaatgggccattgtaagaacacaggactgtggaagactgtgttaacacctaactcaacaggacctggagaacctcactcccctctgggcctttgtttccctatttgtacagtgagttgataaggctacacagcagtctctttgagagatgcctttgggaggagggacactgtgttattctcagatgttttagggtaactacaaattatatttcagagccaaacatgtttgaccaagataaaattaaagtagggactagagagatgagggtgcttgctgtgcaatcatgagaagcagagttccaatcccagctcctatgactgtatgcctgtatcttcatcttgcatgtgagtagagacaggggcatcactggggcttgctggtttctagtttagccgagaaaatgtgagccccaggttcaaggaggatgctgcctcagaggaattgagaggcagtgatagaggatgtccaggccttcttctgcccttagtgcacgtttataagagtgtttgactgaatacccacacatgtgtacacactcacacacaaacatatatacacaaaagtaatcaaataaataaatcttagaacatttagatttatttattttatcatttcataggtctgagttctttgcatgtatggctggtgtacgctgaggatctaaaagggtgttgatccctgagagtggaattacagatgttttgagtgcccatgtaggtgatggaatctgtatcctctgggagagcaagtgctcttaactgctgagctcactcttcagaccaataaatccaacagatataattaagtgaaacagagctttatgaaacagatttttcaaatgctaggaaattagtgtgagagctattattagcacaactcttccaagaacagaagagaaatggctccaatctctacctttccttgaccttaaaatctctccctctgtctctctttgaaatcactaccttgtctgtctagtttcccaggaaaccagctttaaaaaatcactcatggagtcctttaagctcaccatcttctcattggtgcagagacagggtcaacgaaccctgttgccttctgggaagcctaccttctgcaggttggaggcaacagcctgtacccatggtgcactgctcccttagagacgataccagcaactccagctcctccagcctgctcaggagctccttcacatctggagctgcagcacagccacaggcccggcgggggatgttgatgcggtgtgtgaatacaatttggttttccccatccactgtatgttcctggaagctcccactggactctggcgtgggggtcaggtctttctccccactcgctgactccagatccactgagcattgggaacccatgggcaacttgatgttgtagatatggttgaacaccactggctgattctcttctggcagggtcatgtttagcccactctctcgcttgtgcctgatgattttcttgaggaccccaccttcgggagtgagggcaaacaaagctagaaagatgcctggcagtagccaggtcacggcccccatggtggaggttggactggctaggtgtctctagatctgtagggtgcctgaactcccagtagagtttggtatttagatgtactcaaaggaatacagttggatgtccccaatcttcttggaagaaggatctataaataaaggaaaacaatagttattaggcactgtccctaatacactgtggagtggccacaattccgagtgatttttgccttcttgccccctgggtctgaaactttcttgatatccctttactatatatggtaatgaggacataaaatggtctctagaaaaatcttgcaattttgaaagattgacattactcactcaacctttgaaaatgtaaagagacaatagagaaaagaaagacctggcagaacattaggaaaaggtaggcaggggcttgtatcgcagcttcggatctgagcacttagggaagttacttaactttgtcccttgtttcactttttacagtgaaaatcctggccaatggcagggttagaaggctgacccgatgagatcattccttgtccctcagtatttacaagccacgccttctgagggaatttttctggtcctgtgaagtgtagctgcaggagatgttcaatgactcctgactgtaattataaattcttcaagctgaaataagtgcttctgtttctctgtcactggagacagaggggggaagcacagtactcaggggaaaatgaggttttaggtcctacattgcttctttctagtcatgaggctcttgcgtagcatcctttctttgtacctcagattcccttttccttgatttatctatccagaacattgcgcaatctaagctttagaaggacgtgacaatgcacttcggaatcaggtacccaaattaagagttgtccactagtttctagtgacttcttaaattgactggtaccgagaaaatttataccgaatgttctatagcaaccaaagttctgtgggtggtagaaataaatataagatcaggcatggactcttctaacaacaaaactaaaaagaaaacagaacaatcctttcagtatttagagaacaaagaaaaacaagaatgtagatgatttgttttctgagaatagagtcaactgcttatggctttgaaaatcacaggaattgtctaacgaatagcaaagtatggcttagtgggaaggaagcaattgaggatgtgacatagtgaggaggattaaatgagacagaatgtggaggaagatgtaccttgaagttcttttgactgctgagctaactattcatcagtcacgatgccattcatatgcacagacattcaggtagggtagaggagctgtcaaagatgcttgagaaattactgagtgaaaacatgagagcctagctaaattctggctcattttaagacctacaaaacaatggcttatatgtgagaaataaatacttgacagaaagttacctaaggtcttctctcattatgacaaacacctgagctgttggttgagaccccaaaggaagacttaaggataatgtgggaagagagacactatttcatagtgtagttaagaggggaggaatgacatttttgagagttttctttcacatcagctcatggtgtctgaggattgggggtggtgctttgggaaagatcatccacatcttctgtgttgtggaacatctaagccctttctggttccataacttgggcaagatacttgtcattcaatccacaaccctggccttgtttataaaataaggctcagaaaaaatttcaaagatggctcagttagtaaagtgtttgtcatgaaagcatgaggacttgagtttggttctttgaatctatgtaaaagggtgggcataggagtacatgcttgtagatctccgaggcttcaaggtggaatctgcaagctccagaccaagggataggcccagtctcacctccttacccccaagaaacccaaaccccccaaacaaggttgatggctctggaggaaattgaggaaagacacttaaggttgacttctggcttctgtggcaccaccaccacccacacaaacaccacacacacacacacacacacacacacacacacacacacacacacacaccagggggaattatggattagaggtctgtactggagcttcagaactttggtgctttataggtagtcaatcaacaggtcatgacattgtggtgcactcttgggatcacacactagcaagagtctatgccaatagcactttttgtttaagtcagaacttggccttagttgaatccagtcccaaattcagtggcaacttggatctggatcagagaagctgtagaaatcactggtgtatgagaaactaaaccttgtgacgatcaatttgctagaaatagaaatgtgtactctagagagtgtagaactggagagaaataatgacattagcaatgcaaaaatattctgctacacgcagataactggctggtttatgtctagggtagactttggggaaattagttgagattgcagtttgagagatagaggttagacatggggagtcaagttcagatagcttgtgcttttataatttcaggatgaacaagttaatttacaaagatgataaaaagtacagataaatgattatcattaaaaaaacatattttgtgtgtgaatgtttttgcctacatgtatatctttatggatatcatatgcatgcctgctgcctgtgtgtatatctatgtaccacatgcatgcctgctgcctgtggaggccagaagagtgaataataacccctaatctagaactcaagttatagatggatgtgagctaccatgtaggtgctaggaatcacacccaggtcctctggaagtgcagcagatgctcttaaccatagattcatctctccagtgccctggactcttatatctatgggaagtgactagaaatgaagagtccagagaatgtgttataggaaactgatgacttgtgctccttcattcatagctgaggaagccaacatggagtgtatcagtattaccatatatcaatcccagagaaggagatgtggggttgtcttcatgtacccaaaagaacaagtgctgctgtagatgctctttatggatgactgggttggtgactagtttggacacttcaacgcctataagaagcatgagatatactaaagattatctttagttatctcttcacaggctggagaccattatgagataaaggagtcattctttgaatattttccctggtcatagttggagaataagcaatacatgatttcagttttagacaagtatcaactttatctggatagccttatgtggctggagacacactttgtgttagttacttgtgacatcgtgattagtagctcatggaatgtgtttatctttttgacttaggtacatacatggaatatcctggactcggatagacaacaatgactctactttttcaaatgcggatgaacttgtttccacatcattttggcaactctaaggtattacggcaaatttttcttctggctaacagaggagaaaattttattgtgctaggtcagtcaagcatggggctgctaacacaggcttctaaaatggtctacaaattcctcactcctcgtccctcccaacagccataaattccttcttggaatgtgtcaggaagagccaggagccaggaaatagccttaagtgtagatgtgttttccaaggacatctgatcccctcagttgagtgaatccaggacactctgggtgaaaaaatagacagaaaaaacttaaactgacaagccaaagaccctcctgagccatgagggtctgaattttagtatcggcaagtcattatctatttgagataggatcatagacccttgattggtgtccagtagcatatcaatgggactgctgattgcctcagagacttgtcacttaaaaacgatttgttcttttttttcccactagagatgagttgaatgatgtgctataggtcttgggatagacttaggctggtagagagtttcagagaccagtgatggacagctctgtgtttgtactgaggtcacaggtcagtcaaggaggcagtcatagaaacagatatttactgggacaaatcataattgctaaagtgaataaatatcctagaagagactatgtgatgtttgggaccacctgctctagaggcagacaaatatgcttgactctgttcttcttattagtatgaaccacagcaagttgcaaattatctttaggtaaaaaacgatgggtggcagcaattccacacaattccaccttgttgctatggaagtggatataaaatattgcttgtctaggcctctgtgctaacatctgtataatgacaacatcaataccagctgcatgtgagaagaaatgagataatttatgcaaaacactttcttagctaacacttaaaagaagatagaccttaagtctagtaggcatgattgctttgtcttgtttggagaaggcggttagcagaaggctactttgtgaccaaaaataaattcttaaggtactgtcgagaagtccttccttttctccaaacgtattcagttttccttaagctcattgtttctttctctttcctcctctttctcttctccctccttccttttttcccattaggttttatttaattgtgcacgtgggtctgtgtgcatgcatgtgtacacagggagtgggcagaggccagcttctgggagccaattgtcaccttccaccttgttggaagcaaggtctcttttgcttctctgttgcactgagcccagtttgctagcaggtccatgaacttctaggtgattctgtccctgattctcttcctgctgtaggaatgtcgggattacacactgttgggattccatctggttatttacatggatcctagggatctgaactcgggtcatcaggcttgctctgtaagcaccatcacctactgaaccatctttctagttcccactgtggctttctctgtgggagcctacagtcctcagtgtttcagttagtctgatatcagggcattctgaaatccttaggagatcgaaaaggctgtggctgcagacccaggattcccttagccttcatctaattcagtagcaggaacaagggagtgaatgagttgggtggagctcttttctgggaggtcagaactttggccaagacttttctgaggccgagagctgctactgggatggttgtccatgatacccggccagcgatttcttcagaacagactgtctgtggtttagtctttcaaaactgttctcttaatggaaaacacttggcccagcctcgcagtgctttccgtatgcagtcagaaatcagattataaaatcaaaatcataactgagcagggaatacaaccaacaggagaggatcactgagtccagaagtggtaaattagtgctacccacatactttgtacatgcagacaaataatgacacagttctgagaaagtcctactgtacacttatgctgcatagattaccccaaacagccatatgcattcatcataacatatatttatatatggaaaccattatggtaaaatggatctataatattacattgtatatttggaatttaccaagactgaagatatttgttagtctcatcctatacaaacaaagtaactttgtgtggtgttagatatgttagttatgatcttgaaagtggtaacatttctatctgtctgtctactaagaatcaatctgtctgtctactactacaccaatgcttttaaattctacctcagtaaagctagaaaaaataataaaaataaggccaagaatatgtctctgcaacagatggagagcactacagaaaaccataaccaatcaagatgtagagttatggagctcagccctaatggatatatctgtaaaatgcaaccacacataaatttcaggggatgttatagaagataggataaaagagtgtaagaatcagagaattgaggagtctgatataaatctgtgtttcctagtaatatccacggctatcctcacaaagtctcaccaacaatggctaaccaaatctgagctaactaaggatgccaacaacagacatgagaaagttaatatggaaagcccacgaggcctaaaccctacacaaagaactctaggtaatcaagcaatgcactggcaatgaaagaggtggtcctctccagagaaatggttgttcagtgctaaaatgtcagccctgaaacatacatgtaagtttataatgctaagtactggacatgttatatctatgcttgcaataccaattagtgaaaaaagaggccttggatttgaaggatagcagggaggtggggtatgtgggaaggcctggagaaaagaaggggaagaaagaagtgtcataattatattataatctcaaaagtaaaataaaaataatagaaggaagtacatatgaaaagtttccattaatgcttaacttgagtccattataatggtctccagagagaagtgtactccagaaaggaactgagaggactcttgtgctaagagctttctacaattcttgattctgtatgtctttgttccattcatccatccatcaatccatccattcatctacctgacctccatccatttatccatccatctatccatccatccattcatctacctggcctccattcatcctcctttcttttatccatccatccatccatccatccatccatccatccttattaaatacctaccgtgtgtcaagcctctagttaagtatgaatgatacaacagtagccaaaacaaatgtgaactctacagtaataaaacttaaaactacctcctagacagtccaaaacgtaactgtttttcaacctactctcaagtgccactacaaactagagcatgttacatggttctatcccaacagaaagggggaggaatgctgaaattctttccagagataattgcttcttactcactgtgggcttcacagtgtgaaggacactggggaggagcgactgagtgaagagctgtgtccttttcccagaggtcattatggaaatgcatgtggagattatacatgcacaagagtagtagcagtgccagcctcagtgaaagagttaaggaatggaagtagtactcttggccaaggagctcaccgaggtattactgaaggaggaaaggcccaggggaaccaaatactggttgaagagttcttgagagttcaaggagaaggataccaacaatgataatagaagtgaagaagatactgagtgattcattgcttgtatttttctagagcttgtgctaagaattttaaacacatgatttcaaattctttccaagttgcgagataaagttttttatcttcattttgaagataaagaaactgagacatataattattatgtcatatgtgcaaattgaagtgtcactaaggagtaaggatgtgaacccaagtccctctgagtccatgatcattcactgccctttgcactggaagtcaatgaaaggagttagcatttgagagcagttgctgctctgcctatctgaccttcaaacagcaggctgaaggggagtctatctgttctgtttgatcagaacctgatggtgctgctgtggagtgaagcaagctgttgggtacctctgagatgctgcagaatctgacttattattggagagaggtcttggtgtcttgaaagcccatttgctccacttgaatggacaggcttaatctgtcctcccagtgaaactaaaatgccatccattattggaagttagttattttcctttctgtcttttgaattgccttttgatgtctagaaatgtttcagttctattttatacttatgctaggttgatttagttatgcatagttagactatagactatatagggatttgggtttcatgttatatgtggaaggcaagttatgtgtggtatcgaggtgtatacccaacactaaaaactgtacctaagatacaaccaaccaaagttttagaatgttcttggttgtaacgacctgttgcaatttggcaatagttctgtcaaaccaaatttagccttccacttaaacacaagcaaaatggctaatattaaatacaaagggatccagatattatattgattttttttcctttcaggtgtttggatgaatggtattttgtggctcccctcctccctcttcttgaacagaagtttcattgctaaccaaattaagtccccaaattttaatccataaaatatttccatctagacacaataatgagattcatatttgtggtttagtatacctaagagcagctctgatgaaaaatgactaggcccattgatacattcagaccacaagctacctcctgatggtctggtttcaatttttgaaataaaatttctgcagagcagtagttttccctcttctgctccttgcctagacataaaagaaaaaataaaaagtgggtttgaccaaatggcaacactatagattcctatgaaattcttgaaaatcatttcaaaaacaaatttgaattcatttctcctggaacaatagcctcctctattttgaatttccatcagaattttaagaaatgcagttggctctttcctaggtctcaaacgattgagccaaggttaaagaattagagctatttattcaggagggacaggttatagatagagagcaacacaggagcaggacactgtgaatgcatgtgctaaatatttggcatttggggactagagtgttcggaaaccttttctgaaataacagtcttggcattcaaatgagtggaattctgctggcctgaggtttgctcttagatgcagccagatagagacactggcagttaccaaacccaggaggcatgaagatcagccagccttgatacactttgataggacctgacctctgaaataaaaatggatctctaagattggtagcaagaaaccagacactatggaaaactgagtccactccagtaattaactagtgtgcctagaaaaggcatgcagacacatggtgtctacttttcctttctcaaaaagggatcacctaaaagctacaataataaccagtcctgattgaaaacatctgtactgtctgtgccttgtatggattatttcattgcttcttctcgaagatccctgacatttcttcctttattttcctctccctgaggatggggaaactggggtcacatagctagaagaggagaggagagtttaattcaggtggtctgactcatcagttagaggcagcattcttaaccctcagctttcttccagcaatttagtgaagccaaaggctggtttgcatgactaagttcaaaggattaacttcaaaataagcttgagtttgccacctcccccccaaaaaaacccctattaacagtgtaaaacaactttatgaagttacacaagagccagaaaatagagataaagataagcctaaactcagaattaggcttaatttagccatacaaatgcaggaagctatttcctaatgtgtagtctgtggcatgttgagaggtattaatgctgagcaaagagttatttcctagttaatcatgtttggagaaggctatttttaaagccaatgttattttaagccaaacaaattacgtatcttactttatttcaagattttccagggtcttttatgtgtttgtggaaacctccaagaagatcgtttatgtgtgtttcccaaacttacttgattcttttgtgtttgaagtacgtcacaggttgggtttgatggcacacaaggggcagtaagtactggcaccggacaaacccttgatcctctctcttttcagtccttacacaatagaaatgatgctatacctggccaggacctgtctttcataaaagggtgaagccccaggatggaagagctcaagcaactagagcctagggtgagacaaatcagtatatttatttggttcttggcgattacaaatgccttttcatcacgatccaagcttaggcaatcagagaacactgttcatattttcctgccatcaaaagcacaggcttgagacagttcagcaagttatctagtcagtacaacttgaatctgaaaaaaaggatactgtctctgtcttattctgtggaagtttaggttccttttgtcctattgagtgttttttttttctttttgaaacaggatttattgcttggtctcagaaattaacatttatgtaatagttaaacgccaggggaacactcagtttcattaatgtgaatgaagttgttggagtcatagagggagaatgaaattggaaaactggggtgcgcacggcgattttatttaccattttgggcttgaggagagggcctgaagccaagtgaactaatgtctgtatctccagcaggtctctagagctggaagagaacaccctgctcccctccagcttggccaagagagaatgttaataaatgagaggatgataaagcaagatgtagcagacaggggagtttaaacatcaatgggtcctggaaaattgggcctcatactatgtatagccaagaaatcagtcagaacataagaaaatttcagagaccctgacacttcaaactttcttttggaattttacattgggattgttaacttgacacaactgagtcacctgggggagaaaaacctcaataatgaattgtctagatgaggtggtttgtgggtttgcttgttttgattacgttaattgaggcagaaagacctgctcatcatgggtggtaccattccctaggcatggtatcctggactatataagaacaaagaaagtaatttgaacacaagatatgcatcccttaattcaacacccaattcttttgatgttgaatataatgtagttactagctgcttcacgtcattgtgctatactgtcccaaaataatggatcccaagttgtgaacaaaataaaccctttcatgtttttctccgagtattttttatcacagtggccgtgatcagaaggaggcagaattttatgtctaaacaagcaaatcttcaaagaaggaaagagaattaaattccttctcagcagagttatttatttcagcatatggtgggataatcagaatattccacctgagggaacagggttaggaaagaccataggagaaggaaagggagaagaagaaggtggggagggaaagggagctgataatggagggagggatggagggggaggaaagaggaaagagtaagagagtgagaaagtgcaaaataaataaagggaggatggggcacagtcgtgactatcagtcttctacacttccttcttgtatagagtttggcattgtgcctctacctgtgctgggaagacttattaaacaaactttcatttctgtctttgtcttattatgtgtataataacatatggcttgccaaggtcacagtaactggaaactgcatgaaaatctggcatactcattggaagggtcagttaacattttcttaaatgacctgagaatacatgtgctgtcagatcacctctttctcctagggtttgaatctgagttcccagtttgaacacttggtcttcagctgtgggaataatttggatgctgtggagtctttgggaatgtgggccaggtgggtagaaggaggccagaaaggtgggtggtgggcattgtgggtttagagccaatctctttccagtctaatttactatgctccctgccatccaggtaagcaagccagggctgcatgcttctgacacctcaggctgagtcctgagctgccctcccctgccatcctggagtaagactctgaaattccgagcccaaacaaaccctttttcctctatgttgcttctgtgaggtattttggtcgcatagacacaacttcataagtatctaaatttactattgtagtaggcactgttatagaaaatatgaaaacaaacatggcttttttctaatacaaaaaaatgtacaaaaataggcttctacatcacattttgctgacccctggaggaatatagtgattattacagtttttgttatatattcaaatagagctggattggcaataaaaccaacattttcttatttactgtttataaatctgttttgtgagcctgtggaatagttcagtggataaaggcacccgttgtcaagccacgtgattgagatcaatccctgagaccaatgtgaaataaagagagaactaactcccctaagttgtcaaattgtcctctgacttccacaaatatgtttgcctgcttgtgtgtgtgtgtgtgtgtgcgcgcacgcgcgcacgcacacacacacacacacacacacattaaaacaaacttgtcttgtgcctaatgttatgcttcaggtttttcattgattttattactgacataaaacgctagtgaggagcaaattactctacctgtttggaagttaaactaagacacagggaagcataaggactaagtcatgagacagaacatgagacagaagcagcctttggagcttgcactgtgactctcatgtgggacatttcaatcatattgtgccacactgggatggctcctcaaacactttcttcagttctgaaaaaaagtgccaccttacaagttgaactgctcagtaagggacaagataaggagtgcagaaacagttccttcatcttctgcttcccagacccctagcagctgtctaagtagtctccacatgtaactctggaagtattcgacctctgccttcctcattgagctctggctggctctcctacttcgtgcactttttctctggagagcactgaagccaaggtgcactgtttgcaagtggttattagctcctgggtacatgttggcaagttctctttggctcagacagggttccagaatctgccagactctggctttgctcactgggttccctagccagaaagagttgctaattgggatgacactctacatgtctctgcctctccagctaggtttcctgacctgggcatgcctgttttggctcaagtaggatgtttgccctttttactgtcagcttaaatgtgtgagggcaaatttactgttcccttaagcatctggggagcctggtgctctggtatcgtttccaagatcatggtccaacacattttaaggcagctttcatatggataagggtgtcagtggtctcatcagattggggatatggattcaccagagctggacagaatttctcagattctgaatttgatcgcatcaaacattccattagtttctaatcaaacagggatattcagattcctaaccaatgtctaaagacctcagtcccatattccattctgaaggttttaggagttaatctggctcctttctataacttctcttccctcatggcatgatctggatatttgtggatcctcccaacactcatgtattggaacctaacaatattgtagtattacttgttagaaagtaactgttcatgtggatagggctttctataatgggatcactgtccttcagagtgatgccccatggaccctcccctccttgtctcttccaacctgtgtaggcacagctgtgaatcttaatctatgaaccagtatgtggacacttccaagacatggaatctattggtgctttattcttaagatcaaattctccaggcaagtggatttctgttctttccatactacccagcacacaaaattttgccatagaagcccacatagaagaaaaatagttttataatgaattctaggatattaccttattgtttctgctactgtgttgtcagcctttggaactagagctgaaaagactatatgaaccctgaatttccaagatattgtcaagtgtttccagacttagcagccacagaaccctctttaagtgactttcagtaaggatctgttttataggatacaatttgagaacagctgaccaagtggggtcttattaccaagaactgtctcaaaagcagcatcaacatgaatgaccatcactatttgtgtcacataccagttttttggaagcaatgtaatacacaatactatttaataaccatcatgatcttctaagataggcattgctaagtgtgtcatatatatcatatatcatacattatacattataaattatacgttatatattacatattaaagttagagcagttatttagtcaagcttacatagcaaacaaaaatattttgaacccagagccctcagataccgaagccacactcttaatcacgattcatttctttctatgggttgtgattttccacatatccaaacacaaagagatccttgtcttcatctcttccctgagaccattcattcctcccactagttggtgattgatcaatcttgttacaacagccatctctgactcattctcaaatcccctgacagatgtcctctgtccttggtactggcttttcccaaatcccaagtaatgatggcagttatttttaggactggccttgaaagcaaagataatccttgaagtctgcttcctacatggtttcctgtccagtgctggaaacacataaataacttctaactctagtttttctaagcaagactcatgagaaatggatttttgagtcttggaaataaagactttatcaggtatttaagattaattttgaatcatgctgattttcaggtgaaccaggtacaaatatcctcttgagaactgctgtgtcagaagggtttgtctattgtataataattacagtttgatataagggatggtgcaaaagggcacactatgggagtatctgttgtacctggaggaggtggcatcagaacagacaactaaagaaagaagatcatttagatataaaacagagaatgccattttatgtaatagaaaatgacatttacaagaaaaaaataagcatgaaagctgtgtgtggaaagcatgatgctagctgaggcccagcgtctgcttgggggccaggggtctggacgataggaaaccataaataacaactaggtgatgcgaattttctttgtagaaaataactacttggaaatatttgggcatagacattctggcctctataattctaacttgtcatttagatcaaaggtgtgatggggccccagtaggaatctcttgtattggctcgtttataagacactgagaatcgagtatggaggttgctaacagagggcatggggaggcagagaagtgcttgacttgtgatacttactttgtcattgatcagatcaaaatcccctaaaaagaaccaacttagggaaggaaaagtttaattttggctcactgtttcagagaattgtagtccatcatgacagagaatattttaaatttgtgagacagtaaaatactaagatctcctcaaaagactttgtcacctattctggggagtagtgggtggggtggtatagcacatttacagataattacagcatgcttggcagtaccattttggaattgaagcataacataaggagatgtggttgggtatcagtttaacaagggatggagttgtgatgattgctttttgttgtcagcttgaatggatatggaattagctcagaagttcaaggcaggtctgtaaggttatttactaggaaaattaaggagggaagcaatctccctcagagtgtgtgggaacttcctttgatgacagtatatgagaagatccaaggggaaagcgatttctcttctgtctgtttgcattattctcccactggtgagtgtatctactctgttgccgctattacctctgttgctgccatctttcactgacatgaggactcagattctttagcttcccaatatggactaaagattaggggtgcttcaggattcttccagacattaaacatcacattggatcttctggggcatctagccttgtagacagagtagccacctgttctctggctctccattatgacaacagtcagtgttatactacagacaatatcttaatatggtaagccaacctagtaaatcttctttaatatatattcatcctattcgtcttgtttcttgagagccatgactaatatagaagatgtggtgactgaagcatgtgtcagaagccactcacatattgcaagccaggaagcacaaagccagagataaaaacagggagcagggatggatgtaacattctgccacccagaccttgcccttgaaaattctttgactatagaatctatagtccctggaacaacatctccagttgagaattaagcactgaaagaacaaaccttcagcagcattttatatttaaaccaaatgtggtggtttgaatatgcttggcccagggagtggcactactagaaagtgtggccctgttggagtagacgtggccttggtggaggaaatgtgtcactgtaaggggtgggattgaccagtcttcccttggttccctttggaacaagatgtagaactctcaggtgcttctccaatgccatgtctgcctagacactgccgttctcccatctcaataataatggactgaacctctgaacctgtaagccagacccaattaaatattgtcctttataagagttgccttggtcatggtgtctcttcatagcagtggatatcctaacacaccataacagcagtagaggacacaccatactgcatatggtatagaagaaagaaagaaaatgaaattctaaagtttagtcttaatttatatgctgggaagcctataaattaattatcatacctagatgggtgataagaagcaggtacttttcattttcactgcttgaacgttcagtaaaatatattttgtgtgatggctaatcttgatggtcagtttgactgaatctggaatctaagctactgggcactcctgtgagggttttctcgatcagattatttgaagcaggatggtcaatcttaaatctggatagcaccttctgatggcagctcacatgaaagatcgtaaaacaaggaaacttgtttctttggctccttgtctgtgaggaaatcctgctaatttagggtaaatgtctactatgactggttaaatcaacagaactcagcagaaaatggaggactcccattagcagcagggcttccccttctctgactttgtttggggaacccaacttctcacaccttctatcttgggaaaggtgagtagtccttggcagacctacaagttcaacttcctctccccacccccaataagaagcctcaccataagtacctgagattcctggaatgcctctccacacaaatgaggcattcacagaactttaaactctagccaatgattttatttaccctgaaaattccttcccgctctccaaggcccatatatagctctggttcaccctgaataaatgcatacaaacccagcccaaataaagatacgtgcataagctaaagtcctctcagctgtttcattgaagaccattggagaaggtcttcgtctaaaagatctgtaacattaagaccagcccactacacacacacacacacacacacacacacacacacacacacacacacagagagagagagagagagagagagagagagagagtcaaccagccagcctgggatcctgcagaaccctagtcatttcaaactctgctccatcctgtagattgtgtgctgtatcacagaaccacagctagacccccaaatgaataacacacgtatcatcatgatcaaattagttcaatggattacttccgaaaccaggtgtggtggtgtgtgcaagtcatcccagccctaggaagcaggaggctggagaaaactcaaggtcattgagttggccaagaaaacttggccacagagaaagttcaagactaacatcaattacctaggacctgatctcagaatacagaaagtgtagctaaactggcagagtgcttgctggccgggcatcaaggccagtgctgcaaaaatgaaaaaaaaaattagaaagttaaaaaattagaaagttagaagagtttaaaaaaaactaaaatcctactttgggcgattattgtcaagcaaattccatttatcgaatgtctttgtctgtctgtctctgtctctgtctctgtctctgtctctgtctctgtctctgtctctgtctctctctctctctctctctctctctctctctctgtgtgtgtgtgtgtgtgtgtgtgtgtgtgtgtgtgtgattggcttggatgagataaatggctttgttgaaatgccccatgtgagcagttattaaggcagcatggaactgacaagcttcagtctagaacctcctgagaaatggcgtccagtcaacaggtacagcctggaagaaggctgatccccactcaagtcttcagatatgatctaaacccaggccaatgacaactgatcctagaaattccagcctaactctgctcagctatgctttgattctagacctatagaagccataagacacaacctgtgatgttttattttttgtttgttgttgttgttgtttttgagacagggtttctctgtgtagccctggctgtaatggaactcactctgtggaccaggctggcctcgaactcagaaattcacctgcctctgcctcccaagtgctgggattaaaggtgtgcgccaccatgcccagcacctgtgatgtttttaatgactatgtttttgtggtgggtaagtaactaatagaattattagctcaatccacatgtgctatactatttagagaataagacagttcatttttcttttgtaagaggatatattaactgcagacttttatgttgtccctggattctaagagcagagtcaggatacccaagattctgccctgacccgctgccagctggcatgacatcttaggaaaatatctctcttccccatgtctcagtttcagcatctttaaaatgaagatgttaaagtcggccagtgatttgtacaaacatttttcttctccttctcctcctcctcctcctcctcctcctcctcctcctcctccctctcctcctttcttcttctttttgtgccacagaaaccttcctttctatctcatgtgaaagttccgtgcacaaaacataaacagagaggggctttagatgaaatgaggttgaaagtgacttttacctcacccttctctccatggcatctcctgaattacctctggatttctttttgaatctgatctgtaagctcctggctttgagggtacccatcaatcagcctcctcagcattaacattctaagttctagtgagagcaacctctgtaagaacgttcttctatagcatccctgcttccagctacttctgtatgattgtcaatgacaaaggctatccatgatgccactgcccactgcgggagggagctgtctggcttcctgtctttccccagcaagcaggctcccctgctgtgccggagctccttctgtggttacctccaccagacttctatcaccataggtggctttagtattagatgtatacatttttttttaaatttttaagatattattatttcagggctggagagatggctcagtggttaagagcactgactgctcttccagaggtcctgagttcaattcccagcaaccacatagtggctcacaaccatctgtaatgggatctgatgccctcttctggtgtgtctgaagacagctacagtgcactcacacataaaataaataaatctttttttaaaaagatacaccatttcatatactggcacttacactcagtgtgttgcaagggctggcagatggtctaatggagttctggactatcttcttttgatctcagtctgttgctccttcaggtgacatgcagtggcgtcctgttgtatggctgctcgggatccctgaacactgtacttttatccaacattcccagacctagtactatagctttaacattttgaataaaactaatgcttttcccaacagtcttgattctcttccactttttaactcagcaacggttaccttaactgtcttatatgactcttccagtgcacagaatccacagacttgtctaaagcccctcattgatatttcattcacccatttaagcattgcctgctttacctaactacctttccaaaatgcaaatgtgaggctgtggagatggcttgtgctgtcctttcagcgaggatgagtccaggtctgaggatctaagtaggaatgctcacaaccgcctggaactccagctccagagatctgacactctcctctgaccccctagagaaactgtccttctgtgcacctacctcaacagagacgcacatccatatgcataactcaaaacaaatcttaaaatataaatgtttatcgagcaaatagcctgtcatctctaagctgttttgttatgtagacacttgagtcaattctttacaatcctgtggcatatcgagggaaacaaactcgatggtgttgatcctatgaaggagctctgaatgcctttaccttctactttaagcaagtaacaaaggcctcattttaccttcctgcaaagcctttatgtatatattctgggagcatgtcaaggtgatgtacataggagtgtttcattaatgcactggttcatgagcataccacgttgggaagatccgtcctgcacatgagaaacttgctcagtcctgaaacctgaaagagctgcagagcacacctacagaagtcaaaccctgttgtattgggaacagcagagaacttcacagacattacattctgagggtctgatgcctgcagaaggcaggcagactctggggacaatgacctccccacgacaggaggagcagaagcatggtgcctagcatggctcaggtagcctgatggtcattacctccttctagggacttggcccgggtttatgttaaggtttcccctatcatctacctgcatgatattcaacaggctacatacataattcaccccaggtccccaacattagaatggcaatgatattgcaaataataacaatggtaaaatggcacagtattgatcgagtaggtgacaacatttagtgggctggttaatgttgattgtttttttgataagatttgaaaaaatacgggtctagaaacaaacctctggacgtgtctgttagtcattttctagattgcattaattgacgtgagaagcctcaccctaagtgtgggtggcatcaatccatgcagtgggggttctggactccatacaaaggagaaagccgactgagtaccagctctcaatcactgttccctgagcatggatgcgggatgaccagccacccccagctcctgccattttgcctcctctgccaggacagattatgtccctgcaaactgtaacccaaatgaaagccttgacaatggacaaagtaacaaatgcagttactttcacagttacccttcatctccccgcatcaaggatagtttggacgattctttagagatgttaacagaaaccacctttcctcttttagggtaagaggtgacctttggctgattctgaagcaagctatctgctttcagggcttatgaaacacctttgtctcttggcagtctgtttgaggaaggttaaaggaccagccaaagccatctgagtttaagtgcccacatttcaggacctgtgaacttcaggaaatttcaaacatctgagatgacttggaatgaaataatcttttaaaaatttccactcacaaatagagtgaaaggacacatggaaaggattttccgttcacaacctgctttgagtgtgggcattctgattttgttccatggtggagaatcaagaatggcagagagcactgaactccaggtggctcttactgtctaggagagtgttttttaatatgtggcttgtgacctctttgggagttgaaggactctttcacaggagttgtctaagaccatcagaaaacagcaaatttacattgctattcataatcgtagagaattaaagttatgaaggaacaaaaataattttatttcggggggggggacgtcatcacaacatgagaaactgtattaaaggatcacagcatgaggatagtcgagaaccactgctctaggaagtatatatggcagaaaaggagaaagaacaaagatgattagatttaagggtataactgaacaaaagtctgagcgccaggctcggaatcaagagaactatgcagtggtttctcctccacaagaagtcatagggtgtgtgcagatttcatagaaggcaaagtcaccagtgtgctttgtgttgtaaaggattgggatttttaggaggctcgtctcactatacattaaggggttttccttcttggaaaggggccttcatgtaatgttttccacatgttgaaggtgtttggactggtctgggacgggattcaaggggattcccagctatctttgtgtggtgagaggtgtttgaatcacaatcttcctctttgaggcttcggcagaatcagtggcatggaggctatagctgttccctgacttctgttagagacctgggagagccccatttttatctccccagcagcccccttaaaaccacacatttagctctcctacaccttagaagatgcaggtatggctgtctcccttttctcccttttgtagctcccacctgcacagccatgggaagtgtgggctgatgccatgaaaatcactaggaaggacatgactgcaaccttgccaccccctttctctctctctctctctctctctctctctctctctctctctctctctctctcgtgtgtgtgtgtgtgatttttctctctttctgctcactctgtcttcctctctgtctttctctttgtgtttctgtctctatcttcctgtctctgtttctctctgctgtctctgtctgtctatgtctgtctgtctgtctctgtctgtctctgtctgtccctccgtctctgtctctgtgtctctgtctctgtctctctctctctctctcctttctccctcactcaccctgtccctcagctgaaattggaatgtttccgtttctaagcattgggttgcactaccaccagctaacctttcttgtgcaccatgaaaaacgatagctgcagggctcctctgtgaaatcaagaggcaccaatgccagctggagtcttgtgtgctcttctggccattccccaaaggacaccgtgcacagttctgcacttgggtagccaagtctgacatcaagaggcagcgtgacacaagagacaaaacggtggcgttttacttagaaagtttgggtttgcagccagttctgactcttgtgagaagatcctgggctgagctactcagcttccttgagcctcagtttctccatctattaaatggagctgttgattcataatttgcagtattagaaaactaagtagacagtcttccccatcactgtgtcacacttcatccctgactattagctattttatgtcagtgtctgactaccatagaggaactgtatatggagaaccaactaaatatttgtttctcaagttctacttttcaaacccatacagcctcagtatggaggagcctttatgctttgtgaaagccagtttgtaagttcatgaaactgcgggaagagagatgagaggtggttttagttcacagcgaacatgagaacggataggattcagggagtatgtttttcattctgtcagcctgagttccctttccaaattctattctggttatatgatcaggctattgctgtatttatgggtggccacagtctgcctggtggggcatattttgtcagaagggaagtgctttccctctgagggctatacaagaagctgacacgttgaaaagaagcacagcctccaaagaaagatatgagcttagattctggccctatcacttgagttccaagacccaatctctctgctctgtgagtctctctgtcttataagtacacccatgctccagagacctgctgtggccatttgataccatgatgcccagggaagcatcaagagcctatagctcatacactggttaattctatgctggctatagtgattactgacattgattgaagtaaccaacctttcttaagcctctaaaattcctgtctcctgtttcatttggggaactgtccttactcccatagctgctggatttcagaacactgatctgagtaagcactgcctagctgtgagatctggagctgtgtgtcccattgtttgcaatgtggtaaaaatgttccaggggtatgaatagtgtgtttgcaccccttaaccccatgttagcccatgcaacctcatttttatctgtcagaaactcagggaggagggttgttcataatttattaataactgcttctattgttaaacttgacaaacatttgtttaggacattaatcttgaaagtatctgtgatctagtaacaaggtaaacagaaacacctctgtctattgaactcttctggtgtgtatgtcacagagccccaggagaggtaactcctcaccctctttgtatgagtgacaaaactgatggatggaagccttgtcacctcttgagacaggggaaagagaggccaagagcgcgaagctaggtgttttgaacaaatgagggagtgggtgattaccaagcttggcttcacccattctctctgtctctgtctctgtctctgtctctgtctctgtctctctctctctctctctctctctctctctcgtgctcaccccatttgagtaacccagagaatattcacacactgcacccccttctttccctagatgtggtcacattcttggaatgtaccaggccaaggcacactacccccatcccccatgcccttcgaaagccttggttcataggacaggagaactttccatcagcttatttagacagagcatgcctctcaccagccctggtgagctttgttgcatctcaggaaaggcagtggggtggggagcagctttcatttctaaggtgcatatagggaaagctctataaaacaaagaaaaaaaaagattccacgaaaacacacgaaaaagaggcattcactcttaaagagagctcccagtctggctcatcctctgaggcaaagaatctgattccaaagaccaccagccacacagcactccatagccaagcacttcagcctgtaaatgcctgaggacattctggagtcagaactccagattcacatcaagcccgaggctgccaccttttctcctaatggtgccaacacaccccttgcttgtaaaacactacgtgccaggctagcaggctgtctcagattgggcaagataagaaggcagaggctttgggggtaagcagacacactgaaaaactgggttaagaggccccgcttttcacgtccagggtgttggcagctttgggccatgacagagattgcccagttgctgatttgatcttttttgttcctcattcgctcctcattataaggggagctgctgtccccactttagagaagtggaaactaaggtccatagaagttacatattttcctgacacatttatgttgtagtggcactagtgggaatgcccaagccacttctagggtcaaaccccaacctcttattccccctgtcacaacgatggcatagaggaatctctgtgctctttccaaagttcaccagggaagggaatatgttactggggttctgggataaagtgtcaggagggaggccgatttgggagcaatatggggttcagatgcctccaaaccttctacacatgccccacctgaggtctctgaatcaggaggatggcaccctgcttcaagaacccacagacgtgcccaccagtttcatcttacagcctgtgggcttttcatccgtgcccagaactcatctcctagctctggtatccagctcttatctttccccagagtggacactgaggatcaaatgggacaagaggggaacgaaaactgtcaagtgctgagactgtgtagatgcacggttgtgttctccctactacgggtacgtggtactcatcccacccaagtgctgtgagtgaatgccactttaaaatgcaacttctctaacgctccaaaaggggaaaatccacaggtgagaatcaacgaggtaaaagggtaagagttaaagtaagacatttcctccaaagaaaggcagagacaaaactttaccaaaagttccctgagttcctctgactattgacagatccataccaaatacatgaccgcaggagggcaagcacagaataatcgggccgcatctgatcacaccgggcttggaaattaaacaaaagttttatagttacaaacccacatcttactgggtaccgggaatgccaggagcacaccagaaagatcctgggtgatgggatcaacagactcaccttttccaggtcgggaaaagcaaagtctctgggtgcaccagctccgtgaagaagtacctgggttaagccacaacgagttcccaagcgcgcggtccctagcgtcttcccagccactgtctgtgcccaccagaggctagggtgtgtgtctgcgcgcgggagagacgcgtgacagtaggcaggctgtggccggagcagccagctttggcaggcttatatagggagctccttcctctgtaatgggacgcctcgcctccagacatcctttcccacttttttttttttcagttggtgagttaaaggcacagccctcccagcggaacagggttagctcatgaaagacgcactcactccaggcgcgccgccagctaacggaccatttgcatacaatttatagtgaagaaaaaaaaaagtaggaatttcagctccctccgcccccgcagagtagttgttagtgaagtgtgatttttgcattgctccacaaatgagtattctaattgtgaaacagaagccttgggaactgggatatgagggaactggatcctggcgctgctcctggactagagcaagctggaaacacgacctgggttccctcaggctctgggcagcagctgcggggtggcacctcggagaaagcctgagggctgaacctgagttcctggaaagaggagatcgaggagagttgagcaagcccggggcagttcaggtttctcttggccagcttggagataacccaagattagttctcagcaggtgggaaccatactgggagcttagaaaagtgagcttttctgaagcaggacccagcggtgcccagctgcctggaggaatctttatccagatcccaatgtcccctcaggagtcactttttgacattgtttatgccacatactaagtgctttctacttagtagggtctactaagtagggtgtagtacttagctcagggtgtactcctgagctctcagtgtacctaggtgctgagtgaagacttttttttttttttcttagagaagcactaatatatttcaaaaggtaacactatttaggttgaagtcctcatttagcatgttaaagtatccccaaggcacctggggccaagctcagctcacggtacttctgggcttgtttgggacagtgcttataccctgcaatttagagaagcagtttaatgccatcaaggaattgtgcctgggaagcacttagaattcatggctccatgacacattggtgaccagaaacagtgagtgatgcttaagtaggaaactgtcacccatgacaacagacacagctgctttgctggactgtggaaaatgcatctctttgttctgtaatttagaagagacttctgatgttttaattaacaactattatcggaaatttcaaccatccacttactgattgataccatccttcagcctttctcataacatttagtttcaatctccctgggagaataaagcaagacaaaattaggctatccctagggtggcaccgattccaggactcgaagactgcctgcttaagtgttccctatcccccccccccccacacacacacacacacacaccgctcagacatcaggaacagccataaatagtcatgtcgtaaaacgactcatttgaacttttaaaccatttgggctgattcagatgttggttgctttgggaattttttcattctgcgtgttagccaaaacatatttcagtggcacaagcctgtctttccaccagtagtgaatgcttccacgcctctaggctttcctaagcagacccaggctacctcttctcagttagcagagaaagtgttagacatgtctttactccatgtgtcctatgagctatgtttatatacaataaatatataatcaatttatttgtaaccattttcttatgtctgaacaaggtaagctgagagagtctgctaaaagccgtgtgattaatagggcttctaagaatgttccagacttgacatccctggtccccaacaattcttagtgttctatagtcaatcatgaattcacagctaccacaaactgcttaacctattactggaaagcgaagtcagatgggaggccctgaggatggtgatcctgacacataagactataaccatcagtggtcacagaaatgtgtcacatgacacctgagatctatctttttttccattaatttatttattcactccacatcccagtatccagcctccctctcctcccagtgcctgccctacagctctttcccccatttcccccatcccttttacctgggaagggggccaggccctaggtgtcaccccaccctgacatagcaaatctctctgcaggtgaattttctcccacggaggccagacaaggtggcccagctagaggagtgggatccacagacaagaaacagattcagagacagcccctgctccagttgtgaggaggtggggggccacgtgaagaccaagctgcacatctgctacatatatgtgaggagcctcggcctagcccatgctatccccttggctggaggttcagcctctgctgtactgcaatctacttgtaaaatgaatgttcagcaggttatggaggctcatcctgtcgtgatcatggcatttgagaggttcaagcctgggagtcagcatgagtctgggccagcctagactgaaaccttctctagaagacaaacaaacagaaccaaccaaccaaaacctccaagaacaaacaagagaccctttcactaacaaaaaaagttttctcccaaagtgctgagaaacatcataattctagctatacttcagccttacagtgaggaggactgctcagactagacactgttctgtccccctggactctttatactttacatagagtaataatactgagtgattgcatttgttgtgctgtttccatagtgcacataatactgtgataatcagtcttctaatgccttgcctacccttgccctccatacccctgactgtcctgctccatttgcttgtttctcgctcctaatttgcatatgtaagagaaacgtgcagtgcttgtcttcctgcatgagtttagcttatttgacttagcaaggtgatctccagttctgtttatttttctgcaaatggcgtagctgtatttttctttatggctgaataaaacttctctgggtgtatctagtgccttctcttcctcctcctcctcctcctctcgtctgcagatgacaggtagatggattgtgagtggtgccatgatcaatgtggctactccagaatctccacagtaaactgactccgatatttcaggctaactgccatagccctagtttcaacctattgaacttcctccacagagattttcatagttattgggtgaattgaattcacattcccattagcagcaaaagacacccttgccaataactgttggttggactttgttttcttcaggacagcttttctgactggggtcagatggatccttctagcagtttggatgtttgtttccctgatcgagaagtagcctaagcagttcccatgtatttattgctagttatttaatcttttgggaactgtccatttagctcttttgcccatatgctgaatgaatttgctcttttggatttttaaaaaaatatttttatataccatggatattaattcctataagatgaataaatagtgaggattttctcccttgccacaggttgtttattcccttgggcaactaacacttctatttgctatgcaggagttcctcatggtcatctaatggccactgaattcctttcagagcttccattctgtgcaggtaggtctgtgtagatcacgtgctcctcaagacataagcctttacttgtgctgaaattaacttaatccctttatttccacctctcaccaccatttgccatctgattctgatccagcttcacttggaaatttccctatatatttatttaattaaaaatgcttccactccaggtgtggtatctcattcctttgaccctagcactcaggaggcagaagcatgccagcctttgtgagttagaagctcatctacatagcaagttccaggccggtttgggctatgcaataagacgttatctatcttagttacttcccaattcatttaataaaacacaatggctaaatggaataaagggttgatttcgttttacaattgtcaggtcacactcttatcactgaggaaagtcaaggcagaaattcaaggtagaagcttagaggtaggacttgaagcagaggccatgggtgaacactactggtttactttccatggcttgctcagcctgccttttaattctcttttattcttccctcgtttattaatccccaatcacagttacccctccttctactcctcccagcccctcccccacctcctatctctcctcgatccactcctctattttccttcatataaaagaacaggcaggcctcctagggctatccaccaaacacggcccaataaattacagtaagcctaggtacaaaccctcatgtcaagacttgacaagcaacctagaaggaggaaaggggtcccgagtgcagacaaacaagtcaaaaccaccctcaactctcactcttgggagttccacaagaacaccaagctactcaaccataaggcatatgcagagaacctagctcagacttgtacggggtctgtgtttgttccttcagttcctgtgagtacctatgaatcctgtttagttgattcttttctcatggcatccttttttacccctctggttcttacaatccttcctctctgtcttctgctgggttcctctggctctgtctagtgtttggctgtgggtttctgcatctgcccccatcagttgctggctgatacccctctgatatttccctcaacccaagaatggataaagagaatgtggtacgctgttaaaaacaatgacatcatgaaatttataggcaagtgaatggaactagaaaatattatcctgagtgaggtaaccctaactcaaaaaggaaaatatggtatgtattcatgcataagtggacattagcttttaaataaaagataatcataccacaattctcagacccaggcaggctaaacaacaagaatagctcaaggggagacacatggatctccctgggaaaaagaaatggaattgattttgcaggtagactgggaataggccatgatgggaacaggaaggatcaggctgagggtgaggtggataggagggatggagggagagtattgggaaagatgactggaatttgggggcatttgggtggtgatgttgaaacctactgcagtggaaactccctagaatctgtgagagtgatgctagtgaagcccctaataatggggcataaagagagtgaactggccatcttccataaccaggcaaggctcttagtcttcatcagtgcctagtagcctgctttcttattctacctttcatttctttctttattcattttacctccctattgcagcttcccctctcctctcagtgtaccacccacacagcccctccctccatccccctccccttctcctctgagaagggggattcccctctccctctcatatcaacccaccctggcacatcaagtcactgcaggactaggggcatcctctcccactgaggccagacaaggtagcccagtgaaaggatccaaaggcaggatccaaaggcagtaacctgcttttttttgcacccagcacacaggagtagcactgcctccagtggtatgggtcttcccacatcaataattaagagaatatctcaaagatttgtctatagacccatctcatggaggcattttctcgattaagattctttcctcctagatatgtgtaggtttatgtcaagaaatgataactaactgctctgaaacagacaaaatatacataacaacaaaaatgcttccacacacatagctcagttctgtcagcataggcaccactttcacatgctgtagttctacatgtgtatgtccactattcccctcagaccctcagcttcctctgggtctgtgaccagggctttctccctgtgtctagtaaacagacttggacattacagaagctcagaaagtagttgttgaatatatgatgtgatggagggatacatgaatatttgacatactatgttttataattagtcttttgttctagctacagaacataagggggaactgtattataatgtcaaacacattcgttgtacacatgaagaaaggggacttagcaaggagaaatgactagccataggccactatggctgcagcccatcgtcattttagtcagaaccgagcctccaaaatctaccagtcattaaggcagaggacacttatggaaattaatagccactaatcttctgatttggcaaggataccttttggcatctgatcttgcatgggtatatccttttcagtactgtgagaatttcttttccatgtgagagggtagagagaaggcttgtaaacaccacctctgcacatcaatacctgccaaggactgactttgttcttgcttgctcttctcattcatgagttgctggtggagcctgtggttggaggccaaagggagtatggaggattgcctcaggtgagatccctctcattttcttaatggtctattacatttttttccagatggactagacagtgagtagaatattggccaggactagtttacttgaggaaatcaagtgatcacctcctgtgaggatctctggcttccaactctggtaaagttcccctctgctgcccctagccctgtccacattctagactcaagtggattatgatgaacggttatggagtctgagtatggtgatttagcatgccaaaactcacctcaaagtctcatgcaactcttcagtggccagaagtcttctcaaacaattggataaagcttagatccaatgcagactgtcagttattcaattaaaatcatcgcttaatataaactttccccatcttatctacacatcatcttcattggcttctctatttcacctcttttcactctcccacacaacaaaggaaactaccaaccaatcatcaaaaattcaaaactcaaagatgttcctgaatgggaagcaagacagatgggtgcttggctgaaagaaaaggttaggtcaggtacacaagtaaccaagatgtcagttgtggggttgaacagcatgaaaagaacttggcttggtattgagttctagttccaggggtgttttattgactgtgtgactttgggaatgtcctttgcaccaactagctttctatgccttggtatcaaatgggcacttgctaaggacattagaagctcaaatattttaagttaaaatttaaagaaataatttagaagcctgagcacttttgtccatccaatttgctaggtggaacaatgttttacctttatgataaattatattttaagttttattttgtagtgtttctttcttctgagactgtttccagagctcttgcacccagataggaggactcctcctctacactcatttacactaccatttttctttgttagcacattatgcgtgtagtctctcctttggctccttgctctactaaaccacagacacctgacaggcactgggtcttgatgtctgtttattggcagggatgtttataactagcatctgtttatggccaatgtcttgatatttattaataatttgttaataattttgtatatcattcatgtttagagtagcatatatatatattttggagataaatgacaaaaccattgtttaaattcttttgttgatgcttacaatgctgaatattatcactgatttccttgtccgttttctcagccattctgtgacagcaccttgaaggcaggtagcattttcctactgtacatgcccaaaccacaggaagtccattcatgtttccacaaaaatgactggcacacccattggctggcttcatgataacaactatggtaaagacataagtttggcaagtcagtcttgggttccattcagcttgaatatttagaaggtaactcatcttaaagaaaaacatgttccctctgtcaagcactctttttttttttttaaacaattttttaattagatattttcttcatttacatttcaaatgctatcccaaaagtcccatatacactccccccaccctgctccccaattcattcactcctgcttcctggccctgacattcccttgtaatggggcatataatctttgcaagaccaagggcttctcctcccaatgatggccgacgaggccatcttctgctacatatgcagctagagacacaagctctggggttactggttagttcatattgctgttcctcctataggtttgcagaccgattcagctccttgggtgctttctctagctcctacatgggggcactgtgttccattgaagagctgactgtgagtatccacttctaaatttgccaggcactggcatagcctcacaagagacagtcaagcactctttcttttttctttctttatctctgtctctgtctctctctctctctctttttagatgacaacataaatttattatcttacaattctctcaagtagaaatctgaagtcaagatgttcatagggtctttttttttaattagatttttaaatttacatttcaaatgtttcccgtttttccttttcttttttccttatttgtatttggaaaacataatcttggtcccacattctagtaatgtgcatatttaaatatgaaagattaataaataacaagaaaatgaaatatacatattttcttttcagagaggctacaaagatctgctgcttggcaaattcgtagtaatcactcgtaatcactctttttacacagatttcatgaattacctctattgtttactacacatatacaacacacacacacacacacacacacacacacacacacactcatggaatttaccaaaggcaagaaaaaatgaatgcctccctgcagggatgttcaatgttattctgagagattaatatctgagagaaatattatgaattgccttcaaaaactaaaactccctttgcctgccctccaacagcaacagaactagcagagattcaagatcaagatcactgctctttcattgttttctaagtaggatgatttcccccattcagagtcagctgatttcacctaacccagaaagagaattgccctcagcaggacctggggcttggtggactagcctcaaaaaatcacctcttaaatcacctcttttccctgtggggagcatcctaggctggttctctgttcccactaagcatccttacctgttccccacctgctatggtctgaagatgctttcttcactcctgtcctcaaactcatgttgaaatctgattgtactgtgccagtgttggcaggtgtttgggacatgggggttaagacttcataaattgattcaagtgtttgtttgtttgtttgttttgttttgttttgttgttttgctttgtttttttaacatggtgataggtgagccattgggagaggtcagcctttcccctttcccagggctacttggccccctgcctttcactttgttggaagtatcacaatcacaaagctctaacaagaaaaaacaagttcttaatcttttcagcctgtggaatcacaagtcaaagtaagtgccctttctaggttacccagtctcatatttgttatagcaatgaaataggttaagatgtcaccttccaccctagtgctagatgatttgtggcaaacaaatccccttcagtttgtattacataactttgctgtgatctcagctttcacatgggaagtcctctatgttataagtgacttcttccctaaagtgggaataagtcaacccatttggttaaagttgcccagcctgtggtttaactggaagctctccatgtgggaattaccactgaagcatctatctgtaaggaatgtattttttattaattttgtgggttcaatatatattaaaagtatactttaatggtttgcctggattgtcattttgataggactggtgaagggtttttgatttgtctgtggggagctgctttagaaaggagtaatagctaagaaagtgatgggtggataaagaccaattctgaatgtgtgaggttggtgggtctgcatgggaaaaaagtacgaagaaaaaaagcagtctctctctctctctctctctctctctctctctctgtgtgtgtgtgtgtgtgtatgtgtgtatacaccagttttttatagcacatgtatgtatggctgccattattgtcctctgatgttagacgattaaagtcccaacttctttgtcctgttaacatggagtgcaacatcatcaactctccacagagcttcccggctttcagcttggactgagcagcccctacattcgctgcttctccagtggccactgggaaaaatcttgttattattattttttttttgtgtaagccaatccaaaaataattcttgttttatcatatatacaactactcccttggttctctacttgtaattggtaatgcactcactgtttgagatgagtcagacttacattgctgtcatctttgtgtcttagtattgggtagcccctttcaagccccctcattttgtttctatctctgtaacaatagagtgaaaatatttatgtcacagggttaacagcatgcccactggagaaaagctaaccatttttgcaagtgcacttctgcacagttgtggaggatgctgtctaggggaaaaagccttgccctaaatgtatgtgttgtcattaaatggactaatagcctgaatagaagatggtggatgtctgcatactaacccatgagacctgtgagtatgtctttgcatgacaaaggatagtgtgtagttgtagaagagtgagggatcttgagaattgaaaattgccctggatgtaattgcatgtgtctcattagaggaagtcatggtgggtattgactacatgagagaaaaatatgatacggccagggtatataactatatagcattgtggcgacaggctaggtcatgccagtgatcaccagaagtggcaagagagattctctatggagtctctagaaagactttagtcctattaatattttgaagttaattaattaaactcacttcatgctcagtgattcatagttgcaagagaatacatttcattagtgctaattcactaactctgggaataatttgataaaacatgaatagaaatgaatctaaggatagtatctctgaggtattatttctatattctgcacagcagggttttacaattttttgggttttgattaaatgagattatctgtgagagatggtgttagtctcctttgaaatttggaatggcatttctacattcttttattgcgtctcctttaacctaatttcatggggtgggtcggaggacagagaagaacagaagctttgcctgggaattgcaaccttcaccctcagcctgacagtttttgccgtcagtccgttgatgtgggagctttgcagtgttgagtgatttaggccagaaaggaagatgaaatctggtctgacacatttcttccttatcatcccaggggcagcctgacgccaggaagtgtcgggctttatctgcatggctgctcatcgataactctaaggattcgtccacagtacactttgtcaaactgaaaagctaagagaggattatgctcaagccagagataagaaagtgaggcacagagctttgtctgcatgtcccacccactgtgggacagcctaggcctgcgtccatgtgtgcttattctgactcagcatcctatgtggggaaaggacctagtctagattttcataagagctatacaaactctgccatagattgcttctaaactcttttcgcacatctggttgcttctacgtggacagggtaaacattaagagggatctgagaggagcgagtggaatgatgccagactctctgttcctttagaacttctgaaaacagcccacaggtctgatctttctctccagtttctctctagtttccactgagatcagcaatcatggcagatgtggctgtggtatctggggactggagatctgcttagggagacccccccagtaagcttttcagaaaccatcatgcagagcagcctccatccaaggagtttaaagactttccagatcctcaggatcacctgtctaggccagggtcggacttgacttatggttgaacagtacatgggagtgctccgaagtggggatagaaagatgactcaccgtttgagacagatgatagaagcttctcttagtagaaacgctttataaggaaatgacagcaaagcctcgataatccctgtggaaaggcagggataggggccaggatgaatcagggagacagctgcatgctaagagcaactgaagggggcttgctttgaagtggattccatcaggggctcatttaagtggaaaacattgccaggcgagacttgctgagagcctggtgtagagtgctggagtcagtagtcaatgattgcttttgatgccatggggatgctttggttcttttgaaagctgtgatcttattgacatctttctaataagtatcccataataaattgcccttgagcagtatatttgacccataagaacatagttaaacatgggacattctgatctatatttacaaatcggtgacaaagatagttcacagttggactctgactaagttttaagacttttcccactgtctgtcttgtcatggaagacatgaagggcattgaggtgccccagctcatactgttttgataaccgtggctaattgactgtattctctggtgcccaacctgcctgcagaaagcaggaagaacaggaaggtgactgaactggttcaggtaagggcttccatggtctgtaagtaaaggcttggttctcagtgtggcagtgttggttgatgctatggatctttaaggcatagagtcttatataatttctttaggttgctggggagtatgccctcaaaaggaattggactctctggcttctatctatgtttcctacctaaaatataagcattctctctctgtcacacatttctatcatcttatccaccttgggtatacgtccaaaccaatgagattgttagccttgggctcaaacttctataaatattaatcaagataaatatctttttgtattatgaatagtctgtgtcaggactgtatcaaggagattttaaaaggtgatatgaacattataggatatacattgaccataggaagccagggcgatgagcttggaggaagaggaaggaggtgtggtgtctttggaccaagcagtaggaaatgtgtaaggataatgtctttatggagggacttaaactccagctgcatgtgtagcagaggatggccttgtgggacatcaatgagaggagaggcctttggtcctgtgaaggctccatgccctagtatagggaaatgccaggacagggaagcaggagtgggtggattagtgaacagggagagaggggatgggatagggagtttttggagggcaaatgaggaaaggggataacatttgaaatgtaaataaagaaaatatctaataataataatttaaaaagtaattaaaaaaagaaagagactttcacaaggaaaagtagtttttcttcatcatttcttatattctgtttttagttatcatttgttatatgttggttttatctttaggactttatttttacaaaactaatttaatattcatagcaaatttatgaataagcattgttacaattttaaatggacacctgaggaagagaagttacttgagcaaaagtaataaccgtagctggtgtcagaggtgtggttaggacccaagatcctattagttttgtgccagattttattttttatggctttgtaaatgttattatatatgtttccattttattaattacaacacacacacacacatgcacacacatacacacacacacacacacacacacacacacacacacacacagcgagggataccaggagaggacacaataatactttttctgattctttttttttttcacttacttgcttgttcagtctatacacacaggtcccagtaaatgttgagaacacagctgcaggcagggcagacacaatctcttttcttccaggacatttctcatcaaggggtgaatttgatcctcagtgatatttaatgatgcttatggatattttagctgccacaattttgagttgctattagcatcaagtggacaaaagtcagggactctgctgaaagtttgcagtgtacaggatgatatctcatgaaaaagaactatctggcacaaaaatgagattagttccaaatttgaataatgctgatctagcaaacagagagataaagatcgtgacaattatcagatagttcatatcgggatgacctgaagttaatatcatattgtaacatacagtatcatgggcaaaatttaagcatagactttccatgagacattatggcatgagaaactgtaggattttgtgaaatgtggaacaaatactaccttcttgcaatatcaagtaccatgatagatgaatagtttattattattattatttttcagtgtgaaatgcatcctgacattcccaggccttgctgcactcctagcatcagagttgggcatagaggaaatagaactgcttgattctagattcaaaagccaggcaatgaggattcttgacatggcaaaggaagaagaaggcagcaaatgagtcccaaatttcctggaccgtctgagattcttgggttcccaaataaaccatcagacaagaggaacaactcacaacacaaatgaaagtgaattcactgtgcatcacttagaaggaaactctgaaaaatggcacgatgagggaagcaaagaatctagatccatcttgtccttagtgttggaaagaatccgtgacagggctacatgcagaacattcctaactacagctagacggcagtaacaatagctagcttccctcttctttcctgtggagaacaatgacagatgaaatagtagctcttcctgtttttggagatgttcctggtggtggggagatgatgtccacaggtgtaccaaactttccagcccttaagcattctattctggacttcatttactgaccatttcctctgtgtatcagagtttcccttcaccaatagtgctgagatcagtggaaaggaatttgtcatagatactcttgaggactttactactactcgctgccccaagtaagccaatacaaacagttgaaattttattttggtaaataagattattgctcttatattccccctttaaaaatcattctttaaaaatttactgaatgtatatggatgctctgcctccttgtatatatgtgtgtcacatgcatgtctagggtaccagtcagaaaagggcattggatgttgtagggctggacttacagatggttgtgagcaatggtgtgagtgctggaattgaacctgggtccttttgaagattagccactgctattaactactgaaccatctttccagctacaatctttaagtcttcaaagacccaggaagctttaagtagaatcttgaacatctcacaactctgaacaaccaccctgtaggtatttgttgtatgtacgagtgattgagagtgataaatcttcaggtactagttagatatggaaatatggctcatagttctttttaaaagcatcacatttaatttaatagagaattattgattagttgtgagttttttttcaaggatagcataaacaattccatttcctcccattggttcctgttcgtcagaagtggtctggatagatttggtagcagttagaatttatgagtcatgagacatgagaagaataattttgtctaagatctaacttagtggacaggtaccccttaaggcatcaatgtttttaattttacaaaaacttattggagtcagacatgtatcataccttgagtacatgtaataaaatgaaattatagggattgataagtgagccatttagctatgaagaagtttattaccatagaaatggtgacacaaaacaatgtgataggtgcaatagtgaaaataatccttagaggctgagaggagtatagaacaatagagaatctaattttttttctttgcttaaatggtttactatctggaagctcactatattgggtgagaatgggggaagagagagtgtaaaaacactttttaaaaatattaacagcatactttagctgagccaggaaccacagaagacttgtcacattagaagaggtagggtctcttattcatagaacttcagactcagaaatgacacgactgtgaaacagatacagaagcacacacacacacacacacacacacacacacacacatatacatagctacataagcacacatgtgattgcagaatgatgaatgtaattagaggagtgctgctatttgaatgtagactagccctatcccacatggactcacgtgtatgaacactttcttggtccccagttggtgctgggtcttgaggtagggtccagttggagaaggtgagtcactgtggtggaccctgaaatcttttgcctggctccactttctgtgtgttctctgcttcctgactgcagacacaatgtggtcagcaacatcttcctcctgctgacatgccttccctgccatgatagtctgaatctatagaactgggaggcacgagaaaccctttctgagtttgtttctggttaggcattaggtcacagccgtgaggaaagtatctaagagaaaaggccaagtcagcatggaacacttcatgttaattctcaggacctggttttagttattccagtcaaccctaagaagcggagctttaaatctacagttcgctgaggaattaacggaaactcctcactataaattgccttttcagtgttatacaacagggagagtggtaggctggggattagaacccagggttgtccaaagccaagtctatactgtcaagctcaataaatctgtgtgctgaatttcatggtacacagttctcctacccccatgcaggggaagcttaaattactagaaacacttgttttaaagtatgcttttttttatccatccaatatgtgtcactcacacaggggttaattttgtgctatctcatgttgattcataagtgtgggttaatcctgtctagatgagagcttagaaagcccgatttgcacactgaagcccatccacttcaattgaagatgatattaaatgccaaagtccttggtaaaatacttagttgaataagctttgctatttttattgcattggttatggacaccaaagtaaaaggctaagagaacccagtggctcagaattctgccacttgaatcatgaagatcaggtttcatgtttatttgtattttatttatcttgtttatttgtggggtgtgtgtacacgtgcatgtgcgcacatgcacatacatgcatgtacagaggccagaggaggataatggatgggcagttctcaatactcttccttattctcttgaatcaggttctcattgaacctggacctatgtcagtggccagcaagatcatctctgcccctcatcacactggggttgcaggtacttctagccatgcccaacactttatgtgggcacttggggattcaaactcaggtcctcatacaaacagagcaaactgccttacctgaaaagctatctccacaggtctaagatcagaatccaagttaaagctcagacacttatcagctgtatgtcctgggcaagaatgtcgatcagctgagccccagtcttcatgtatgaagtagagataagtgtgcagtccctcctgctgtggtctgaggagcactgtccacattgcctctggctttgttcttctttaactagtgccatttgacccacaaatcaaagtcactcagctaggtttattgagataggatcttactatgtgcattatagactagccaggaacttgctatggaaagcaggctgacatcaaacattttggcactcttcttgcctcagtttccccagggctgagattccaggaactaccttgtctgccctgcccctgctctgttttttaatttatgtctaaaatagtataagaaactgtagactcactgtgtcttcaaaatttcccctgatcttttgataagaaggtattctaatttgtcccactctggggattcttaactggctatgatttttatcacccacacaaggagaactcagagtgaactggaaatgttttaatctgtaataggtaggagtgaacagaggtgccactaccaaatagaatggatggatcagagttgctgatgtccacctacaattaacagaacagcctcattcactttcccagctgaaaaaaaaaagttcatagtgccaagatcttgcaaccctggcctatactctctgtcatgacataatgtgcacttgcatgtacaccatgcatgtatggatgtgcacctacacgaatgaccttcacatccacatgcacataggtacactttcagttctcggcttccaagaaaggagcagcgtacagagattagagcaggactgagtgccaggatgatgtcatgctggggagacccacgcctgctgtggcgagacattctctgtccaaagatctcgccatttccgtgcagacccctcacctcaccaccaccgcctcctcatatcctgctcaggtccctcctgggagctcagggagacctcggagcagatggagtttcacttagtcactctccctacagccagatcgggttacatggccaagggctctggtgctgagctgctcactttgactggagtgatctgggttggctctttaccttccaggatgtggattggccactgggcaaggcttgtttgtagttttctatcctaaggaaagaggctgagaaacacgcaaagcaaaaaggatgcctagatcctgtgttgagagcagagcctggagttcatgcttctttgttcttatcgctagaggtaatgaatattcagcaactttctaaatgaagtatacaaatgatagcaatctccatggagtcgtatggcatgtgtatcttaatgctttttgcgacaagagaatatcagggtcttgatagcttttggaaaaaagattttttttttttaaaaaacttttggcggttacagagttcaagatctaaatgctgatagagggtctgttgaggaccccatttcctggttcacacaatcacctcttcacttgctttcacagtggccaaaggagccaatacattccttgaggcttcaatgacaggggttctaatcccattcacaaaagacctgccctcatgacctagtcaccactcacgtgccccacattctgatagcacactggagatgatgttttcagatatacattcagaaggggacaacagaaatgtaatttaatgtggtttatacaggctaacactggatcttaaaactctgagcagctataatacatctagtattgcatctcttctgcaacccacaagcagcagctatagactgctaaaattccagagtcgatatcatggcagtccagtgaagtaggcttaactaaggagagggtagcttccagtagaagaactagctttccagcttgagtctcactcccttccagatctagtttttaatacttcataagatgcctcttacaaggtcgtttccttcttttctgctgaggagagaactaatctgtagaaaacataaataaccccagagctcccagctgcaggcatgctactacccctctgtgagtcctcttggcatctaactttagcaaatacaagttagtttcaaaggtcttccatggcacctaagtatctgtacatgactgcctgattacatacccgaggctgtcactttctgcttatggttctaaagctaggtaccaggaacctacactagctgtaattactcttcacaatcttggttaagcgtgtaaaatgggataactctctaataatccagaagaagtcctagagccaagagagataggaggtaggagtcacccaaactgaccctccgctgtgacaaggattatctggtttacctctgtataagttgcagaaatgctcaaagcaaaaacagtttgggaaggatgccctggagggcgttctagagtgtccaaagacaggcaggcatgggagaaaatcaggagccgtgttcagaactcaggtgacacagaagcttatgacatttcatagggagtaacttgcattcatgcggcattttgaaccttctccagatgacaatgtcatattgggaaattttcagagagcattgctttgtgtaactacccatagttgggcctgatgagaaattgttgcccttttgtagtgattttggcatcattggtgacatcttttaccaatatgtaaaagaattccactaccatcttcttctcaaagttgtactccacatatgatctctgctaccagttctaatcttcagcagctacagtgaatgccaaatgggcactgaaaacttctcagccattctctcattggccaaggactctccagtacaactatgtctttccttcttctatccccaaggagactgatgactgtctctaattttcagagaagtttggattgtggcattgttgttctttgaaggcttggtgccctctacctattagtttctgagagcagtgacggggatgggaaaatgatgcagcgggcactagaacggcagttgctcctttgtaatctatttttggctaggaagcagagccacatggaagagatttgataatgttaacaaatgacacagtaacagtgagtggagccaggaagtgcttctttccacactccagtgatgcattttagtagtttacaattctgggaagaaagccttctcgtgctgtctgaaatgcaacctccccttccggtgtgcaacctaaccgtcacctgctctttaaatcattcctcaatcttcgactccaaatgctttatttgtagttctactccttgattaccccactgtgcctggatcctatataatagcttccatatgcatcctctcatgtgattataaaaatgagtagaaaaacttttattacaagcttttatgtgtcaggtactgagataattgttttatatgttggaattcactgaatcttctttaaaagacaatgaacagatgttaatggccccatattaaaattgagtcaatggcagattgtaggttttgagcacctggaggaccaaaaaaagtctctttcttgtcttatgttctaccaattacagtaggaatagggtaactttcactgaaatcttttgcttcctttttttctttttttctggctcaagtagtacactatccatccaagttttattttataatagaaaaatgtactagaaaaatttagcaatggtgtatgtatcctaggaatcagaaatttaaatataccgggttcttgttctcagcatgtatcccaatataaggaatgtacatttttctgtgtatcactatgatagaattttgctgatgttatagaatattccagggttgtatttgcaagacattgctcccaaatagatgtgtgtcattgtgtgggcacatctaaggcatctgggctattccactttctgcctccatttctctcctcttttgacatttagagaacatgatagagcttttcttgatggcacagcttatgaaacacagccttttcatgtgaaaatctaactcttccttttcggaacaaaaggaaaacatgagaatggtttctattctatagtcttttgcctacactactggaagaatttccctcaaggaaacactatctaaactcttcttttccacagtttagaatacagtcctttattttggaaagttgaatatgaaaaattcaactttttcatctatggttaggatgcctgcttagatgtttaaagatttcagggagcatttgttagtccttatgagttagaggcattgatttttctgctgaaaggaatgtgatcccagtggtgttgtgaagacatctttatcatttttcaggagaggaaaactgagtgggcctagtgagttagtagcaatggtaaaattcattgaactttggtttttaccattctgcaaatgaattctgcatcttttagagaagtatataatagtcactcaacagtaataatgagatttatatatttatatttacttaatgcacaccctcctattatgtgctatgtgttgaacattgtgctcagaagtgagggacttagatgaaccatggtgccaatggctcagaagagaagatagacaagcacacatgacagttgtaaactaatgtgataagtattatgacaaagaaaatagagtgtgtaggaaccagtggtggcttaaatgtgggaagatattgttagagaagcataaacttaagcataatttagtgtcaaagagaagaaagcaaataatgcccaaagtccaaggaacattctgcattggagtcatgaccttggattatagaggagtgttggagctctcactggtgatacacactaccctggcaggtggcatgggaaggatcatgaactctttgctaggaatagattaagacaccattccaaggtgtcagcatcatgaataagggtagcttcatgctttagaaaaatcattctacctgcaatggatgcagtggaacagaatgaaaagtaagggtgagcttaaaatcaaggacactgatgcgggccactgtagtctctcatgaatgttggcttgcggcagggtagaagttttgagaatgttctctgtgaggttataattgtgatgccattcactaagatgagtggagggtataaagaaaaagtgaaggtacttcagtagtctcaactgaggagtagatccctattcctggcccaagggctcctctgtgggtctggctacagagaaagaccatgttggcacttcattcttctctagatgggacttgtgggctcctatacatagtccacttttacttgagattgagacacatgtagacaaggtctaggagctgtctacccacacttttgatttgaattgatttggtttgatttaatttaattcttgagttcaagaaggatgatagtaatcacactagctacagagagacagaattgtggctaaaaacatgctgtctggtttgctctggttaatcaattattgaattctcttcattctattttctgaacttaggtgaactactcaagccatctatgctttggtatctataaaaagtaggaagtttaattcctacttgacaaattgcttggaaaacaccaattgtatacacttttatgtaaaggagcagatatctgaaaaatattgattaaaagtgaatattttgtgcctattttgattaatttcttcctctttaaaatatatggtcttcatggatgtttgtactttgtgaattcatagacctattcttctgaggaggttaatccatttgtagctagtgctagtgtgttttaatcatgtcttcagtctcattaattatcatcttaaggttcttatattgttttacttattcatttttctcaaaaagtcaaattcaaattataaatggctgggcaaaggttttgctatagtccaaatgtctatctgtattccagacttggaaataattgcctgtttgatggttttgggagtttgattctttgggagatgattaggatatgagacctgaggcttcacagacagaagtagcaactcttacaaaaatggctcaagggagctgtctctttgtgtgtcccattgtggggacaaagctaagagatacaatctaagaactagaatatggaccttcactagacactgattcaactgatgccttggtcttggatttctcagcttccataatactgaaaaattattttctgctgtgtaagccatcgagcctctggtacctagtaatagcttgaatagaggacgacagctttcaagatcctttgcaatctatggtcaccttatttccttagctgtaattcctatctctacttactttgtgctgattctattgtcttcttgatccatgctagaccttttattcataaaaatctcaaaccatatatgtctctatactagaatgtattactgactttcttgcttcctaacaaagatcctgctcaagtgaactgatcaccattctctcttactgctagcaccttaatagatttttctaatgtaccacttacttcaggatatcttagtcattttttatgaaatatttttcaattttaataacccatgattagaactcaaaggtagggcctatgttttcctggtcgtggtagcttccaattccagcctagaacttaaaatggggccagtggtcagaaaagggtttcagaacgaataaacacataagtaaattctcctcaaaatgggaggaatagcaaatagatgatagttgttgtttctttttctctttgttttctcaattcttatcttcatagctattcagcaatctaaatctatctggaatgttccagaaaatgatcaacgaaggaaaggatctcttttggaactgtggaattctctgttgtattctccagaaaaactgctatagattatatatatatatatatatatatatatatatatatatatatacacacacacacacacatacacacatacacacacatacatatgtgtgtgtctgtatgtgttggtatctgagtgggatcatttgtgtgcatatactcacacacaagcacatgtgtgtgatggaggcaagagtgaaaccacaagtaccaatcctctagagcacctcccaccatttaaaaacaaatttcagaaataggatctctcactggattcttaccaagatggttaagctggcttccccagggattactgtctccatcatctctacccctaccatgccttatcactttctcatgaagattatggagatcagtctcaatcctttctactatcatgatttatttgaaaaaaaaataaataaagagaaatatatgaatatatctttcttagcaattaaaaacgttaagcttattttttccccttaagtatccctttatgtccacaggggcttgtgctaatacagcatactttcatatttgatgttctttcactgatcattttaatgtattccactgaaacaaaacatatttataagtcaatatcaatgcatctgtaatggtaagtattacattcaaatagaaaataatttcttctagactgagtcttcaaaagaattgctagttgtacccaattagctaacctactgtacatttattaatttttgataaatagcaatgaaacataaatttattttggtaatgcttctctgaataaaatgtttgggtttttaagtgtagacaatacactagaattgaatatagtgactgttattgttttatggtaattgagttctagtctttcttgtgtgtgtgtgtgtgtgtgtgtgtgtgtgtgtgtgtgtgtgtgtaagcactgaaaaacaaaatctatccacaaaaataagtcaatgggtaagaggaatctttgttaaaacaagattataatttgcttgtcatggtctgaaaatcacatggggtagatgattataaaaaccatcttctgctcatttcaaaaattaagtgggatgttatattttattaattaattttcatgaaaaatgttttctgtcagtttctacttaaaatgttttaaattaacacatatttaaatacattgatgaggtctgggacaataacttggtacatgtaaatatgtgataattaaattatggtaagctggtatttctatctcaaataggtatcatttctctgtattgtgaaccttcagggacttaatgggtacccaaatgcagctacatagggaaggttaagcagcacagcaggctggctatactctacaacaattgttacatatttcatacacatcctaatggtttctccactgatattttaattagttttcacatcattttcatagtaacaagagcttggcagtcatctgacttgcaaaataatctgttcgcaggttgtataacattcattctctttctcaaaattttaatagaggtttacattctatctttatttgtgtttttcaccccaaggcaactcaagataaatgagagagttggctttattttgtcagaggagaaaaaaaattatgaaaatatgttctaaccttacagagtgtaaatgtaaatgaagaagattctcttgaaattctctcaactgggcccacatttgagagtacatcagtacagcaccacactttgaaattttctgtggttaaattacttctcccaggaagtttgatgccctagtgtaggggaatgtcagggtaggaaggcagggccggggggtgggggggatgccctcatagaggcagggggagggagatggtatagggggtttccagaggggagacctggagaggggataatttttgaaatgtaaataaagaaaatatctaatagaagaaaaaagattacttcacccagatagacaatatacaaatagatttgtgagtagctagaagccatgttcaaatggacttacatagaccagtctctaaacttcagaaccaggttacaacactctgtattttaatgatctagatggtctttataaataagttacagtacagttgagttgaattcttggaataccaagaaatgaacttcagatctcacctaatctggagaaagaaattaagggttgttttttatgtcaacttgaattgttagtgactgcttagagttctgtgtcatgaaggatttagaggactcatgttagactgattggaaatgcagtgatcaattagttatgcctatcacgggaagctaaaaggaatgctcagtgctctccatttgttaaccttagctgcctgaaggacatgtagtccttatcatcaggacagccagggaagcattcccagtgtgagcagaaagcttgaccacaattctacagcaaaccagtggtgggatggatagaattacttttcttttgtccttcaacatttggtgtacattgtgagcttagatatttaataaacattgtaatatttgaaaatggaaaatttggggatgttttagagtttggaaggagcaaatagttttgtaaattttttttgtttgtcgtgaaaatatgaactattatttcttttgggggcatatcgactttctttgcatttgttctctgtaatatttgatgaatagaggaaatgggccatccattttatgaaactagtgaaagatggataatgctcagcatggtcttactgcctatcaaataaagggcaggaaaacccacaagacatgtaagcaactttgtacacatctgtctattgcttatacctcactctagtttaagaacacagatttagagagaagagcagacaggggcttgtgggcttcatcctttcatatatatctgtgatttccattcagtcctagaatcttgcatatctccaggggtctatgtcatactcttgtcatttcggtatcagaaaccttgagatatgcgtgaaaacacacaagtattaagcagagaagagtaagatatgcacacaaatagaatgacacactttttcaatataagtggaattccccatgcataagaaataatactatctatctcccttttatttttgtctttttatatacatctgcatgtacctcaaaatttaatttacaacatataatgttcagctatcctagacctacactatcataaatgatactgtaataaacatattccctgaactttcacctttgggcatctctgagaacttttctgaagaataaatttctagaagagggctggttgcaacaaaagaactatacacattcagtttccatggattctgccaactgggtctctgcagaggtcatgctaatttatactctttgctgtgatatatgggaatgcctgctttcccacatctggtcaacactgggtacttttcagatatgaatgaatgaagagtttggatagttctagctttgaattagacttagacttgaagtctccttcttggctatctcaatatgggtctccacaaagcattatagctggggaacagactccactcaaggctgaatgctctcactacagtgggaacagggaacttcaatctgtgccctacttggcatatatccctgacagacacagccactctagggagccagcctctctgactataagaatagtagattggaagcaaattgatcttttcacagctggccattctcctctcttcctcagcttggaccaagctcagaacaaggtcagcaatgtacttctgccacaaagcttgcattgttgaggattgccctctttggggaagacatcttattccccaagactctcctctgtagtttcaactgtgacaagcttggagacaacgtagctattcttttccaagagtctccaaagcaacacccatttttttgtccatcctgtttgataaacatgtactgttgttatgctattctcaatgtcattcaaagtttgtcagatgactcaatttaacagagtataactccttactcatctttactggaggtccatgctcagtgggtttgggactccaaagtaaagtaaaatgaataaaccaggggaaagaagcttatgcaactgtctagttgcactgtgtataagtactgttcatcccattgctcagttcattttcttcacacttgtttcactagagagacagttatttttgcttattgatcaattgcttgtctcttgtagaagacacgggctccacaatatagtgatattctttagttcatgattcatcatatgtctttagaatatctcctggtaccttggatggggttgatgtgcattgcagaatgaatgacgttgatgagcaactcctgtgttatgcaatttcaagcctgtgtacttgatgcataacctgaaataaataaatattgtattcatttatggctaagaacattgagagtcacagagcaagcagtacatctagacccattcatctgataatgggttgatctgggattttcattttggcttggtgtattccaatcttatctcatagatgaacaggactcttgattattcaaagtctaaaatattggaacattttttaaacatgaagactgatcattgacatgccaaggtaaacatgatacaaccaacagatgcatacattctgtccctagtccaaagaaacaaacctccaaattactagtatgtataacttttcatttatctggttagagtcagtatagctaagatttgtacatttgttcacatttagagctctttgaacagaataataaggaaaaatctaaaagaattttaattttatatcaagaaaaagtaggactggagactaaaatttaacatggttatgttgtgcctacagattattttacatgaataatttttcttagttcttatgacagcaatttttttcttgtactttttaatctgaagtaggaattttgaagctcagcttgatgaatccataccttagattggaacaatgtttgaatttatgccaatattgctgaagaatttctctttttcctgtcccagtgcatatgctggtcaggactgtggtctcaatgacctcataccatcacagacatggagtgtgctgcaccatggctgagagacagcctcccttacagcctagacagctcaagaactagcttggggtttggcatcacgcctggtatgagtctatcctttagttgtttctttctattgttggccaaccccccaggaaggctcgtctcttctgtgcaattcaactgaaatgagaagttaccacaaggattctggaagcccgcactccatgctgagattttttttttcttccctgagaactggctgcatagtaatgttctgcgtcagtccttccagatcccaactcaaagattcacaaacactggctcccctgagcattgggctgctggttatgatgaaatgttagcacagaagagctttctttttctattttgggtttcgaatcaggacagcatggttacaggatgatttatgcactttgagaactttaaaatgttttgttgctatgccttcccccaggcatttctcttatcacttggactcagcttgatgcctctctggaatccgcttgttcccctatcatctgtgcaacaccaaacacatgtcttcaatctgaaatcagaaaactgaaaattggaagcaattgattctagaaagatcccaaacagactgccatttgggcataataagccccaaagaggtggcatttgtagtatttggggatggaaatatccatctgtagttgcagctagttccccccctcccccgtcccatcctgactcttaaaaaatgaaaaagttagaaagcaaggaaagggtttccctaatggaattgctatttactggatgactattatgcatgccctcatttggcctatgactgctatttcctctatggtggacacagcgatggatgtgaagaaggtactggcaggtcacataaaaccccatcctcaaagagctcatggttcattgcactggttggctgaggcacgtgtcttgcacacttctctgtccgctgattgtgcttctctcttgtgtgccatcattgctggtctttttcccggttactgatgatcacctcatttcgagatctcctgtgctcctgcctgcgctcttctcccatggttaaatatgttctttacacttttaccctacacaacttccaactctttctctaactttctcatgattccagtccaaacaggacatccaatctccaagacatctccctcccacacaaaattagtactcttatgtgttcttggatgactctttgtttcatgacatttgtcatgtactactgtagccagctatacctttatccacttttttcttctgtcagcttctgaagaaaaagggtgaaataatcatgttgacagatatgtaccaaatgtatggctaatgttggctgtttaatagctattcttggcacatagaaatggtctgtccaacagacaagtaaaattaacttaaataatgtcacagggactcttcatgttatgtattttttgggacaacctctcacatagcttaggctggccttgaacttgctatggacttagcttctgaacctgtaagctagccccaatcaaatgttatccgtataagttaccttggtcattttgtctgttcatagcagtaaaaccctaatcaagacagtgggattggattgacctttgcatactatctacttgaaaatctttttgaatcacatctaaattttcaagtactccaccacacaattataggatctaccagattgaaatttccccattggccctctgattagatttggagtccatgcttcatcctgtgatcttctgggctttgtctcagactgctggatgatgttgctctcacagctgttggaagtgacccattgatgcagttggcaacagttgctcagcatctgatcagaaagaccaaatggggtgaaaaaaatggaaatcatggtgagtaagtgactgacctcattctgtaggaattctttctggaaaggcagcaagagaaagttgtgacaggcagtaagtcatctctaagaatgtttactgtggaattctagcaaaagaaaaggcttgagagacttcctggatgacacacatctttgctcagagacaccaaagcagagtactggaaaacttcagcctagagcgagaggctgtccactcctgtgttaagggcggctgaagcagcagcagcatttgagatgcccacattgctagggtggtgtttgtaagataattttctaaagcttgagttggcttggctgaaaagaccagccatgagacacatgagggaggaattctttctaagcatatgacaaggaattattattaatatcttatagggtctttcatagctggggagattttctgaagctatttaaatttaagttataggtggaaattcaactgtatgtgaccctaactcacacagttgtctttctgaagaacagggatattccatgtatacacttttctcctccattgcattatctacatctacgtgtgtagaatcctggtgcatgaagcttggaagaaattttaagcatcccactgtaataagaactgttgttgtactatttggaatggaccaagagaagcacatacaaaggctagtcccagaatagaacttggctgaaaagagtttgcaatatccccaattaggtctgtcactctgagtagataccaagttcattttactggttgatcaaaagcaaagctgtacctccatttgaagaactacaggaaaccaatagctgctgagagaggaggaacgagttttctctaggaataacctccttgatgggttattcaatctgaagtagttagcactaaatacatgtgcatcccaataacactacatggactcaatagtgtgtgtacctgtggttataaattacagttaaaaaagaagaaatcgtgaaattgagaagtaaggataacataagacaagttggagcatgggaggaagataattatgcaaactgttctgatatataaatcttcaaaacaaataaaaatgtaatgtgttataacactttctcttttcttttccagaagaataaattctatctcctagtaatccaccttgcaatcaactcttgatttcctggctatcagaatttgacttctacagtcagttcatacaacagtgtgatctgaggtatgaggaatgcaaacatagaacagtcctgggttgtgaactatgggaactcatctacaagctagagacatggaacccagtttattttagtttagaataaagtcagatgtcacagactctcaggaggtatagtgccagagaccaaggtatcgttcaaagccagagggctgatatacacttctgaggagaagtaattaatctagtcaactagtagtacctgctttgtgtcagatactcctttagctgttgcacgtggaaatcagaagcagttctcactgtatttgagaggtacagtattcataactaaacagaaacttattcaaagtagtattagtgatggagcatatagtgaagaaaagatctagaaagtggaatgaagctggggatttgctttgtggtggatgggcatgtgagaggggggggaaggagagttagaagaagagggagaatgagaagaagggggtagaagctcttgctgtatttattttgttcttcctggaactcacaatcctactttagcctcctaaatgctaggatttcagatatgcaccatatttggctgaggatttatttacaaaagagtgtccaaggaagcctactttagggaatgacttcggatcagaaaactaaagaagacgacaaagaacttttctgatactgttctctcagtggaaagaaatattgacccaatgtcttaaatcagaaactagtgtgtataattcaaatgattgcagcacatgggctgaggacatggctaaactgttaggagcacttgatgctcttctagaagagccatgtttgagtttcagcacctacatagtggcttacaaccatctgtaactctaattctagaggatttagtgccatttcctggcttctatgggcatgtataatgcacatggtgtacagacatacacagagacaattacaaatttactgaagtatgtctggatagagtattcaagggattccaaggtaaccaatgaagaaagaaacgtaaaagagagcaggtcacacactgcatctgagcatttttttggtgtgaaatggaggaaagcttccccattttctccttggtcagcatcactggcaatcctgtgacatcaaagcccagaggaaaactaagctgggtgcaaactattctgattgcacatctggagatgctacgacgagttatgaagtgtgtattcctggtctcaaatctgattccatccagtcacctttgtagacaatggagtccccttcacccctggcctcagcattcctaccctctctaccacacagccacagtcatcatcatctctccaatccttcatcattgttgctaatatcctgtcaaggcaggggtgcatccaactccaagcaaagctgtcttcgtaaatatttagactgaacagaaaatgtgccaaagctacaaagagtatgtccagaaggaaaagagagcttcctgtgagctgtttcctccaggcttgtgtctgaattcatgaatatgcattctggaataagacataactattcctgtacctgaaagacccttacccagaaacctgctagaccctgcatgacaatttcttctcacccctgtaactatgtgtctccatttcctctgaatttttctttttcattttcctgtttctgatcacatacagagctccaggctctattaaacttaccccaaagtctatattaaccatctcattgtacctccttcacttgtcacttctttatcatcaggtttctgcctatcccacccctctcctatgcttctgctcactcaggttaacctagagcccatgtttctggttcttgcagttatactcactgaaatgggctatgttcattggtcctggctgacactgcatttgtgtgaatcatcttcctgcttgaaccactctgatccttcatttcctgcccgttatatctataacgttttgcaagttgcatctttacacttgtctctcgagatcaccactgtattcttatccatttttcgacttgacttttcatagctgctgttgtttgttgtcctgagtagatccaatagctagctcccgcctagggacatcaaatgttaagtctcaatcatctcccactcttggctgaataatgagttttaaagtgatccttgatatattctattttcattccagttatgtctgatgtttcctcttgaccttattcatcctcttagatatttctttagaagacagagaaacagtgctctcttgttagatgcattatgggaattactttttaaaaagtgtttgatggtgacacagtttgactagctttttcaaccttgagagaattcctaagctggaggaacgtttaaattctttccatctgcctgcatagcattaagatttcaactccagtcttggggtgagaggaattcttaacttctcctttaataaaatcaatagaagctgaaaagaagaccaagttgacactcatcatttcactagcattctgcctctaagcatccacggtttccctcttcttttctaccatataagtaagatgcagttcttgattctaagggctctcaatcaacaggcacgaagaacattcaggtgcctgaagaaatagaaagtgtgcaaggctcttcagagaaaggtgaaggggcacagacctttaagctgtttacagatactatatcatctgtgagttagaggtgaagtaagatattcagagagacaatgtggcatgcctaaggttacttagggaaaagaaaagcaaaaacagatggattataatcctaaaatgtaacatctattgtgctccttcttaagaagaaatagtaactgtaccaggaggtaagaatttcttccctccctccctcccccctccctccctccctccctccctccctccctccctccctccctccctccctccctccctccctccctctctctctcctttccttcccctatttccttatattttgagacagggtctcatgtaacacaggttatcctcaatacctactatactgatgaggataaccttgaatttccagtcttcttgtctttaccttcagagtgctagcattaaaggattgagccaccatactgggagtggtttatggtactgtggagtgaacccatagcttagggaaacactctactaattgagctccatccttaatcttattggtgttctttaataactgttgagattcacttaaaacaggatctcatgtgtaagtcccatggtgatattgcttgtatcataaagctaagactgatctccatggttcccttattctttttatcataggcagaaatattgaaaacgagcaagctttgttttaattggaaggactaaatgcctatttttggaaactattgcttgtattgctacagttgagacagtgaagcacaattaaaatccttttaaaaaagattttctccaataaatcagtaagtaatttatgactaagcaagtcccatgaaaaatgttatagctgctggcggctgggcgtgtacacccatctctcactcttcttgaagggatgtaggctagatgtcccttctaagtccctccaggttttggagctttttgatctttttctgtgctcccacccttaccctagcccccaacatgaaaggagtgatttagttagcagggaagttactgagctgtttgattagctgtgaagaagtctttcatgtttctagggtcgtcagagttgctataaccagcctatggattagaaatgcagactttgagacccaacccaggcttactgaataggacactctggacagactcagccatctgagcattaccagttggttctggtctgacttaagctgtataagcattgtctagctggcccacctctcttttctgaatcagctttaggagaagctgggttctgatctgcttccttccatgtggttggaatagagatatagattggaaaggatactctgttgcaaggtgtttttatacactagtttcaggtgcagcactataaagtcatgattttacaaaaaaattttttttctaatgatactgacaatttacttatttttgtttaaatgtaactctaatttcaactttcatagtatattctaactttgagggtagaaggagaaaggaatatcattcattggattccttaaagccctaatagtagtcacttatttttctttatgacgatgcatttaagtcctgagtgagcctgagagtagcccaaattcattcctgttagaactggtaccaagtaaagaccagagaaggcagacacacttataaaaacgtacctggaaagttagctggagatagcaagaacccagtcatatgtcagacacagcccaggtgtctcatcaccagctccaaattgaaagagaaggaatgcttttctggattggcttatctctgtcttcatagcgaggaattcctacctcatgtttcatcctgggaatcaagaatgaatctgtaccaaattggtttccatggccccctagtgaacacggcatctctcaatgtcacatcctaaattcctaccccagttctttcatccaacttccttgacaggaattgaaaatgaactgcagctgttcagcttgtctgtggtaggcagcaaattcttagtcctcctgtgagctcatcccagggaaaacctcatagtgtgaccaggaagtgctcttgacggcaatgtagagtccgcccccatttcctgtgagtcacttttggttccagtctgtgggacaattatttctccaaatggagttacttgattatccaacagagacatgttccacgaggtaacaaactgactttcagatttgaattttgacttacctaattttcatccacattatgccttttataatccctcatttctattctgggttgccaaaacactgtttatactttgcgaaatttcacagtgagtacgggctttgatggagggatcaaccaatttgcttctttcttgattagctttatagtgacagctcatggctttgtttgtttgttttctgtttttgtatttttctttgtgaacatggcagctaatgtgctatgcatgttgtgtgtgttggtttgaccaaccttcatggtcctataaagtaggtactatttcagtttccattcttcagagactatgcgccccttctttcttcattcaacatctgtatggttgggctttaaacccaggtctggctctcttagatcctttcatacaatgaaatatgcattggcttcctggatgtcccagctcttgggtaggagagggcttactgggataaggacagttcagatatgcaaaaggccttcacagaagccaagcaaggcaaatgtctagttcaaattcaatgccaaggtgaagaatgggagatagcaggtgacttttggtgaaattattttagaaaattgccagtgttattcaactacaaattattcttatggagtgtcttgggtgtgaagatatccaacagaatgaaatacatgctagatccagaagatctgtggctgaaattctacatgatggatgtttacattcacccccattttaaagcttaaaatgtacacaaatacagatctaattgaatagctaccatatatctttgaaaatcaaatatctcaacagagcatatgccagaatttaggaagtatgggcataatgtaatgagccatttatagaaaataaatgtcatttgctttattgatgtggctgaagggaatcttacttttatgatcagagtgaggtttaaggatgaatgtaaggaatgacccatgtcttaaaggacaaagaggagttagataataaaagaagatggtaaaagttgatgttccaaaactaaacaacccatttttcttttctttttttttttttttttttggttatcactgccaatctgtttttcattttattttatcattttatggtgggaactacaaaggaaactggactcatttgtcaagtatgaccccaatgccaaagccgccatcttgatttctttttctttgtctattcttttatatttgttaataacagaaccatttcatgttaatagctgtgggtctgcacatctcatttgcatgaagatactgaaggaagagttaggctacaccatctgtagtccattttatcagaatatcaggagtttctctatgagactactaaatgaatacttgcttctgtttattcccctggatcaaatcatgtgagtcctcttggttccctcttgagcttctatacagagagtgtggaagggagaatggcacaaagtatgtgttttagtgttatccatgtcagcgatcaccttccacgtgagtggaagaactatgctctgggagaattatgaagttagcatttgtatttgttttctttctttattccttccaagtatgtcctgtcatgctcaaagaggaataacagaaaacattcactgaaagaataaacaaatcaagtttcatctcagcaggcatttatttgttaagcacgacctccctgctggagaaaatgaaggcacagatcaagcttgaggtctgacagtagatatgtgttcaatatgctatggtgcatgttacatataggtgtttttttttttcaaaaaagaagaaatccagagagagatgaaaacagggaaggaaactcatgtatacacatgagagaggggtggagggaagaatctatctcagggaggttatcggacagtttaaacttaaacttgggtaacaaatgttacttaactgtcagtgggtgaccacaggtttatttctccattgtgcaatttagctgtgtggttaggttgtgactgtctcagcctgggagccaaagtgaatgaaaagcctcagtctggaacctgggcagatggcacagagaacagacaaccacatagcacttatcacttctgctccatccttggtcaaaataggtcacatggctctttctgagtgaactaatggctcttgcagagtacactcctccatgtaatcatccagagatggacacacagtactgtcatttacaaagagctatggagggtttgactgtctgtgctatcttttttctgttctttctagtctattcttcctttcccccttcttccagtgatcagcctcccacatcccttgatgtgggagaactgtggctgggatgacttgtaagggatgcactgtgggagccagagtctgacttcatctccacctggtccaggaggggagactgagggaagggtttggattcaaagccaagagcatcttggcaggatgtggcttttcaggaggtaaaaagatggatttcaccatttgtatcttttctaatacattttttggacaaaagttataccagatatggaggtgggtggccagacttctaagaaagtcttactgtcattcagcattggttcagcacataaccagctgtgaggttcttgacagatgtagaccatcatttattcaggggccagtggcagaatggactaaagacagggacaataataagagacctcacttgtcaatggcaataaacaagcacagatgtgcatttagcacacaaagaatcagtgtgacttggatatttggagcactgagtaaaaagctatcacaaaattcatctttatttctccttcagacacttcaagctcattgtctttctactgcctgggatgtgtctgtacactcatattcaaatgttcctttgacgtactatttgagacaaactgttttaaaaatacacagttaaatttttgtctccagacactaagaattacatcctggttttcagtagaggcaaatagaaaaaaatgtttggctaagagcaaatcatgtttagcttcattccaggtcctcaaattttcttggattctcaggtactcaactcctttgaacatcaacatgctctctgttataaaatagaatgttctctcatagattttaaggaatttggtggaaaaaaaatcacatgagaactttcttttattaaatacctgccagataggaatttttggctaaggtgagagcacacaacttatgagcttttagtcagtgaatgatttttttatattattatatgtattatgtttgtgaaagctaaaactggatccaaaaatgtacatcttatgggtgggaccacaataatttttgttatcaatatttgaactgttcttaatgatttacgttaatttttggatcatgaaattatattgtcaccttttccaagttgctgatattctaaacctgtatcaaacatggcagctactcttttgtattactgctatcatacactgtttaattttccatttaatattaacttgtagttctttgaagacagggtttgagatgaaactttatttgtttatgtgggatagacacattagtcttgagaagcttgtgtctttggacctcatatggtgcgggaaacagagcaacaaaccatgagtcatgaaatgactcagccagtgaatcagaggttccgttcagacaagcctaggggcctctatcatctaaacccatttggaggcccaaggagattaacacctttgtattatgatttatttttttatattaaaatataaattatacataaaacataattttcctactcctttctctccatctatcccttcacatgaaccctttattactctctttcaaattcatatatctctctatctctatctctatctctatcaatctatctatcatctatctatctatctatctatctatctatctatctatctatctaatacatataaacccttcttggttcatatatgtatgatttcaggattaatcacttggtattggacaactcacttgggggaggttcttcattgaggaagatagtgtctcctgatttcagcatgccatagttgcctatagctctctgtcaagggctgaggcttgatgtgatttcctcccttttcattagcatgcttacttttgttgtctttgttcaggccttgcttagctagccatttgattttagagacactccacctcaaaagtcctatcaatcaataccattaaaaatctctattgtagtgacaataggctgacatgtttttataaaatatattattcaaattatgaaacatccaaactcttgacttggcttattatttggcatttttcaatttcatgttctattagttggaaaaatgagggtcattgaatccaaaatcctgcacattcacatatccaagatgtttgttgtatgggctgcttagcctcaataaacttcacagttctcatttgctaaaggagatggtaatgtctgatcttgtgaggatgcttaaaaagaagtgaaatgtaagtttttgccaatatagtttttggcaaagaatgagttctccaaaaccctgttcttttatacccatcccatcagggtaatgttctaaagaggaagtagggagatcttatacattgtgtggatattataccaataagaaaggatagatttaggatcattggttaaagaaaagtttttatagtaccattaaaaatattaaagatccagaccttcatatacagaattgatgtttttttttctgcgaggcaaggaagatctccaaacagaggcaaacgtttttaaattttaatgacaataatattatattgtctgtcttcatcctcatcagtttggtcagttaagctttgggttaattctgggctgctctaactcttaactgcttgttcagattagtatagatcctaggaagatggacgttacatcatcagacacccatggtcatgatctgcaaactgtatatttatagagtatagtaaggactggcaactgatcacacaacacttcgttcacatgcttttttcagagttcaagttttgttttctgatattttcaaccctccctaaaggaggagaatccatggtgggtggtatgacaggcgtggagtttgttgttcttgccacatgtgaatggaaaagctaagtcactagaagagaaatagtggtatcagaaatcgtgaatattttcatatattctttttacacatcatttccagttagaaaaaaaggagcagaggatttgagggtcttgttgcttaactgtgacgagaaggctgtttccagaataagtgtctcagcttgatgtggtgactagtgatgttgcataagtccaataacttttcatggtcctaacttctctcactatggggaaatctggagaccacatgtgagaatttgggactatggtagagcttaggcttgatgtctaggggaagtgagctgagagtatagctctcctggagactgttgtgtgccatagaatacactacctgaattttctaagattctgcattctcctctagtaaatcagaatgatggttgattcaaatgcaaaaagccaatgtaaggactaaaagagatgagtcacataaaattctttagcccattggctgacgcgtagtaagggatctacctactcctgataccattgccattaggagcaaccattcattgacaatctactgtgttcattttcacatttgggtatcactgaaaactgaggagatatgattccaatactgagtgtaaaaaacaaagagatatagcaagctcacataacctttaaaagtcacacaactgaaccaaagagatggaatttaaatcaagctttcagtttttcctttttttgatgctgaggtctactgactgtcttgccattgaaagatattaaatagatgagacattgtttcccttgtcactaactaactaactggaaccaaccaattttaatcctcaactacttagacagttgtacccaagcatgtatttagttacataaaaggagttgagagaattttgtacaacatggatgctcctaggatcagaaatttctggttaaaatattctccaagaagtgactgattatgcttgttagagattctgggagattgaagaaattagctatggactgagtatgacttattaatccttgcttgtctattcccttgaagtcccctagaaggtagctccttgtcaaagaggtcttccttggtttccaggtggtatttcctgcatcacttttctaggctcaatgttctgttgctgggccttggctaattctgagcttgttgataatagatccagggcatgttagagtgcctaggagtggagcttcttctgggaattgtgggactggctgtggagttagcgcccaaggtctgctcaaggcacctctgatcctatgatctcgggcctgttagagttcctgggagtggagcttcctctgggtgttgtgggactgtctgctcagagcaccagcccagacaggaaggaacccatgccactgctcaggcagagttcctggatgcctggaggagatgtttctaagcctttcagcagatggctaatggattcgatttcagaggaaagacttattaagcttcctccttgaaggctagttttcatggtaccaaaacgagtcatggaaacttctataaaagggaagcattcaattgtctcacccagtcttgatgcctatgaaccatagcagagaccagcatagcaggataatcctaagaatgtagtagtggcacatgtaccttagtgataaccaaaagttctctagttagacttaagactatttaacaagaggggaagaatcatacctggtactggaaatttagccatctatcttgggctaatgaagtcagggattctggaggggaacctacaactgcctctttactaaacctgtataatctctaactatatctaaagtattagtttgtatacacacagataagtatagtcctaacccattatcaaggaaacttctttttgcaatagatggagaccattacagaaaaccacagctgaccaaaatgcagagctgtatagcccagtctcagttgatacatctacaacatagttctgtcccaaagtctcatggaatattgtagaagaggggtagaaaagttgtaagagccaaaggatcagagaatttgttgtgggactgtgtctcctactaaagtcagaggctacacccataactcaacaaaatgactgcctatgcatgagctgaacaaggacaataataggcatggtaacctgaatagggaaaagctcatgatgatttaatcctacactaagaactacagggatgctaagagctagagaagtaatccccaaggaagaacacaccaattggttatctaatacccaatggttagcctgaaaacatacatacaaataacgttatacagactgagaggattgtatttttgtattaggtacatacacacacacacatatatatatacatatatatacacatacatacacacatatatataccatatatatatatatacatacatatacatatatatatatatatatacacacacacacatatatatcaacaatagaaaaattttaattaaataattaaaagagaaagtctccaactttgctgtagccctgggaattgcttttttggttcttgcccacagggctttagaatgagccgggacctatgttcttgccttgtcatatctcctgtgttatttccctatgtagcctgacaggtccttgactcagttctatatctgtgtctttgtttccttcagccagacaatttgtatgtgaatgtcctatccatgccaatggtagggttattaggaagagagacctttgaaaattatttaatgatcccaatgcagtcatgagagtggagcccatattaatggattagtgccctcattgaagactggagagagagagtttcctctttcatctgctggtatgtgaaggcaatgaaggaatggtcatgtgtaaacaagaaaggattgctcatcagatactggatcctagagtctttcatctcggacaccttagtaatgtaatgtttgttgcatattaaaccaacttttgtttcagcaacttgagtgaactaagacattcaggggattcattgtagcctcctggcagtctactaacatcctgccatctgtctgagacaatgagagatactgaattcagcatggtttataactagtatgcatagctttaaggggaagttaacactcactatttggctgtgttttcccttttacccgtgcccttttgaattcacctcctgccctcctatgactctaggtacccttatggttcatcattattctctcatggatgagaaacctttgtattctcagttgtctttccctgggcctttctccactgttcccagtgtactatgaatcattgttcaatatttctctctctctctctctctctctctctctctctctctctctctccctccctccctctctctctctacctcctctgtcagtctttagctttaattaatttaccagataaatttatcagaaatggggctttagacaaatttaatgtttggagactgtttttagaagctgtttccaggacaggcaggtgttggtagaggacaacaggaggtggaaggaactgtctgagcagactgtctataccctagtgggggccactgagcctgagtgcatcgagcagctttatgagtaagatccaagtgggagttggggagaagactcccaatggtggaaaacttgactcacttgaaaacttgcccacaagcctgtcctggaaggaagaaataaaaggtgatctcatcagacttccccctccccagctctcatccatgtatgtatttacttccctctttcacttttcaccctacaaagaacattcattagtggctcaacagccttggatgttaatcccagcaaagctctctcatttaccagcaagtaagaccatccatgagtctgaggcttagcaagaacctgccaaatcccatcacatgaacatggctcaggtcttctgacactcgaagcagcttctcaatcccctatcgtgtctccaatgcaaaatatattcagacgccctagagatatatctgtgacttcatgcctctaagaattcaacaagtcttttctggtgacttttcccatgaagctttacagtcctaggtcctggtagatcttgtggcattcttcacaccaataacatgtcaaaaacctctctgtgatcctgcaatggaaacagaaaaccaagacctaggccagagaaacacaagtaggaaaatacatgcatccacatgatcgatacagttcagccttacatatgcttctgtttcctagaatccaaagaaatacagggaagcagatttagtcacttgtttctaggaaaatagaaaatagaaagatatttgtgtgagtgtgcatgtgtgtgtgtgtgtgtgtgtgtgtgtatgtgtgtgtgtgtgtgtgtgtgtgtgtgtgtgtgtgtgtatgtatgtcggagagagggacagagacagagatagggagacagggagaaatagagagacagacagggagacagacagggagatggggagagagatatataacccccaaatattctggagacagaaaatttacaagatcaaagccaacttcttgcatcaggggaaggtgattcttttacaaggacaaataatgaataatgcccttcaaaccagcaaggtctagataacagaagtccaaaccctaccttcatcaaaataactgataatgtcatttctgagtcagtttgcttggaagtaagagacatgtagagcaaacctccactttcatacaccaaaaatgtactatagcatcactagcactataggaaaactatttctagttctggtaattaattaattattattttttgttatatgtagaggttcagactcccagctgcaatgagaggaagacagatgtaacagaccaatgttggtagagccaaatgcaaatttttcccacagtatttttcccgttgaataactgggtctccctctgagcagatgcttgtatgccttaatgactcgcttatgaggtcctcatcccactgcagtttgaagacaggaagcctggcatgaggcctggagctggtgacacagtggcttcttgcccgcttttctaaagttgccccagtgggcacatctgtgccccaaatttgcccgctctgtcagaagacaatgaaggcttgttcccagtatctgaaatgatgacttcatagtcctttttaaagctggcagggagagatagagaattaatgtagttaaaaatgcacactgcaaagattgagtttcacattgggtaaagaacgggagtacttcctatctgggaaactataaaatctaacacagtaactaccttgacagcagtgccccagtttccttccattaagctcatttaaaagacaatcatgagtgtgtagcccattgggttgacatgtgtagactcattcttttcttcctgtgttgaaagtatgatacagaacagtaacctttaacattttttgataatgacccatatacacaggtacattttgtattgtgactctgaacacacactgaaaaaatgattttatgaaaataccatgtgtaatatgcacaattcacatttgttagattatctcattgacaaacaccttcttgtgattccttgagttgattctatgaatcccaaacaagctgtaacctatagttagaagacacaggtttcaagaaagaacataggacttcgatgtccaggctcaactcctaactgctcaactttagtggctgcatgaagtttttttgagccgtagtatgtcagtcagcatgggctaggttatgctttagtaatgaacagtccggccatttcagagacttaaaataactagagttcacttcatactcatcctgtttgaggctcatgtttttgtaacgactcacacatccagaatgcaggtgctgtcaggatagcatccttacttcccgatctactgacagagcaatttgactcccagctgtgtcatgggattttcttttgggcataggattcatgcagcaacctggtgttgagaagatctctgtgcttgactcgatgttctactatcacagtcttgaaataatgatcttggaacaagacatcttaggttttaattttgtaagaattttgcattttaattttggaccaggaccccaaattatgtagctagtatgtagaccactattttaaaatataaatactccaaggagttacagagaaaaagtttggagctgagacaaaaggatggaccatctagagactgccatatctggggatccatcccataatcagcttccaaacgctgacaccattgcatacactagcaagattttgctgaaaggaccctgatatagctgtctcttatgagacaatgccggggcctagcaaacacagaagtggatgctcacagtcagctattggatggatcacagggcccccaatggaggagctagagaaagtacccaaggagctgaagggatctgcagttgtataggtgggacaacaatatgaactaaacaataccccccaccccccctggagcttgtgtctctagctgcatatgaatcagaagatggcctagtcggccatcagtggaaagagaggcccattgttctgttcgtgcaaactttatatgcctcagtacaggggaacgccagggccaagaagtgggagtgggtgggtaggggagtgggtagggaagtgtgtgggtgaattttgggatagcattggaaatgtaaatgaaataaatacccaattaaaaataaataaaaatttaaaaatataaatacatttatctatctatctatctatctatctatctatctatctatctatctatctatacattccactacctcatccatctgccttctctatttcttttcagaaaaggtcagacatccatgggtatagaccaaacatggcatatcaagttgcagtaagactaggaacttcaccttatactgaggctggatgaggcaacccagtaggaggaaaggatcctcttttgagtctccttcttcttcttcttttttttttttcctgatctggaaaatggattcctgatatggactcatgagattcctaaaagaattaaaagaaggacggcatagtcatgacagtgcatattataacttttgttcatgtcttgatagtttcatttccatttctatcaatgggaaaaacctatctatccagtcatgttactcttctcacctggaaacattctcttccattatgttgttctctttctctagtctgcttaccttaaatcagtatattacactatggcctcggtagtcaccttctgtggctgttcacacatccacagagccctccttaattcccttcttattgcggcccttcccttgcctttggctcttcatccctttgccagttcccttcatacttcacatttagcctcttctttagttgcctcagctccagttggttatgtgactctcagtgatgctggtctctgcataatcatcactaatttcttacctccagctaaccagcaccaattgtcccagtagtcctttctattctggactctaaagtccaagccacctgcctgaagctgtcatgttctgccgcttcctggggctgaaacttgccccccttattctatttcctgctttctgttttttaactcccatactgtctaagcttggctgtcttaaaacttgttctatagattgaccttgaactcagagatctgcatggctctgtctcctgggattaaagtcatgtacaaccatgactggatttaaacttttcttcacataaaaaggagactcaaaagaggatcctttcctcctactgggttgcctcatccagcctcagtataaggtgaagtgcctagtcttactgcaacttgatatgccatgtttggtctatatccatggatgtctgaccttttctgaaaagaaacagagaaggcagatggatggggcagtggaatgtatagatagatagatagatagatagatagatagatagatagatagataggtaggtaggtaggtagacagatagatttttattttaaaagagtggtctacaaactagctatataatttggggtcctggtccaaaatgaaaatgcaaaattcttacaaaatgaaaacataaggaaaatataacatatggtttgagcattaaatgggcaccaggaagtgaaatggagctgaatcctgtgttcaatgatattaatttgaataaaagggagtggtgactttgggataggatctcacccagctaaatttagctccattcgtggtgctacacacacacacacacacacacacacacacacacacacacacacacacaccacaaatacgttgccatacacttttggagattcgtagtttaggctaggtcagatcaaggtgttatctgcttctgttttctggaagggagtctgtactccagtttcttagattctgatggctgccttcataccttggttcacggattaccttcaccttcaaacctctggccttcatttcacaaaagcccttgtgatgatttctccacctcaatcatttttgctcaatagaatctgtaaagtgcatttggctatgtatgatgattcctcggtgtgtgttgggtgtctttattcttattaccataacttccaagtagttttcattggcttcagttcagctttatcaactgagtgaaacacaaacttcactaaactcccattgagagactttgctggaaacctctcatcatttatttcagactaccactaccacaactctgcaagacaagtatttttataatatccattcataaatgagcagattgagggttgcccaagttaagtgactaattcagcctgtaagagatggggggaaatcaagtgtaataagtctgtctgaaaaaactcaccttttctttacaacttcaaattccaacttcaaggcaccatccacactattgaaatgattgggacactctaaaatcttgggcccttgttctcttagtgactacagaggcacactagatacctaatccagcactcctggctagccattttctttgcccctaaggcagggaacagaccagtttccttttcattttcttaagactctgcccaggataccctggctttgtagaagagacacacccaaatgccctgcatgagtcactggctctgcccggagctaaaatatgatgaggcgggagtctttggctgctcccgtctgtgaaatggtttccattacagtatttctgccgagaacagcaattctgtcttttgatccctctcaccatgactacagaactgtgggcatctgggtgagctgccataagagagctgttgggtttagagagccctatgctggagcttgggggacccagatgacaccatcagcactgcttctgactagtcctctgacattggggtctaatgtccgagtctccagtcctttctacattcttggtccctctctactgttacaaattaatcactatgtctttggtctctttccagcttgtatagtgttctaaatttccttgggtttccttgtaggagccatgaacaaccatgttatcaacacagtggccaaaactctgtatattatgtcaatgaagggaacaaaagacagcttaacagatttcttgctgttgatatgggtgctcaggtgatgagcagagtcacaaaagtgaatctagagcccagaaggaaggtatccatagcagtggcagttcaagagcaaaagccatgctggagagaagaagacatgtttctttactttttaagactcttccgttgaactagagtcttatgttagcctcgagcatcctgggtagcacagaatgaccttgtacttctgatccttctgcctctgcatctctagtcctaggattacatgcaccatcgtgcccagtttgtgcagttctgtgcctcaagcacaaggctttacaatgctattcaagcactgtaccaattgatgtatattcctaacctgtctttttcttttaagatcaggcaggtatcataataaaggtgaaaagcatggaccactgaatggctccctagaatgcttgttagtaatgatactcattaagaagtatttgcccctaatgtatcactgcttatccagaatagtaattaattaattaattaattaattaattaactttttacactccatattttattccccctccctgcctaccctccaactgctccacatcccatacctcctctttaccccctatcttcacgtggatgtccccacttcccaccccacctgacctctaaactccctggggcctccagtctcttgagggttaggtacattatctctgaatgaacacagaccctgtagtcctctgctgtatatatgtgttggggacctcatatcagctgttgtatgctgcctgtttggtggtccagtgtttgagagttcttgggggtccagattatttgagactgctggcccttctacaggtcactctcctcctcagcttctttcagcctttccctaatttaacaacaggggccagctgcttctgtccatttgttgggtgcaactctctgcatctgactctttcatctgcttgttggatctttcagagtgcagtttctgaaatactatgtcagaacagtattttcgatacataaactatttctgtctttagatgacatgagtttggagaacatttcccagggaccttacattagaatcctacctctgttcctaatttccaggtcattggagcctcaccttttaaacctgttatcttagcaccatgcaggctgaacaaccattaggatatccagttggttaatcatgtggaaatactaatacatggaacctcttcattcttcttgagtcaccagtggagaaagaaacttcagatctggaatgagaaccacttgactttcagaggagactcttcgactcatcaactgtgttatcttaggcaagttaactgtctgattcgcaaatcttttaatcttgaaactaaggatacaaggagaatatcttcatgggggtggggatgttcaatgttacaatatatgtaaggattgtagcatagggtctggcatgtggaatatgtttgctcactatggatggtatcctattgttgtgggacagaattctttaacatttatagtctgctctgagtcgaattccattttctgaggtgtcaggagacattatttgttattttggacagagttaagcctttctgttgagatcacactcttgtaaatgtgtgtataaaactgtgtcctgatgtagaacaaggggtacagattttttctggcatccctatttcccagcccacagcctcaacatctgcaaataattaatgcagagagccttcttacagctggccacccaaatgcatcttacacattaaacttgaaaagttaaaaggatgaacccagaaagacttctataaatttcaaaatacacattggggacttagacatatggtgtttaagcatatacccatgatgtttgatgctgggatgaatagaaacctgctgaatggcagggtaaggatggtcaaagtaacctgtgggccttcaggttgcctgggctaactttaggaatagattaggtgtcaggggacttggctcacctcttgggtcttgtatatgcatgcataaattcagaaggttaaggccagtgaggaagtattggacagagatgacagggcagggcagggtagggggaaatggttggaatcttctttggatttcattgcattcaatctggatcactgggagtaatatttatacatttatagagtagttgcaatatgtggggtacctttctcttgggttgacgattgtgtaatacctttttataaaaagaagagtttgaggatcaaagaccttttaagagttgctcagaaccacaaaggtcacaaatacaaaatgagaacttaggtgcaggtctatttgatatgggacttctttggtgaaacagtgaaagggagcagatggccttgaaggtgaagtgtttggctattgatgcatttgaaggctgagcaagagatcaaatgaccttttggacatgagctatcttaggctcttttttatttctgaattgaagatgccatattcagttcagtaagctcctgcatgcttctggtctctctcggtgtgtaattatctcatcttcccaaaggcacaacactgatctacttgaaagttacctgtctatcagctgttgctgcaaagggagtttcatttttgacctagtatttggaaactcttagttcagttcagtcctaggatggtttaaaattgcttacatatgtctctttagcttttgtttcccatggttggatggagagaggaacagatgtgtttccaaatgaactcatgcattgtctgttacttcaggtatgatcacagactgaaaatgtgctcatatggggccttcattccttagttccttagtcaccatttgctctgctccataagatgagacatcttccatcacctaccaccatggtccctatctgcctcaagcctccctactcctcatgctaatgtcattggtaaatttttattttatcaaatgatacatacatatacaaaagcacaagtgatttagtgaattattgtttttgttacatatatatccgcataaatcaacatgcatttagttacgcttggtataagttgtagcacactgcacttgatagctgactttccttgaaaaatcttcttcaaattctgttgttagaaataatctcacttccatttcaaatttctaccaattgatctattcaacagtactctgtgtgagtttccatttcctgtaacttataaaaatattaacattatcagatagtagatagtctgatgtgtaggacaaagtatctcatttttaagatttttgggtttttggaagatgtattcagtccatttattgcattttaatttgcatctattagcagaagtaatcatccttttgtatattcattgtgtgttgagatttttttttcttgtggtttgtctgatagagtctttggtggtttttgtctcgagatttagggtataccttcttgctctgtggaacactttctacctgtctagtcaacggcaattatttattgtttagaactactgtttggaataagccggtataggctagacatgaaaattcattaacttgagagatagagactggaagatcagatgtttagggataactttgcctctatacagcaagaagacctaagagcttgactataaatcgactaagcgaccaatccaacaaaaagagttcaaaatggtgaataaattttcaagcccatagtttccagttcatgattcttgtgtttttataatgttttggttttcttataattgacaacacaagtgggatataggggattgtatatacacagaaggaaggggaggaggagagaaggaaagagaataaagaagagggggaagaggaagagaagtaagaagaataggaataggaggagaaataaggatgatgaagtttggtaagagatgaattagaggttacaggaggagttggaatagtaaaatgaatatgtttataattatatttcattttgttaacatgtacaaaactattaaagaatataaaagcgaagtttatgtttttagttttatcattagtacatgattcaataaatccttcattctggtttcaaaggattttgtttgtcatttttctaaaaattttagaaaattagctttttaaaattaactttaaattattttatttatttacacccagaatgttgcctccccacccagttccctgctatcaaagttcttcccccttcccccttccctttacctctcctcttctgagagggtacccccttttccacttcccctttccctgggtcattaaatttctacagaattatgcacatactttcccactgaaaccagacaatgcagtcctctgctacatatgtgtcagggccatgaaccagcccatgtatgctccttggttggtggctcagtctctgggaactctgaggggtctgggttagttgatatttttgttcttcctatggagtttcactcttcttcagctcccactgggttcctaacctcaatccagtggttggctgaaagtatctgcatctgtctcaatcagctgttggtagagcctcttagaggatagccatgttaggcttctgtctgcaagcacaatatagcattagtaatagcatcagtgtttggggccagcccataggataatcccaagttgggctggtcacaagtcagcttttccttcagtttctgctccacattttttttttttgtccctgcatttcttttagacaggaacgattctgggtcaaaaattttgaacatggattggtaaccccatcactccacttggggccctgactatctactggaggtggtctcttcaggttccatctctccattgttgggcatttcaactaaggtcactcccactgagtcctgggagcatgtcacatcccaggcctctagggctttctagaggtaccccctgcccgagcagttgtatatttccattcattctcttggccctctgggtttctctcctttcttcctccatacctgattatgatctccttttcttcccaccaaccccaccgagatgtctcatttcctctgccttccctgattactttaatttcacatatgaatattgatacaaaaatactcaataaaaatttcacaagctgaatccaaaaacaaataaaaaatattgttcaccatgatcaagtaagctccatcccagggatgcagggatggttcaatgtatgaaaatccatcaacacaagccgttatataaaaatctccaaaaaggaagtcacatgatcatcttattagattccaagaaagcctttgacaaaatctaacacaccttcatgttaaaagtctttgaatgatcaggactcatgacatacaatgaaacataataaaagcaatatacagaaaaccaacagcccggatcaaattaaatggaaagaaacttgaagcaatcccactaaaaatagggacatgcctgctcagtcactccctatctattcaatatagcacttgaagttctagttagagcaattagacaacaaaaggagatcaagtggttatagattggaaaggaagaaatcaaggtaccactatttgtagatgatatgatagtatatataagcaacactaaggagtctatcaaagaactcctacagttgataaacaacttcagcaaagtggctagatataaaattaactcaaacaaacctgttgtcctcctttatacaaatgataaatgagctgagaatagcgacaaataatataaaacatctttgtgtaactctaaccaagcaagtaaaagatctgtatgacaagaacttcaaatccctgaagaaagaaatcaaagaagacatcagaagatggaaagatctcccgtgctcattgatcagtaggattaacagtgaaaaaggccattttatcaaaaacaattcacagattcaatgcaatccccatcaaaatacaacacagttcttcacagacatggaaaaagaaattctcaacttcatgtgagaaaccaaaaagaccccagggtatccaaaacaactttcaacagtcaaaggatttctgggggaatcaccatccctgacctcaaactctactacagaaaaatagtgataaaaccacatgatattggtacaaaggcagacaggttgatcaatggcatagaattgaagacccagaaataaactgacacacttaggagaacacttaataaagaaataaaacccatacaatggaaaaaagaaagcatctttaacaaatggtactggtctaactggcagtctgcacatgctgggaggatgtagagaaaggagaacactcctccattgttgggattacaaactgataaaaccactctggaaatcaatgtggcagtttttcagaaaattggaaatagttttacctgaagacacagctatacagctcctggggatacacacacacacacacacacacacacacacacacaaatgcttcatcataacacaaggacacatgcttcactatgttcatagcagccttattcataattgccagaaggtggaggcatcccagatgtcccacaacttaagaatggatacagaaaacatggttcatttacacaatagaatactattcagataataaaaatgaggacatcataagttttgcagacaaatgaatgcagctagaaaatatcatcctgagtgagttaatccagaccccaaaggtcatgcatggtatgtactcactgataagtggatattagccaaaaagtacagaatacccatgatacaacccacagaccttaaagaatacccatgatacaactcacagaccttaagaagtatttttgttttgttttttatttttattttttttacaggttaaaatcactttgatgctcttgttagtttttaaattgcatctactcctctggtttcatgaccaggatataagccaccctatttaatctgcatacacacatgtgcacatgcacacacacacatacacacacacacacacacacacacacacacacacacacacacgaaaattggcattcagagaaagaacactggaactgaaaggatacctctgcacctcaaactataaaacaaagcatgaatttagggattttatgattaacctattgttttatgtttttttgtttgtttttctttttgtttttgagacagggttcctctgtgtagccttgactgccctggaccaggctggccttgaactcagaaatccacctgcctctgcctcccaactgctgggattaaaggcatgtgccaccattgcctggctaccataaaaagtttaataagaaggaaggcccaagtgaggatgcttcaattctacttagaagggggaacaaagtagaaaactgactttttatgtttatgttatagccttcaatttttctggaatttatttttcactaaagctgtgttctaactgtgttttggttccatatggaaagtcaattgcccctgtccaatttgtttaaaaaaaagcatgttctttcagtgttgacttaccactgaacaacagataatgccagttttccacaagtctctttcaaagtgcttgattctattatactgatctctttctttttatatcaatagcatattatcttacatgaagtgctatgatgagacttgatatctagtcttggtacacttttttctcaaatctttctattatgctttagtctatttgctaaacagaaatactgattggtctttcaataaaaccttttctgggattttagctgaaattgcaagaaaaggaaaactaaactaaaccctggctgttctttcattgaagaacaagaatctctttttcaatgagtttcttttttttttccatttatatttgctctatttcttttatgtcttttaacaattcttaaacttttctttgagaaaaagtttgctaaatatttagagaggccttggaaggtttccactgtaacaaacgggattttacttttattctatatagttccattttctggaactagtaagtgatttaaatttgaactagtaacatgattttttttcttttttagttacaataaaaacttcctagtcatgtggtctttttttttaaagccagtttacctcatttccctgtttttataaaattgattgtatgtatttattaattggccatagatcatggaaaatacataggaaaatagtagggaagagtggggggaaagtgagcatcttggttccacccagattctactgggttccacccagtaactgttcctacagtgtgtcacatcactagataggccatgaagaacaggggctaacaatacagtaggcttaagtttagtgtcctaggagaagcccagaaggccacactctatcggtcattcaaagctgtatgatttgagctagatcatttaagccctctgtaattaaacattatatttataaaatgatgataataatgctcatctcagaaaaatgttgtgagcattaaataaatgtgtatgtgcatgtgtgcatgtgcatgtgcatgtgtgttgttaaaatagagcctactccatattaaatgctcaataagttttaataaaaataaaggaacaatatttggatcatatttttgataatcattatttatacatatgactgttttaatcttcaacttctaatatggcaggtttaggaaaaatttccaatttgcactatttatcatcattataaggttaacagtcctttaattttgtggttctttggaattgctgtgcatcttgcagctatcatattgctttcagatgtgataatactgcatatggagtctagaattaactgctgatgctctgatctcttgtgtgtttgttggcttgcttacttgcttgctttatttatttttgacattgtaatgataccaatgacataccaaagtgtactgggaggagcccaggaggcctcaccctatgcaaagaattataggtatctgaagaaagctgggagggggagaggtgttctaccccagggaggagcacaccggttggttgttcagtgctaaatatcagccctgaaaatgtattctaaggtgtttaagtgaactatatacctctataaatcttcagtaaggtcatagaatgattcaccattgaaaagagtatcaataatgtaagtggataggcaatgacttagaaaaccgtggaattgacatcacatttacatacatgggaggccatggtgcccttgaacatagcaggtaccattatctattggaaattacaggccataaactctgaactaaaactcaatagacatgggaagagttctgaatacaaaaagaaagatgatgcaaatatccaattaaaagtgagtacatatcatgcatgtccttttgggtctgggttacctcactcaagatgataatttctacttccatctatttgcctgaaaaagtcatgatcttgtttttaatagctgaatgggattcaactgtgtaagtgaaccacattttctttttttttccatttttattaggtatttagctcatttacatttccaatgctataccaaaagtcccccatatccacccacccccactcccctgcccacccactccccctttatggccctggtgttcccctgtactggggcatataaagtttgcaagtccaatgggcctctctttccagtgatggccgactaggccatcttttgatatatatgcagctagagtcaagagctccggggtactggttagttcataatgttgttccacctatagggttgcagatccctttagctcctttgctacattctctagctcctccattgggagccctatgatccatccattagctgactgtgagcatccacttctgtgtttgctaggccccggcatagtctcacaagagacagctacatctgggtcctttcaataaaatcttgctagtgtatgcaatggtgtcagcgtttggatgctgattatggggtggatccctggatatggcagtctctacatggtccatcctttcatctcagctccaaactttgtctctgtaactccttccatgggtgttttgttcccaaatctaaggaggggcatagtgtccacacttcagtcttcattcttcttgagtttcatgtgtttagcaaattatatcttatatcttgggtatcctaggtttggggctaatatccacttatcagtgagtacatattgtgtgagtttctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctaggttctttccagcttctggctattataaataaggctgctatgaacatagtggagcatgtgtccttcttaccagttggggcatcttctggatatatgcccaggagaggtattgctggatcctccggtagtactatgtccagttttctgaggaactgccagactgatttccagagtggttgtacaagcatgcactcccaccaacaatggaggagtgttcctctttctccacatccatgccagcatctgctgtcacctgaattttttatcttagccattctgactggtgtgaggtggaatctcagggttgttttgatttgtatttccctgatgattaaggatgttgaacattttttcaggtgcttctctaccattcggtattcctcaggtgagaattctttgttcagttctgagccccattttttaatggggttgtttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttatcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacacgataacaaccagttgtgccagcaccaattgttgaaaatgctgtctttcttccactggatggttttagctcccttgtcgaagatcaagtgaccataggtgtgtgggttcatttctgggtcttcaattctattccattggtctacttgtctgtctctataccagtaccatgcagtttttatcacaattgctctgtagtaaagctttaggtctggcatggtgattccgccagaagttcttttatccttgagaagactttttgctatcctaggttttttgttattccagacaaatttgcaaattgctccttccaattcgttgaagaattgagttggaattttgatggggattgcattgaatctgtagattgcttttggcaagatagccatttttacaatgttgatcctgccaatccatgagcatgggagatctttccatcttctgagatcttccttaatttctttcttcagagatttgaagtttttatcatacagatctttcacttccttagttagagtcacgccaagatattttatattatttgtgactattgagaagggtgttgtttccctaatttctttctcagcctgtttattctttgtatagagaaaggccattgacttgtttgagtttattttatatccagctacttcaccgaagctgtttatcatgtttaggagttctctggtagaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccattttctttgatgttggctactggtttgctgtagattgcttttatcatgtttaggtatgggccttgaattcctgatctttccaaaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcaagaattttattgaggatttttgcatcgatattcataagagaaattggtctgaagttctctatctttgttgggtctttctgtggtttaggtatcagagtaatagtggcttcataaaatgagttgggtagagtaccttctacttctattttgtgaaatagtttgtgcagaactggaattagatcttctttgaaggtctgatagaactctgcactaaacccatctggtcctgggctttttttggttgggagactattaataactgcttctatttctttaggtgatatgggactgtttagatgatcaacttgatcctgattcaactttggtacctggtatctgtccagaaatttgtccatttcgtccaggttttccagttttgttgagtatagccttttgtagaaggatctgatggtgttatggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttacttcctttttttctagggcttttagatgtgttgtcaagctgctagtatgtgctgtctcccgtttcttcttggaggcactcagagctatgagtttccctcttagaaatgctttcattgtgtcccataggtttgggtacgttgtggcttcattttcattaaactctaaaaagtctttaatttccttctttattccttccttgaccaaggtatcattgagaagagtgttattcagtttccacgtgaatgttggctttccattatttatgtttttattgaagatcagtcttaggccatggtggtctgataggatacatgggacaatttctatatttttgtatctattgaggcctgttttgtgaccaattatatggtcaattttggagaaggtccgtgaggtgctgagaagaaggtatatccttttgttttaggataaaatgttctgtagatatctgtcaggtccatttgtttcataacttctgttagtttcactgtgtccctgtttagtttctgtttccatgatctgtcctttgaagaaagtggtgtgttgaagtctcccactcttattgtgtgaggtgcaatgtatgctttgagctttactaaagtgtctctaatgaatgtggctgcccttgcatttggtgcgtagatattcagaattgagagttcctcttggaggattttacctttgatgagtatgaagtgtccctccttgtcttttttgataactttgggttggaagtcgattttatccgatattaaaatggctactccagcttgtttcttcagtccatttgcttggaaaattgttttccagcctttcactctgaggtagtgtctgtctttttccctgagatgggtttcctgtaagcagcagaatgttgggtcctgtttgtgtagccagtctgtaagtctatttctttttattggggaattgagtccattgatattaagagatattaaggaaaagtaattgttgcttccttttatttttgttgttagagttggcattctgttcttgtggctgtcttctttttggtttgttgaatgattactttcttggttgttctagggcgtgatttccgtccttgtattgcttcttttctgttattatcctttgaagggctggattcgtggaaagataatgtgtgaatttgtttttgtcgtggaatactttggtttctccatctatggtaattgagagtttggccgggtatagtagcctgggctggaatttgtgttctcttagtgtctgtataacatctgtccaggctcttctggctttcatagtctctggtgaaaaatctggtgtaattctgataggcttgcctttatatgttacttgacctttctcccttactgcttttaatattctatctttatttagtgcatttgttgttctgattattatgcgtcgggaggaatttcttttctggtccagtctatttggagttctgtaggcttcttgtatgatcatgggcatctctttttttatgtttgggaagttttcttctattattttgttgaagatattagctggccctttaagttgaaaatcttcattctcatcaattcctattatccgtaggtttggtcttctcattgtgtcctgcattacctggatgttttgagttaggatccttttgcattttgtattttctttgactgttgtgtcgatgttctctatggaatcttctgcacctgagattctctcttccatttcttgtattctgttgctgatgctcgcatctatggttccagatctctttcctagggtttctatctccagcgttgcctcgctttgggttttctttattgtgtctacttccccttttagttctaatatggttttgttcatttccatcacctgtttggatgtgtcttcctggttttctttaatgatttctacctgtttggctgtgttttcctgcttttctgtaagggcctgtaactctttagcagtgctctcctgtaattctttaagtgacttatgaaagtccttcttgatgtcctctatcatcatcatgagaaatgtttttaaatctgggtctagattttcagttgtgttggggtgcccaggactaggtggggtgggagtgctgtgttctgatgatggtgagtggtcttgatttctgttagtaggattcttacgtttgcctttcgccatctggtaatctctgaagctagctgttttagttgtcactgttaagagcttgttcttcaggtgactctgttagcctctataagcagacctggagggtagcactctccttagtttcagtgggcagagtattctctgcaggcaagctctcttcttgcagggcaggtacccagatatctggtgttcgaaccagactcctggcagaagttgtgttccactcactagaggtcttaggatctcgtgtggaatcctgtgtgggcacttgcaggtgtcaggcgactccgctggcaaggtatcccggggctcgagtggagcggaagggacttgtgccccagatcagacccgggtagcctgcttccctatgtaccgcagtctcagcttatgtgcgattggattggggcaggcgctgtgttccactcaccagaggtcttaggatctcgtggggagtcccgtgtgggcccttgcgggtgttgggcaagactctgctggcaaggtagcccggggctcgagtcgagcggaagggacttgtgccccagatcaggcccgggtagcctgcttccctatgtaccccagtctcaggttccgcgcgattggattggggcaggcgctgttgaaccacattttctatattcattctttggttgagggacatctgggttatttccagtttctggctattacaaataaatatgaacatagtggaacatgtgttcttttggtatggtggagtatcttctgggcatatgcccaggagctatatagctgggttttcaggtagaactatttccaattttctgaaaattttatagattgattttcagagcagttgttcaagtttgcaatctcagcagcagtggtggagcattctcctttttccacatcctcccagcaagtgctgttcctggaggtttttttttttttttttcatttaatcttagtttttttgattggtataaggtggaacctcagggccattttgatttgcacttttctgatgactaaggatgttgaatatttctttaagtgcttccttatcgtttgagattcctttgttgagaattctctttttagctctgtaccccatttttaaattgggttatttggtttgttggagtttaatttcttgggttctttatgtatttggaatataagccctctgttgtatgtagggtaagtgaagatcattttccatcctatagaatgctattttgtcctattgacagtgtcctttacattacagaagtttttcagtttcatgaggtcccatttatcaattgttgatcctagagtcagatccactggtgtcctgttcaggaaattgtctcctgtatcaataaatttgaggtagaacactcataccccacagacccaaggaagttaagcaggaaggaaggcacaaacaacgatgcttgaatctcacttagaagggaatataaaaagtcataggaggcagagaaagaaagcaaactgagtgagagaggagataggaagggaaaggggggctcacaaacaggtgtagggagagagagccacagggataactgcagctgcctagggtctaggtgtgcggggaatctctaggaagctccagagacctgggataggttcttaggagtcaattcgggtgatcttatctaagaaccctaacagtgaggacatgaaactagaagaggttaccttctgtagtaaggatggccccctgtagagggataaggacacaaactcacacacaaaacttatgacccaaaatttgttctgtataaaagcaatgcaggcacaaagatggagcagaggctgaaggaatggacaaccagccaataaccgccccaatttgagacccatcccacaggcaaccaccagtcttggacactgttaatgctactctgttatgcctacaggaaggagcctagcataactctcttctgagaggctgtacccagcagctgactgaaacagaagtagagacccacagctaaacattggagagaggacagggactttatgagagagttgtgggaagagttgaaggccctgaaggggataggaactccacaggaagactaactcaacagagtcaactaacctggacacttgacaggtctcagagactgagctatcaaccaaagagcatacacagactggactgacaccccgggcacatagggctgccttgtctggccacagtgggaaagaatgtgcctaaccctgcagaggcttcatgtaccaaagtgggggatacccatggaggggcccaccttctcaaaggacaaagagaggggttttgcagtagggactctatgaggagaggccagcatttaggatataaataaataaaattcaaaaaagatattttagacttatctatatgatatttttctatatatactgatgtgagcttttagaacgtgtgattaaatgaatgaaaatgagcttactgatgtgcagtcttgctgtaagaaaactagtaagatcgatcttccttaggagggggaacaaaatacccatggaaagagttacagagacaaagtttggagcagagactgaagggatgaccatccagagactgccccatctggggatccatcccatatacaaccaccaaacccagacactattgcagatgccaacacgagcttgctgacaggagcctgatatagctgtctcctgagaggctctgccattgcctgacaaatacagaagtggatgctgacagccaaccattggacagagcacagggtccccaatgaaggagctagagaaagtacccaaggagctgaaggggtttgcagccccaaaggaagaacaacaatgcgtactaaccagtgccctccagagctccctgggactaaaccacaaatcaaataaaacacatgatgggagtcatggctctagctgtatatgtagcagaggatggtctagttggtcatcaatgggaggataggaccttggtcctgtgaaggatctatgccccagtataggggaatgccagggccagggagtgagagtgggtgggttggggagaaggggggggggggaagaggggatagcagattttcagaggggaaactaggaaaggggataacatttgaaatgtaaataaaagaaaaataattaaaaaatgagaaaaaataaactagtaagaaggtatattgatatatatatctcaacatatatatatatatatatatatatgtatgtatgtatgtgtgcatgtgtatatatgtaatatgtatatatatggagatagatatatgtaatgatagaaagatagattagatacatagtaaatagatagatgtacaaatatattaatcaaaataacttattaaagcaattgtgagcattaattgggagagtttgaggggcacagttaggacttgtgctttttattatattctttgtatactcattatgtttttcttctcttttccctagttctgatgcacactttcttctttcttatatttgtaactcatagacccagcctctgatggtagctgactagacaggtgattattactttgattttcacgtgactgtaattccactttttcttttattcagatggtgagcttccttaagtagtaactatgttgtatgtttgattatttttgttttgtatgatatttctcagtggaagatgtgttctttagtctgattatttcttcttttatgagaagttctgaagtgttttcttgcattgggctttgaggctgctatccagagatgtgactcatgtcaactgtttgaaatccctgctccatggaggtagtgatgttgtttacttgagcacatctggcttggttcaacttgacctctgaggctgagccagctttgtacactcagaccttttttcacctggtgacttcattttcaaaaagaagaacatttaatgatcagtccctcttgaacaggagggagccatcctctagtcttcagcctacttcatgttgcgtgaacaccacaagccactgttcctgtagaagcagcaattctgttgagctgggaatccagagagcttgacagctcatccctcatcttttagttccagcccatcacttaccacaggttctttattatgttttcctcctttcagactcagagatgggatcccaggttagaagccaatattaagatttgaattttcctgcatttaccatccattagtattatgagttggagcaatgctaccatgcctggatgttaccctttgtttcccacctggcagtcttggtagtgttccctgtatgactactttgctatgcatgtcacctccatgttatgagatttccttgcttcctgttaaacctaggataagtgaaaatgtcttatctgttctttactcactcatctgtgcctcccacatctacaaagctgctcttaattctccaagcacaccgtgcttcttttcactaccaccaggcttttattcaagtccttttccatctgatatatggccactcctctctggattgcttgtatttaatcctttaattttgttcacttatgtctttaaacatatgttcatatattaattgtgcagtgtaggcttagatttttcaagtcaattttaataagggttcctaaatgcttcaacatcccttctagcccacctactagaggtaggagaaaataaaggttaataggaaactgggagcatatatctgtgttttgaaatagttctttggggcagttccaaacacaaatcagtaatggcagtccacttaaatggacaaacactaataatcagtagcaatggctcaattcagaagaaaccttgagtctccaccaagccaaattgctatgagtccatggaatgagcaagaagcagccacaataccatgagaaattctttggtgcttttctctctaagaagtcacaaagactccaattaaactcatagacaagaagggagcatggagttggacttgtggggaagaagggttttaacaagagagaggcagggataagctagggaaatggggcttcaagagtgctaaaacttgttacctaaatgtaagattgtcaaacaataataaaaatgttttcatttttaacaaaagagaggaaatagatatgagctaaaaattacaccataagatctagttttccaacttctgcaaggaaaaggtttaaatgaaaattagaattgtttggcgcaaagaagagttgggataagagcttatcattggaaccaggggctgcaacaggcttcttaaaggcacagtatacattttctttagaggaattgtattgtcttacaaaatatatttggattgacaaggaaagttcttttggcctttgaaaaagcacatgacttgtttattccatgtgctaggtatgcaagggagtgaacagaaacacttcaaactgaggttttccttactttactagacttaagcagaaattcaggagactaaatctttccttctatactatgtgggggaaatatgtatgtgtatgtgcacttacgtataagaaataggctttcacatataaaaatgaatatgtaagacatacattaaatatatatgctcaaatagttcctcgggaaaaaaaaaagaagtcacgacaagcaaagatcggtaaagatcatcaacgtgttgcaatgggaaccagggctagagcattgcccactgtctgttgggttatactgataccctttccaaacatcatgcatcctctcaagtgtttgcctcagcaaaatatcctctcacatctctgcctcatcaaactatcatctcataagacaacttccagaaaaaaatcacatgaaacaacagtctccaacaaaaccagaaattaccacttcagtgcagcataatgggtttattataagattttcataatttgttttgattatttgcttccaatactctttctcttttcccctccccttctgataattccttcttcccaaataatctggctgccatctcccccagtgtcacctttcctttattcatcactccgtgacctgtctttttcacaccccaacttccatataacatcttataacatttcctactaattgcttttgatcattctttctacatgactaattttctctgtaagaagacttgtagcttactcattgagtcctcagacatcacacctagcacgttgtaaacaccaggcaaatagtaggagactgagtgaagaaaaatatgatatgccatttgctctgttttgtcttgctgtgcagatggcactctgacgtttatgtggtaggggagaacacattgttttagctacaacagtacccatcagaggagctgatgtgatccaaagaaggagaatcataatgtccagagttctgcattatcatgtagtataggtgtggcatgctacatggtctctctaagcctggagtggttgtgggtccatggtgattccatccatcttgatcttgtctgtcccttagattggtagaaggaaatgttatctgaactcagaggctctcgagaatccaatctgcctttttcctctgtgaagaagttctggttgagtatacttggacactggcagtgaccctggacatagccagtttatgctgaaggagtcacagtctaattactgaccacgagaaccgctgtgtagcctggcttttaaaatcatctttcatggaaagcttttttgtgtgctgaaatttttgtccatcctactttgcctactttgctattcaccattttatttgcaatgtagttaaaaacatttgccatttatgtataggccaacatagtgatttcataaaagtcaagaaatgagggttcaaaaatcttttgtcattacttaaaattaatcatttgttagtaagaacacaaagataaggatgctctgaatagaactcaaagcaaaatatgcacagagaaaactctaaaaatgccacagatattcagggttcacgtagtccccagatgaacccagaatcccatggagtaaaaatttatatttgttttatagcagaggctttatatataacatatccatctatataaacaaatatatattaataggagtagttacaaactgttatagtgtatttcatagtacataccatctatcagatgaatagtcattgtaaactctggagtagaagacttctaatatcagcttcataatttgtctttagaattgaccatattgtttgccttcaaccctaagtagggagtctgagtgcctggtaacagcctcagcagattccttggaggctagggatatataatgctttggcatgaaaaagtaagaaagctggatttctccttgaaattgacaacctaaaggtagtaccactattggtacaaaggtggaaatgacagtcttcctagaaccagaaattgtgcatcctctctctctctaaccttggcagtgttgagacatcttaactgaccccgtgtgtaactctttcttcctccagtgccttcttggtagaactggaactctagattaagtcagcatcttctaaaacctctctcattagttgtgtcacaatgtgatggtcagtctggaaggggactcttgcttgatcatcttctccccgatgttcagtctccatacatgctacagcagactgagttatatgagtaattaggaaggacatattgatagtgtgtcaattctgaggagaattcatcacggcattgctatttccacctttgtattttagataattctgcctcagagttcaagagctcacatgccatgaggacactcaagcagtgctgagaggaacagtcaacaatggctcctggaccacgtgagtgaagcatcttggcagtagaatctagcccaaggtgagtcgcgaaggcctatagttttggacaaaattttactacaaacctgatttaaaatgtttagccagaatcaccccaaattcataatgttcaggcaccatgagggataaaaatgcttacaactgtgtatgccactgggaaggctgtaattcccatgtttgtactaatggtagtatgtactacctttaggttgtcattattagtttgtgttaatttattatgtggtaatagataactaatacacagtcattattctttctttgtctacctaccataaactatttcacactttctttgttctcattttgttaacgatttttacttaaagattgttggtaatgtgaatacttaaggtataccatatagtcctatggggtgcgaacacatgctcatgttcatgtgtgtgtgtgtatgtatgtatgtatgtatgtttgtatgtatgtatatatgtatgtagaaatagacctctaccaactaagctagattcatagtcccacaattttattttaaaaatattttggaatgacttaattctaagaaaagaaatccagtgataaggaatgaccaattgtaatttctttttggtggactccttggaaattgagttataggtggttataaaatgcctcatgagttttgtgaattgaaattgaacttggatctgttggaagtgtaatttcttttcttttttattaggtattttcttcatttacatttccaatgctatcccaaaagtcccccataccctcctccccaactcccctacccacccactcccacttcttggccctggtgtttccctgtactgaggcatataaattttgcaagaccaatgtgcctctttttccactgatggacaactaggccatcttctgatacatatgcagctagagacacgagctccggggtactggttagttcatattgttgttccacctaaagggttgcagatccctttagctctttgggtattttctctagctcctccattgggggccctgtgatccatccaatagctgactgtgagcatctacttctgtgtttgctaggcccaagaatagcctcaaaagagacagctatatcagggtcataatgaagtactactcagctattaaaaagaatgaatttatgaaattcctaggcaaatggatggagctggagggcatcatcctgagtgaggtaacccaatcacaaaagaactcacctgatatgtactcactgataagtggatattagcccagaaacttagaatacccaagatataagatacaatttgcaaaacacatgaaactcaagaagaatgaagaccaaagtgtggatactttgccccttcttagaagtggaaacagaacacccatggaaggagttacagagacaaagtttggagctgagacgaaagaatggatcatctagagagtgccagatccatgtagatccatctagatccatcccataatcagcctccaaatgctgacaccattgcatacactaccaagattttgctggaagtgtaatttctgtttgtataaagtaacactgtcttgtgaaatcgatgaaatggcccacccaactttaaaattactgttgctaatataattcattgcgcatataaaaagatgtgcagatgataaagcctaaccctactccttgggttcttgtattcattgctgaatcaggcctgcaccaggattataagttctacatatacagagcagtacactgaaacatggagatgggaaatacctagccatccttagcagagctgattttatagctgcttcttccaattgggggccccaatgggtcttcattcaatgtacttccctggagtttgcacccagacagatccagggagaatatgccagagcttgaagaaaagactggaatggcttgaagatctgttgcacattactactgaagttgtagtttaccatgtctggacagctttcttgagcttggtgcaaaatggaggacactcgtagcagggcttcctcttctcagtctgatctggggagcatgtaaagaatcccagagcctgagaacagaaggatgaccagcttgttaagcagctgctgtgcccaatgcagatagagaagctgcattgctatgcttatcggagtctgagctcagcatttaagtctgttgcttggcaaatgaaagaaaacacacaaatgcatagaagcagaaacacacacacacatacacacacaatcacactacagtccacatgtgatatcaagtgcatctcagaaaatttcccagcgtccagtgagatgctcagatgtggtattcaaatgaacactctctagtttctcagccaagtctccaactctgccccccccccactatattacaaatacctcttagctcatgtacatcttgaatttgtcaaggactaattacaggaaagtatattttgagaggtagaagaatgcatggagccttgtgattctttccttgaggagagtaaaatttttatgagtgttgaatgacaaaacattcagaccagatggaaatcaaacatatccaaccatgttggagaaggagtttgctggctatttctagatgagaaaaaaaaatgaactcctgtttctcagttgtttgctttaaacagttatcttaaaattgataacattttctttggtattttttataggtcctgaaacaagagatttggaagttgagatttttacatccatcagaggcacagagggagcacagactggggcagagagggaaccaaggcatgactcaagggatgctattgagtcatagcagacagagactcttcaaccttgtaaatgaagtcatgctttgtctgcaatcagagaaagtacaaatgcctggttttgatttctttttcttcttttattagctttaaaatgctaactagatccccctcttccagttcctcactttacctcccattaggtctggggctcaattccatttgaaggaggtagagatctggcaataagggatttacttcatgtttcacatttgagtccactttttacaacttgcttgtaaagttctgagagctggtctagtggcggaaaggctgaagcagtccaatgctaaatgtagcactctaagctcctcgcctctttctgacatcagaaggcaggggtctttcctagaggcaatgcaggctccttgttatttcttatgtcagcacatatgtcttttctgccagatgtcagacccagtgaatcacaaaagcaaagcagctggcttggggcagtgggtagccatggagagcagaggtagaatcaacgccttagtagccaggagcaggagccattcagagtctactccacgggtaagaccttggagtttctgcttcttttttctttctttttcagtgttgatatttggaggtgatagatgagaggtagtgggctccttgtaatgttccttacccatgtggagtataagaatgaatttcaactatggtcccttgcacataattttgatagttctatttttaatgtagtatttaaaacctctgattttgagaagtaatttgaactaaacagataaatgcaaagagatgccaatggaatatgaagcttcatctgcttaaagcagataacattcaggaaaacatacaatagtctgaattccacccgtacatctcagacattcattcctcatagctgccagacctttatcttcaatcactgaaaggatttattttttataaaaatttgacgaaagagttcatatatatgtactaattcaacagaggtctatttttttaattatacatcaaacatgatttttggttcttgaagtccctctaaaactagacaagacatacattcttctgttttgatacttatttccaatctagtgttatactgttgtacaattaattttgttaggaaggaaaccaagtgttgatgtaattacaaagctaacgtaaggagtggtgatcttcagaccgcatgggaaggaaaagtttctcccctgtggttgatgtcttggaaagagaggagtaaagactttgcaggtgacattgatgtgtgacagtgagagtcactttttcagtatttatccatgtaataatttacctatcatctaccagcaactatatgtctatctaactatcatcagtcaatcaatttttttcataccagtctaccaacatctatttgtctaccatctctatctatctatgtatctatgtatctatctatgtatgtatatatgtatgtatgtatctatttatctatctatctatctatctatctatctatctatctatctatctatcatctatctatctatctatctatctatctatctatgtatcatctatctatcacctatctactattcatacatctattatctatttatctatcatctattcatccatctacctatctggtaggagttatgtaggctgggtggatatgaagataaacactttaagccaagttcctacttttgtgcatgtcctatgagtgatgtaataaaaaactaggctaggttaaggaggcttgtttagataagatggtttttagaaggaatcctataagaagaaggaagtgaagaagcagccttcagctctaagctctgtagggaagacaggtctgtaactagcatttttagcttcataaaagcatgattttcttcatgaaatggtatgaaacaggccaccactatctcgagtgtgtttgtgtgtatgtggggggtggtgagtagggtggagagaggcatcaaatcttttcaagacaagagacagaaaaaacaaagctctgtctgagttgtataaacaaggatgatcagaggatcttgaggctacatgttaaagttccgctgccattggagaatcttggacgtagtgtttatgaaaagaaaggacccagccagggggaaatttgtctgtgtttgggacatgagcctctgttaattgtaccagaatcagtcacagctggatagatgatttcacatttcagtagatcttttttggtctaggtcaaagacagaatgctactaaagagaggaggactgatgagatcatcaacagccactaaaatggaggagctagagaaagttcccaaggagctaaagggatctccaaccctataggtggaacaacattatgaactaaccagtaacccctggagctcttgtctctagctgcatatgtatcagaagatggcctagtcggccatcagtggaaagagaggcccattggtcttgcaaactttatatgcctcagtacaggggaatgccagggccaagaagtgggagtgggtgtgtaggggagtgggggggagggtatgggggacttttgggatagcattggaaatgtaaatgaagaaaatacctaattaaaaaaaagaatttaaaggaagagtgggtgctatagcttaacttattaccagggcctggcaactgtattctgtccccataaaagactggtattgaagccatctactatgtagcttggaaagaactaattcagaacagaattctgaacctggctaagataaactattatagtgtaagcaggagtgtacccgtttgtcctataatgtctttggaatggttagacttgaataaaaaagaaatagtagggttggttgaaaaatgcatctatttttttttttgtgtgtgtgggtcttgtggaattgattctttcttttcaccttgtaggatccagggactaaacttaagatgtcaggtttggtggcaagttcctttcccactgagctatatttttggtctcagaaggcagggttgacttttaaaatgattattaagggaagcaaactattcaagactaactttggcaatttgcagatctactccaaacactttgtgctcttaatgacaaaggccaagcttctacagagggaagggatggtgggtggagtctcagggatgactttcctttggtttacattttcagaaatagcttctgaatctgttggtgctttaatacttcctgaacaacatgatgacacaaaggccattaatccatgccatttctaatatcttagcaagacattttaaatttaaaatatgttcatggttgctcagggccaaattcaagtttgctacggtgatccttgcgcacctggtattaatattttccatgaatatgtctgtatctaactgctagacttttcctctaaaatacctacacttctaacttggccaaatatttggtctagagtctagttgtggtattaccctgtggttacttctgtgaccatttctcttccatccttctgttttcctgtgtataattagagttccttgttgaaaaccttcagtctatctttcttgccttaaaaattacccataatcctcctctctaagatgtgtgtaatgaccaatgtttcagagaaattgtcttaaggatgttcatctgaactgtgatggggcccccagtcccagtgtgtccaatctataccaatgccctaaacttatcttgtttcttcaagtagcctctatttcttttcctattactagattttgaatttcttgagaacaggtacctatttcttgcaataggtacaaatgccagttactaatggcactatgaagcagttaaaacactatactgttcatgctaacttggcatactcacatgctgtctaagttcactgtcttcctcttgcaccactcacactgaggtcgacagagtttattcagcattttcatggtcaagaataaagaaatcaaaaggtagaacatgaacctagaacaatttgtcatcaatatctttgccttttctttcttcatctttgaaataactgttccctgattccagaagagagaaaatagaccagttgtggtcttgccttgatggaatggaagacaacttaacaagattttataaccatcaacactctcattattattgactcttcttccaagctatgaccacttatctcaggaaattctctgttgatatgaaatactggaatactatatctcagagtagaataatttctaccctgttgggtagaataaaacataatcacttctaaatctatgaccttgggatagtctctagttagtaataatagttttgacatctggataatatttcacattagacaaaacactttcatggaacatcttatgtggtctcaagtagcatcctttgggatgaggctactgtttcccagagcagtagaactggaccaaagatgatcagagtgagtggaagaaatgcttgggatcaaataattaattctaagatccttcccacaggcatgttgtctattgcaagggagaaaaacattggtctgcagggcagttttgtgcatggtgggagttgtttcttttaacgagtgtgtaggtctcaacctaaagctatctatgacagttatagcgtcttactcaggtcaatattcctgaagaatgacttttcttttgggaaaactcatgcttcagaatctttcttaatcatataattgtacaagcttcctttttgtttgtctgttctatttctatagacaatttctctatatctagagataccagaatgctgattcttacctcaaatgtttcatgtctgggttattcttcctgacacatggatacaggccatgagactctgacttatgtagtccagagcagccagcgcagctcagtcaggagaacatttactccaggactgtggaaagtttggctttgtgctaagtgtaagcagatggtcccagctgctggatcatgggtccatatgaaactaatcattcactctacacaaacatgcatcatcagaccacagtctgaaggtacaaccaacttatcctgcttctcataatgtggtagtagaagtataaaaatgtgaagcactaggcagagtagtccatcacagggaaaactggtttgggagggtaagaatataatgttgggctaaagtgttgagcgaattatgatattaagactggttctttaatattactagggcacgttcaatcctgaacacagggaatataaagtctaggagttaaggtgacttcctcatgcctctatttgaatcaaatggctcagtcagggactcattaaaggtcaaaatgcctagtctagtacttgctgtgccatgcaaggcttctgagatgtctggtatttcctatatttttagtcctagagattgggggtgactttttttttaaactagaacctctctagaaaatattgtaattaattccatttggtattaatattaggcagatcttcatacaaacttaatattgaataaaataattatgtttaacttccatattaaaggaatagaaaattgatacttagaaatggttaggtgcctaaggacataggacagagttggcagtctgaatatacatcaaagcagatttggtttaaaggaactagggaataacatcgaagtatctgatttatcagcagtagaatagctcctgaccaacaatgatccaatagaagaaagtagtaagtctaccaaagtggtatacatgacttagaaggaaaatggaaaattattcaactcctttgaggaaaaatgtaatagtctagtcagtcatacaaatgtagtctcaaatttggcacaaaacaccaagtgttctcagcacaaaggatatatatatatatatatatatatatatatatatatatatatatatacatacatatatatatatatatatgtgtgtgtgtgtgtgtgtgtgtgtgtgtgtgtgtgtattaccccagatggacaatgagcagagaataagagatgataatagacatggagaatgagggagaagggaaaaggaacaaggcaagtgtatttgtactggaagtacatctggatagacatgaaaccccatgttaggatgaattgattgattttgattgggcatgttaaataaggcagccaaaggggagcttttgattgttggacttcaatattttgctataccttggtagtcagcctcaggaggagtaagtgatcaagtaagggaataggcctttgtggatagctttagtgatgtaatctaatcatttaggaaggaagtgggcatgggattagtgtaaggcctacctgagccatgtctgccatgctcctactacagtcctcacattttacttccatattgaagcaatttctaaatggatgatagacaaatggaacacagttagaagccacatgtgtgttggaaggactggtgcattaccagagcatgggcttcagcacagacattgacactatgaatggagaaaggaaactgaacaaactgtgggaaggaagaatacttggggaattacagactataagtattgctaatttctcaaaatgtcaacaaggaagcttaaattgtgagactaaatacacaattctgaagggctttgagtgttttgttaatgggtttgaaactgttctctaagggtaattgtgaaaacttttgaaatgaaagtgtgacatgaccaacacagaacttggggttaggttcacagctaatgatgaaaaattccaaatctgactagcttgaacatagtttatttagttttcaaagaaaagtatgcatttgcatagctatcactgatataaatgagaaattctaggtttttccagtcatccctggctgtaacatttaaactcaaattccaaagatagtcagagcaacaagatggaagccacaataagatacttaaagataggtgccaatatattctttcaaaggggttaccagagacatgtgcaaagtagtgctgactttgtccccttccttgggacttagtcacacgtccatagcagctataaaggcacttgcagaaaggcatctttactctgggcaattgtgggcccatcaaaacacatgacattgtgattttctagaaggatcagagaaaagatattaaaaaacagtagtcatataatttaaagagctggcttcactagctgtgatggctattcttagttgtcaacttgactatatctggaatgaactacagtccagaaatagaggagacacctgtgacccagatcttgaggctggaagacacatgcctttagtctagattttgaggcacacatttaatctgggtcataccttctgctggaggccttcataaggacaatggaaaaaggaagggttctttctttacctacttgcactttcttgccaacacatcggttggagtctagttcttcaggattccagctcatacagaaggccattgcatactgaaacacctagtctgagggattgggcgacaacttgattcttgggcttcccattcacagatagtcattgttgggttagttagactgcagcctataaatcattctaataaattccctttgatatatgcatatatgtatatgtggagagagagagagagagagagagagagagagagagagagagagagagagagagagattcattccataaattctataactctagagaactctgactactacactacccatgaacaaacaggcaaagaagtagggacagactgaagatgggaacccagggctgatagtagtctgatgctagggatgtgccttccttttcaagtcacctaggctttgtccaattaaggaaagtgatttctgctttgtttcttcactactgagtcagaggaagttaggtgtctattttaataaatgagtcatacttatttggcaaacttgtctggatatgctgatggtatgcacctggtttggactatacccttcattgacaaaactttgcttgttcattgtacttttgacctccaatagttagaatagattatttactcagatttttctctcaagccactgtaactaagaggaagtatctatgtatctcatcctgttcaccagagagaaggttctttatcagttcaatatttatgccaatgtgagttctagagccaaaacaaattaaattcaaatctctcctctggaactatcctggaatgtcagatttcagttagtgttcttcataatgctatatggccacctcttgtgatgcaaactctctggcgatcctctctgacttttatctctcccacaagctcttcactttgaagtaaaggggaacagtggttaccacagtcttcttaagtgatagaagactaaacttaagtgtagtcttggtctctgactatactcaccttgccatgtatctctttgtatacttctggtaaaaatctgttccgggaatgacagataatctcacacatatctattactggctcacagtaaacctatgtttgttttctgtccattttctcctctgttgtgcctgtgccctgtctttaaaatcacgcaccgtctattctactgagtttctcttgggtctgtattgtgaatgcatccctggctagagcattagaaaggatttgaatcactggatattacctattatttccaaggctgtgatataacatacattgaagagcagagatgataaaatcaaatttgtctgaatatagctctttcctttacaagtattagatctgaaccttgggtacatcatttggatcttcagctttttcatatctaaacaatgggaaatagtaaaaaacactgatcaggtatgttcttgtcaggctcatttctgttaatgtttatatttttgatacagtggttgttatacagtatctttaacattaatcttaaggcatggaattggttgggaagttgggagagagacaccacaagtagctattttatgaaaaaggctcactttgtcaaaaagagaagaagagcttcagataggacagaattagcttcccacagctgctggaatagactacagcacagtcagtggatttaaacaacacaagtaaaataatttaaatcaatttatggctctgaaggtcagaaatctaaaatgggtagtagagatgaatttctgtatcagtaaggaaaccttactttttccaacttgtaatgactgcctacattccatggctcatggccatacattactttgatttctttttcacagctccatccccctctgactctgtttttacagcttctctcttcaaaggacacctgagtctacacttggcacacctagcttattcagagcatatctcaaaatgcttaattttatcacgtgtaagatagtatatattgatgttcatagatgttggctctctctctctctctctctccctctctctctctctctctctcactttgtgtggttgtggtggggcagctgtgtgtatggatagggggcagctgtgtgtgttagggtttagtggagacatttctctctctctctctctctctctctctctctctctgtgtgtgtgtgtgtgtgtgtgtgtgtgttgctatttagcttaccataggtgtagcagagttatttgactttcatggactgacactaagattaaactttggaagacctgttgccatggtgatagaaatgtaatttgaatgtaagtgtagaagggattgggatgcagaagattggtggaaaatgaactgtgggtcgggtttcaagctgggggaggagagactacaatgaactaaaaccattgggacaatagtaagaacaggaaggagctgattttgagctttggctagagagactaagatggatgagttagcaggacttggaaaacactctggaggttattgacataaagggtttctggaaaattctcctgggaagccattctttttaaagcagaagatggctttatcttgaacattgccttctacacatcaattattcttaacatatatttaatatttttccttaagtagacatgaataaatgccttttcttaagtaattactttgacagaaatcatgactctgatatgcttggacattttgaacacacaaaattgtaagaatttattaaatggaaatatatctgccatatatcacttaatgtcttcctaaccataaccacccatgatactacatacagatatatactggtgtgataacaagaacaaaaatgaaatattcaaacctagattgctatagtcatcagctctccctaggccttcctttcatcaccaaaatagagagacacgacttactttcttacaattattcagctgcatagtctatggaagttgacaggtatcctgctctacagtgtgaacacacacacacacacacacacacacacacacacacacacacacacacatttgttcattgttaagcttgtaatgattttttcttatatgtttaaaataatgtaaaatcttttgatgaggtccattggtttgttctgataaagtcattaaaatattctgagttgttttaatctaggcagtcaatcacattaactcagcattcctcgtgatctttttaatcatgtacctctatagcatttagatagtggcatgtggcctaaacaaacagtttctcccaatcgattgtcctgagacaaacttgagtttggaaatgatgggtttgtggggaagaaaacctggctttcttccaagacttaaagtgggtgtttgagatggcaagcaccactgtttactgggttatatttgatgcatttttctgctcatgtctctgggaaacattgccttgcaatactagctcaatgatctatttgaactcaccggaagtctacaggacaaggtcaattgggtttaaagcttgcattcatgcacacacacacacacacacacacacacacacacacacacagagagagagagagagagagagagagagagagagagagagagagagagagagagagagagagtgacagagcatgacagagagacagggagagagagaaagggagaaagaaagagagagcgagacagaaacagagacagagacagaggcagggatatgcatatgtacactagatctattacctgtgctagcagcatctctatcaatggtacccaactctatttaatgtaacagagttgggctcaaaaaccgcctttgctgaagatagtactattggcatgatcttttccttgatgaatctggtttcctatttgaaattggctctcaaacctcataaaatgaagtcttttgaatcaaattttagagattcattagaactaacctcaacaaaactccctggatatcctgcatccttatctcgtggaaccctcatttttcctagatctttcattttcattaagttaactagagccagacttgcaagaataaatcaagttctcccctgaatttagttcatattaataaaaattacaggtcattttcctgtctcagacctttgatttagaatagctaccatttgctgagctctaactatgtgccaaaggtttttacatagtattccattcatcctacaaatcttgcaaggtaagactttttccagcttttcttacagaggaaagagaaaccactgttttattttagatacattatgcaaatttagtctataaaaatcaagtgttttcatttttggtgtttatctatcaacctgggagattcataagagttaatttttaaatgtaatttgatacttaaacaatccctcattcatcctgggcagctattattctaatagttgatattctggtgagagctttactactgccaagggaacttgctattgtttgggtattatgtcaagcacttcacagtcttcaaatatttacaatcacctctagagacaaaggttataatttctgctctttgatcaataaactaatatgctagaatgctgaaaacttgatcaactgcttaagagcatgtagtagttaattcattggaacttcaggcactagcatgaaacatgattttgcaaaggagagaatacatttaaaggttttatttagctctgttcaatcccatcacaatcttttttttaattagatattttcttcatttacatttccgatgctatcccaaaagtcccccacaccctgtcccccaaccccctacccacccactcccactttttggccctggcattcccctgtactggggcatacaaattttgcaagtccaatgggcctctctttccagtgatggccgactaggccatcttttgatacatatgcagctagagtcaagagctccggggtactggttagttcataatgttgttccacctatagggttgtagatccctttagctccttgggtattttctctagctcatcacaatctttactggtagatattgtttctgtttgcactgtgcaaataagcaatggctgatgttgactgtcagattgtcaaattgattagattaagaaataaatgcttaggaacgtagtgatgctcacctctgggttggtttaaaagagaattcctaaacaagattacctgagcttggaagacctgctctaaacatggatagaacaaccctattagctgtaggacttggtgttagagaaggagagaggtgtaaggatgttggcttagatagtctctttctgcttcctgactgctggcaagttgcctgtcctgtcctaccatgcccatgaattgaaacctttgaaactctgagcacaggtagatagtattccattcaacttgcctatatttgtgcttagtcacaggaaggaagtgcatggctaacaaaggaggaagtgcaaagacaccatgaagggaaggggttacttgaagccacatggctattagtggaatctagatgagaagaatcatgatgaccctgtgtagtaatttagaatcctaaccatagcttcataatgctccatatctttgctctgggcatacatttacttgttagaacttaaaatcatcttatgcagccaagttcttttattttcctgtgacatcattggctggagcagacaggaattgatgcattcagtgttagtggagatgggtgggcactgatgcctgggaatttggtctgaatgcaaatggcatcaagaggtgacctgcaagaaacatgcaggtctgtcagaaagcaagtgctgtgtttggcaagaagtgttgtcatagatattggcagaatcatttatggccaggcttatctgaagcatgaacaaatcactctggaatcttctgggacgttgggagagggaaacaataagtcttggggagcaacaggggcatggaggaggctctgctggatgatggagtactgagcagaacagaggggaagttggtgtcagccagttttcttttgaggaatgaagaactgggagtgcgaacataatggaagtgatttttctttaatttcagacacgataataaagaaatcagcatctggaggactcccaggaggcaagctaaggttagctctacattaccactcattgggattattggctctctgctgcaaagcccctgaatctataacaacaggcactaagtggatagccaaaagtagacttgttcccactgtcaggatctttaaaaccatttgtttttaatgaatcagctatcagagatgaattctcatttaggtgtgttgtaatgcagattgccggttcaaattgacatcttgctaattttttttcttttcctttttccttttctttttccttttcttctccttctttttcttttctttttttgagaaattctcttaacttactcccaattcaagtaaaaatggtatattcagtttttatcattgactcgagtatttctgagagaaacattgtgtatctatgataaggaagcattcttctcagaatcatggaagaatatcttcaatgaagggaagggaaatgtgaaggggacacatatttattgacacttacgttgttatatctcattagtcatagcatcagacctacacacttgctattagcagttccagttgtacagatgaagaaaacaattcagaactgcaaattttattgttcaaggtcgtctgattagtattcagtcatcagaatttgaaaatcaatctacttcaaaacatacattttccaccaaatcattctgtagagcctatcagaacaaagtggaggtgcatgtgtaaagaaaatcaggtcagaaggtcaaggcactcaaggagaagcaaacctaaagcattaagatcaactaatctctgaagtccccttgggtttttgacattcattgtagaaagtaaatagaacacaccatgcttggtgtttggtgacttttagctccctcatccaagttagaagagatgaaaaaagacttagttttgctaagaaaatataccttaatattccacacatttctttgcatgtttgtgtggggggtaggtgtaattttctacttattctatagccagtacaacagcgcagaatatgcctttcatcaaaggtattgtgttcaaccctgattttcctctggtctgtccttgtatttagacttgtccgacaccatgtgacagaaatgataagtgagccagttccatgcctgcgtgtgcagtctgtaaaggattcttttccctaacccccctctgtgtgtatgcatgtgtgtatgaatatagtttgtgtatatgtagagtgaccagaggataatttttttctgtgactatcatgggtcaggtgatgacgaccttgtttttagagaccttagtagtctggagcttaccaagtagcctaggctggctcagttggtatggtccacagctctatgcgttcctgccttccaagtgctgggattaaacatatgcaccataatgcccacctttttttttttaaagcgtcttatgatagaaatcaggtacttatactcataaagcaagcacttcactaactgagctgtctttcaactctgcacttctgtttcttaccctttcctgtatccatgttgtgctatgggaacacaatccagacaaaatactggtggagtgcaaaacacatcgacagtaacacaaaaaatatgagctgctagtggaaccagtctaactcctttcttgtgagggctcttagaagaaaccagaagtgctgaccagctaagtcctcctgaaatcatggacccacagatctgggggttctgagaatgattgtgactccgagtcattaacatatggagcatattttcccagcaaataactgatatctcctcagtgaaaaggaattgagtattctcatgtcaagttatgaaaacacagacaaaggaagttaaagtccctgctctgaagggatgtcctactccaaatagaaagtcaggcatgttgcaattaatcatggcgtggaaaattacagaattaatcaaagtaactaatgaagttcttttagtaaaagccatgtgcgtcttttgttaagaaaccattattacagggagcacagtgggttggtgccaacaattcctgtgatagtgtcatccaaacctcagaccacaccaatttcattccagcggagccttgaggattacccaacactatttatatctattatatggtgccagttaagtaactttaagtagaagccaggaacttgaagccagcacttttggggaggacttctttaaaaagatactgctgaattgggtgtcagtagatatctgtgggtgctcagctgaaaatttcagtcgattttcagtcagttagatttttccagtctaaatggttggaaaaaatgaagagaaatcaggggccttttgaatgactctgcttttatagagaaaaactgagggaactgaggtagatagacacagagaagcaacacatgggtttgaatcccaggagaggtatttgctagctgtttggtttccagtggtgctagaatctccttatacctaatatcacttatggtgaatgggtgtgcaggtgtctaccttacaaggttacagtgacttctaaatgggcctgatacccccttagtgctcactcttcccaatctccttcatttgtaattctccttacttttcattgtcatttcctatttgtccaaagatactaactagagtcacatcacatcaattctcacaaaattaggtccccactgatgggtgaaatggatgggtttgggaatttccagatgaaaagggggctttgagtgactacttgagtaataagatctattcatgttactggggaggcagaaaaaaggctgagttgagcctttttaagagcaaactctgcttgttacatcagtgcacagacagaatggtggctttatgacatccttggcactgcacagtgataaatctcaatgtgggagcatgaacatgaccaggaggacaaggtggacaggagtgtctgagagctgtttaatccaaacataacacattcaatgttgcccccagccccactctacatatatgttacatgtagggagctgtttgtcataataccacgaatagcagtaccaactacatttctaactgtttgagatagagtccttttgttgtatgcacagtatggatcagctaggctgacccatgcgcatctggggattctttttcttctgcctcccatctcagtgatgaagcactggggctatagacacctaccactgtcttggctttatgtgtgtaccttgtattcaaactcaggtccttttgttttcatggcatgtgctgtactctacacactgaactatcgctccagcacccacattcaatgctcacatgcaaaccagataggaggtggggaattctttcatcttcccttgctttcccagtgggatcgatcataaaactgttacttcaatgttcctttggtagagaaagcacaattgaaagcacacgtaagaactaaatacacagtgtaatgacactaggaactatagaataagtatcaggcatgtttctaatacgattgactgccacttgaatggggagtttcctcaccttatgctgggagaattcacacttaggctcagtagggacttttacagatgctgcaagatgagtatttaaaaatcccagtattttctagcctcaggaccttttcactttctgtttctgcttccagaccgcttccttcctcagacattgctgcattccttgatttgttatggtttccattagagtgtcagcttcaaaacaggaccattcttgattatcttagcctaaatcacccctgtatggtttctacttctttctcgattctctcatgagaccactcacaggactttgtgtcatatcttgcatgttgatttgttagttgttcatctcctgctatttcttgagagatttaggaggtatgagctttgttttgtttgcttagtatgtatatgcacagactttatatagaaagcattagacttaatcattggtaaataaaaggcaagctgagtttggactcaataatcagaagcaggccaggagaggtggctcagtgggtaagaacatttcctttgcaaacctgagaacctgtgagcttgagaacctgggttcaagtcttagcactcatacatggttttgcaaaagatccatcctaggggtggagatagctgggattattggaggggaagaaggcagagagtcagtcacaaagcaggacatctaacatccttcttctagcctctatgtgagcacacacacacatgcacctgtctgtatacatacatgtgttatacatcacacaaagctatgtggatacacacacacacacacacacacacacacacacacacacacacaaagaatcaagtcatgccacaagaattccatagttgctggtgaggttaattgtgtatatacatgtgtgagcagatcaatgtgccatgacgctccagcaagccaatgtctgcctcacttcacacccctgcagattgtgtaaggaatgtccagacactttctttttccagcatgacgtaatgtggaatgagaagacctgcagaacatgcagcccatagccagacagatgacctcactcccttcctgggcattcccaagctctgctgttacaaaagaacaacccccagactcacaatgtttggtccacaggtggtggttttagtcctcagtcttttgttggcaaattacttcaaatgatctccaagctcccctgtggctggcgggaggacagctctgacggatacagtctggcctattttttcagccaaatggaatgaattcagcccgaggataaaccaagacataaagggggataaatatgtttcagcatcagccacaaggagacaagctgtgaggagttagctgtagtgatggggaagtttaaagaacaaagtaggaaacacgtttcatggatcctaacaggctcaggttgttcttggggttgtttcaaagccttggaggctgtagaaataatgttgccaatttctctcctatggctcatgttcatttaaaggattccttttatttcatgcctgtgtgtatattaacatgattataactctgatctacaggtatccagtcttctgtcatttataacagattttaaaaggcttatcagcaaacatgagagcaggaaaataatctcctttgtatgtgaacaggctggggctcagagagaggagccaaacttaccgagatcatatggccaggaagcaccaaggcttgtcatggagcccagatggcagtaagttcaagtttggtttctatccaaccagatcaatgcgagacagaacaggtggtatttcttagctgaaaggtctgtattcatcaacattcccacatctgtttctctctgatcaactaccatataccctactgagagctggagcaggtctgggaagataaatctatcaagtcacctgggtgttataagcgatcgatggcccactcaggactatctatccttcccttcatgttggctctctcttctcactcacattaccctcccgccaaaaagtccttctgaataaactggcattttcagtcaatcaagtcttaagtatgaagaacatcttttccatacacaccgtcttcatttaatatctcaaaacacatccagttttcatttctaaagtatttcctggttctgtctgtctctccatctttgctgctaacacctatattgacagcactgttcttatgcccggattgtgataacaaccttacagctgctgatctgagctgttctaacagcctggattgtgctaataacctcccagttcaagaataactgctagctttccttctagtcttgacccttccatttattttcagaatgcaaagaaaagtgaatacttactatatagtcatttcatgtgcctaccctctatagcttcttttttaaaattacttattattttttaaacattctgacagtagtttaccctccctcctttccttccagtccctctttctctcttccctacccccatccactcctcctccatttctcttcagaaaagccagcctccatggatatcgatcagccatggcatatcaagttgcagtaaaactaggtacctcctcttgcataaaggcttggtaaggctaccctgtaaggggaaagggtcctaaaaacagatagcagagtcagagatgctcccactgttgggagtcccaaaagatatccaagctattcaactctaacatatgcatagagggtcagtcccatgtaggctctctgagtggtggttcagtctctgtgaggccctttgaggctagattagttgattctgtgagttttcttgtgatgcctttaaactctctggttcctacaatcctttggtccccctttccaaaggattcccccaagctctgattagtgtttggctgtgagtctctccatctgtttgcatcagttgctgggtgaagcctctctgatgacaactggactaggcaccaatctatgcacatagcagaatatcattaggattcatttcattaactatttttttttgtttggtttaatttcagcactctgggctatccagcctctgaatcctggctctgcaggcagtgttagcagtgggctccatctcatgacatgaatctcaagctgaatcaatctttggttggccacacctacaatttctgcaccacttttatcctagcacatatcaaaggcaatacaaaaattgtaggtcaatggttttgtggctgggttggtgtctcagtctctccactggggatgttgcctgtttatagagatgcccagttcaggttccatatcccccattgctaggagtcttagggtcactctcataggctccttgaagtttccattatactcactttgtagctcatcccagagatgtccccaattctagttgtcttgtctctcccagcacccccttcctccatttcctcccaccagatccttcatgttcccattgccacctctccatccggaccccttcctcctgaaggcttcttgatacacttgttaaatccttaactttactataaggaagcatcaccaccctttacatttcatgaaactcactctcattcattctacacattcttattttgtttaggaaaattctgtgtgcagagaaacaagaaaaggaaaacagtttggaagccatgacaagttaaggaggtttaagattcaatctattggtgtcccaagaatgccatcgaatcattggcttatttcccctaatattttaatgtaagatggaactgatttgaacttacagtcactctggcaagattttcgtgggtcttcaggaacactaggtcacattggggagaaagtgatgtgatgctttcaatcaactatataacataagtacaatgtgcacagtgagtacaaaggaaacgagagagaggaagggagagactagagcttggagtgaatatgatgccaccttaaaatgaattgttatcctgaaacgtttgggaggacatagaaaaagttatctctccagtaggcattctcatgctttccaagcctactctagattattaaaagatttacggtctcttgatgatgattctgaaagtgctataaattaaatatggattggacacttatgcaaagaaaaatacaaaacttgaatatattgggaatctctgaagtaccagatcctggaccagaagagatattcagaatgagggggaaagctgaaaggatgcatgggggaatgtggtagaccctgttagctttctgtccttcaggaattacttcagtggtagggcatcttgagtagtcagtgaatatactgaaagtgtgatggaaagcactgtgctgtactctgtctcatgctgttgagagaagagtcatctgtgtatgcctctttgcctctgtgccttgcatcccagcagctcaatgcagattagcttttcagattcttgggtttcaatggtttcaatgatgggagttttatcctcacaagtgtctcttcacttccttttctgtctcgtgccctatatgtgttcattttctctccacttagcaatggttcattacacagtaaagccaaggaaatgccacaactgtagattttgaatagatggtaccagttctagtatggggggagatgactgaattctcagaaactttgtgggctagaaggcgggttgtaattggcagtgaaccaggagaaggctttgttctcctaggggagctgtctgtgaaaccaggaactctcaggccacattcttggcactggccttcacaaaccattactataccactaagtgttggactggtttttcactaattgatactgttgtgtagcagactgaaatgatgaacctgaacttgaagatgctatcatcttggtctacccaagtaacactctggtgggactctcaccagaaacaatgtgcctattagtgaagaaagtgacttgggtacatttagattttaaaacaatactctagatcattcaagtgtgagcaatatgttaatgatttgaggagtagttcattcattccttcatttattcaatcactcacttcctcaaaatgtatgcagaactcgttctgtttcaaatatatgcttggacttgagtaagataactaagatactgccttggtcattagaaatatatagttcatataggtgttgagtaatggtgctgactcttcactctaagaagcccagtcccttccccctgctgattatggctccctgcaagaatctgtctttatatccaaaagaattcaagcttactaaggaaggggttattttgtaatcaaatacacacattaagaagatttaataatttctcaattgctttattagtagtattatcattattattacattatttttaatgtatatttgcctacaaaggtgatttgcctacatgtatgcctgtgtaccttgttcgtgcttggtggccctggagacaagaagagggcatcagatctccttgaattgaagttgcaaattattgaaagtctccatgcaggttctggtaattgattccaggtccttggatagaccaaaaagtgctcttaactgctaatccattcctccagctctttttttttagtttccgagataaggtcttattatgcagaccagactatctccaaaatcagagattagtctgcccctatcctgagtgctgggattaaagctgtgcaccctcaaattcttcatgcttttctgtttaataacaaaagtaatctgcaaaatccccacaaatccatgaaaatctatatgagagtaggatatatagagaggttatttgaataaagaggaaatgaagtttaaaaaaaggcaaaatgttgctatatcttgtaatgacattgttcctggctacctgtaatacggaattcaaaacatacctgttcagaatgtattttaggtgaaaagcaggaaataaagggagagagacaaagggaaagataaagaataaaggaaggaagaagaaagcagggaaggaaggaagaagaaaaaaaggaagttatgtacataaaagaaaaaaaaaagaccaagcagagtttttttgttagggaaatcagcatttgtggctgattaataataatgataataataatataaccaaccagtgcttccccatgttgaaaaatgtgaagacactgggtttgtggccaactgtgggatatcttgaaatgggcccagcctgatgtcagtttttttacaaatcagtttatgaaaatttgcatttcaaagaatactcattgacaaaatatattcattattactttaaataagtatgataacttgttcgaaaatgtaaatactttactatctaaattgcaaaataacttgtctctttacattctagagagaggagaggcatgctttgtgttgggctctgcattcttgggcagctgaagcagagtgagaaactggctgatgtggagaggctcttacatccagggcttggacttccggcttgctgaatggaagtgatgagccttccccacgccctctccccttttggatccacgttgctatctgtgtcagaaggctctggaaaatttacacctgcacacctgctccgttttgtgttcctcttgattttatgagtggacagctgtgagctacaaggagctcaacagtttagaacccctcccgcaacacgacatgagaagacacggtttccctctccttttccacactccaggctctgcatgagacgtgtgaaggctgtcttcccagcttgtcacatataattaggatttctgagacttcttcagagaaagaaaagggttgtaattttctgatgtcactgagtcattttggtataactttcttgttcttattgaggtggaatgtgtgtttgtgtatatgtgtgtatgtaagtgtaacatacatgtatatatacacacatatgtaacatgtgtatgtgtgcatgcatgtgtgttgtatgtggaatgtagtaacatttaaggaaatggatataaagtgtttttagacttgtctcagtccagttatctgcttccctgagggctatgtcattccctgtgcccaacaaagtgtcctgagacatttcctgttatgtattctctgccacttgtatagttatttgttttgtcctcacaacacagttcagctctgtccatgggatggggcaaatgggtacagtctttttataacttgattggacacatcagtatgaaggcagaattaaaaagaaaacactatttcatttactttaattattataaaatcttcagaagagaactaggtattctggatttatgttttgcatatagcagttgttttttaaaaaacagaaaaatcatgtttaataatgcgaacattgttttctcttgtgctatggaagctagttcagtatgtgtgtacttaaataagaggaaagaggctggaagcaaaataatgttctggtctctacccaaaacatcccttttttttcctccctctttgcaaagtcttaaagtcttaaaagctgtggtgattagcttccacacttctttcctaaatgcaaagtgagatgctggtttatggaccagaatgaaaaaaaccaagaagagctgagactctcacgggacagcttgccagtgaagtcttccaagtccaagaagctttacagaagttggaggtgccctggaaagggaccaacagccttttcagctctttacccatcactaattctggctccagctggactccggcttgctgatgaaagggaatgaaagccgtgggcctccaagggcattttggatggaatctattcagtctgcatttacttgcgctgcattatgaaatctccatgacaacaggcacatgtctcagtgtgttacatggagaaggactctactttgtcaggagaatctgatcatgtgccacttccttcctgggtgttggaatgggttccacctggagttggtttcccctcatccaagatgatggtaatacagaaagatatctgaggccagcatccaaattcctgaaaccaccatagatcccactggagacatgtgggaatggagtttgcttcggtggcagttggcaagcatggcactgatgagaagttgaggctgaggcaccctttctgcttcagttggctctctgatttggctggtttctgaaagttatgagatgaaagggtgggcgagactctggccatcattattctgctctgagaagtatgatttttgaagctgctaatactaaataagtctcacacaacatcctgaaattattgtcccccaaactgtctgtctttagtcattttacaagcctgagagatgtctacaacaacaacaaaacagaacactgcaaaacaaaaaagcagagtattggtcagaagaaaagctagttctcatcagctacagtacccatactagaattatctaccatatgagatattttaaggaaaataattgattctcattttcagcatgcttagttattaatctcccaaaggagacaactattatgtttctggaaaataaaaaacctgatttcc

SEQ ID NO: 260 - DNA, 9420 bp, Mus musculus
ctcccggctgcctttctgttcggaaccaagagtttacaagtggcctttcaaaggcccagcagccctgcagggccaagctgcagcatctgtgaagatgttaccctccgcccttcccaaccgcacagcctcagacccattttctcccccctgggttgcgagggaggggtaagtttggaggtggggcgaagaagaaagttctagtttagtccttcggcactattctgctcctccccctttctgcttgctactcctcttccttctacccttcccctccttcctgctggaaagcttacggtgctccatatacaaagcctggctgatgagctcctggcagcagctgtcaatcctttctctgcctgttaactgttacctgttctcaacctacctcaccagttggtcttaaggaccaaaggagaaagtccctctttgatcctgtgaccttcaggtctctaaaagcctaaggtctctaaagtccaaaggaactccggacttgtaagtcctggaaagtaagcagagaaagagtctcccaaaggcgaaatatcaaaaagggagagccactaaaatccacccccttcagatttctggccatgttggactgccaaaaaggtacttcctgtgatcatccaaacccatttctccgtggctagagactcagggagaatttggtagtgaaacccggaagtggtgtcttcctcagatgagagtccttgatggagagagaagaccacttgcccagcagagacaaagcaaacccggggaggggagaattgacttggcgaatcatacttagaaacagatgtcagcttgtctacacagtaggccaaacccagcccggggtgcccatgtcattcttgccgcggtctatggcaggcatatccgattgaccctgcctttccctgagcatcccacagaggctagtttctgggcttgatgacctctgcctgacttcctactgccatgcctcagttcctctgtagccatcaaatctcaacttgggtgcccccacctctcttgctgccttctttcagtttttctgagagatttactaatgtcctccagataaccagtccctttgtgcctgtgttaagtctcttgtatgggatataagttattatatagttattgctccatgggtagaactcattccttgtcaatatcaacaccgatggcaaaggccacccagcacccacccttcttgatttgccttctctttgtttaggtaggccttctatctatctatctatctatctatctatctatctatctatctatctatctatctatctaatattacatatattttataataattacatataatttatagacagggattatctgtgtagccctggctgtcctggaactcgctctgtagaccaggctggcttttgactcagggatctgcctgcctctgccatcttagtgacgggattaaaggtgtgtgccaccacagcctggagtcctgaatagcttccttcatcacgctaaaatgtctggcttgggttgcattttatgtagtcaccttactgagggcctttatgtgagtgtctggcttggtaaaagtcatagcttgccttgagggctgtcctggggctggccaacccttctgttctcaccagtcttctggaggcaggcttccatatactctcttcttcctcccttgagatagcctcagggcaggaaaagccgcattttctttttgacaagttttcccgggatttcttaatactctgattccacaagaagtagctcaccacagctcttcttatgcttctcagcacctacacagaaaaactgtcactaggtgttataaaagaggccttagactccagagaagcgcaccgcctgtttggggacgagtccccacttcccaccttaactggatgtttggccttgcccgatatttttcactgtgcacatcttcagaattctcactacaagtttcccaagaagcccacattttgggaagctcagagctcctaggaaaatataaaaacatttcaagttcctttcagaacgtagaaaagaccaagtcccttactgttcgcatcacaataaagaacttaatcaaaagtgagccagtgcaagaagcatgaagctgcagaagatattaaaggtttggaaataacagcaagcaggacggctggccttgtgaatgctcccccctcccccccagtgtcagggtgcctgggctgtctcagctgactcaccgctagctggagatgaatcatattccctttctgtgtgtaaggtctcatttccttcaccccccccccccaataaaacaggcatgtttattattcctaccatgcaggagggatgggaagttttaagagtccttgataattacacaaaaaatattattaaagtaaaaattagctgcaaatatgtttttttctttctggtgaggcacagagatggggaggtgtgggtggttcccctcggatgttgctgtggcttctggaagcctggctcactgacaataggacccttgaagctggaaatgcgtatgggaccaataagctctcctttaagtcaccatgaaacccagataacacagtcgccctcttctaaaggaaactgtccttgtcctcccagtcagtttatctgtggaggtagtagtgtttatggtctgcttgagtgggagaatgaagccgaggaggtgagaagcccaaactcaagatgtggcacctgggacaggaacaggaggcaggcagagtgtggagggcttgagtactaggttgggccagcaagctattcctgagggctatgggatgctaatgcttgtcattgagctgggcctcggcaggatgtgaagagcgtttcagtgagctttttggctgttggatggagggcagcaacctactgcagccactttgatccatttgagctttgcttttcctctttttggaaatgaatgatagctccttggtagtccggccatgctgttttcgtgcagtaaagaccccagggaaacagtgcatgtgtgcatgtgtgcatgtgtccttgaatagaagaggtaggaaggaggtaaccgacttgttaggcacaaaaccaactccagaactttgttatctggggaggaagcctaacccagcccaacatcttagccaggtctagtcgaaaagaacccctgggtgtctagagcacagagatctttatctaggacacagcatagtagatctgcagtttagggcctggccactgacctctgtctagacttgtctgccatctacttcttagtccatctgagacacttgcatttgagaagacagctatgcctccattctacgcagttattccttagcactgtatcctgcattagagtcccaggaatctttatagttgggtggctagagagcttcagagctgaaacttgaaagtccagtttggtgtttcctaaggcttgctgtgagaccctacaaaggacgttactgtaatggtgctatcaaagttacctaaggacctttaggcaaagattcatgtaaaaatgtctcgggaaggttcaacttgcactgagcccttgggtttgaggatgtatacttgtatacctgctttatagttggtatcaaaacagctctcaatttagatactattgtttcaaggaggcttacatacacaagcaagtgaaggaatagagatcagctggacccaaggaaatgtagcaagtgaagaactctgtgagcttaagagtattgaactgactgaaagcaacctgagtcctcagtggaaagagaaggtccgtagattcctatttcacagctcgacagtggatactagcttccagtgaaatcattaacttatttatcctgtatttgacgggctgttttttagagatgaaaccaaggttcaccaggaaaagcctacctaaacagtgtcatttaggtcctggggattgtgagtaaggtggtgaccgggtacaaggtacatttttagcctatgttgcaggttcatcctactgattactgtatgaccttgatgcctgtggctggtgtgtactgaaccattatgtgtaggatttaggctctgaagtgtctcctggttccttcattctgctcttggaaatgtcaacactgctgcggattgactggtgacactcagtcattctatcttggagtctacatacaagctaagaaatgacagttcccacccttacactggtgaggaccaaagggtggaaagacattgaagtgggatgcgtcgaagttccagatgaaagctgtcatccctaagttcatgtttaaccacataatgatgtctggccacacccttactcctcatcttatggcgttccaaaggaaattttggatttcaattctaacaagttagtctccaatgcagaacatgaaatatgaattgtatctcatggattctacagttcagttctcttagacaaggacaatgagactttacaaagcttacccactggacctgaccaaagaaacaggcaggaaatcttagagtcaggaccacatcccagatgcccactggtccttggtgttccttttgatttgtaagctatgtgttggagtttggtctctaggttccaatggataacttttgctaggttaaagagtatcaagattgttcttggcctctgacagttttatggatctgcactatctatttctggtccagtgttgattctgtgctattgtttgagctctgtccataatatctgccactgcctttaagagagagagaaaaaatgttctcttgtgcctcacaagacagggagagatagacagggtcagcttgagcagattggctgtctctgacacacacacctgccttggctgatatttgcttgatatttgccatcctcagctgctttcctgtgcagttagctaccttgtacttctgaatctatagcttaaaaacaaacaaacaattagttcttccaccccctcctactgaatgtagcactaaaacatctgcatagatagaattttgtgaaaatgagcagaaaatttgaggcaattcaaggaggaccaataagctctcctttaagtcaccatgaaacccagataacacagtcgccctcttctaaaggaaactgtccttgtcctcccagagttttccatggccatgcccaaatcttctccaagagcgccctctgctggatgacatcaggaccccgacagcctcagccatcttggaagtagagccaactggagttttgagagaataaaaaggaaggttggagagaaagggggttggtgttttgggtggggaagggaagatatttgaggggagggagagagggggaggggagattaccacactgggaagctccgaggcacctctatttgaacaccatcctaaaataagatgtgttccatccatgacgtccttatgccgctctacttctatttcaatgtattaacttagtactaaaagatgatcacatgttttaaaagaaaagaagcagatggggagacccacaggcaaacatcaggcagagtttgggtgacttgtgaaagaatgggggatagaactgaacaagccggagagatcaaggacaccacaagaagacctacagagtcaactaacatgggaccgtgggggctcacagagcctggaccacctaccagggagcatgcaggagctggacctagacctcctacacttttgtagcaaatgtgcagcttggtctttatgtgtgttccctaaccaatggagctgggtctgtctctgtctttgttccctgccattgcatctccttccccctacctggtctccctggttgggcctcagtgggaaaggatgtatttagttctgctaggaccagaggtttcaggatgtagcagttactaagtgggggactccctttcagggacaatgggggatttgtaagggtggggctaggaagagagcaggaagggagggctgtaattgagatgtaaaatggaaaaaaaaaaaaagaagaagaaggatcaaaggagaggaagaaccaagaatctcccttgatattgatgattccttgatggattacaaaagataatttcataaaatagctcaagttctatttgagattttattattctttcaggtaagttctccgtcagctagtcattcctacccagggattgaacagttttggaattcaaggcatatttgtaagttcagtgactcattactgtgcttgcacttcatttagtatatttaattagcatatttattccaaagaagaccataacttcaaaacacttttttagaagaagaaaatgcattagcaaactttaaaagtatatttgaatatctaagtcatattttaaattaagcatgtttgggtaaataatctctctctctctctctctctctctctctctcttcccccctccccacttctgtctgtgtgtgtttgtgtgtgattttaaacaagaagaaggcctcctataaatagcctttttaaggcaagctcttgttgatagattgaattttgtctttaagaccgatgttagtgtgaacttattcattggtaggagtttgctacgaaaatatagaattggagggttgataatctttaaagtgtcatgttcagtagaccaaaagaagcagtagctaggaatgtccttgtgggatgagcatagggctgagctaactgttagaactctgacttaaaaatggaatagtaacgttctatgaaacattagggaagactcccccatctcattactcaagtggttaaaaatgaaacctgaaacgaataatgtcccaaaggctcatggtcagtcctaggtggagcccagactggaccttggatcatccagagtgcttagcaacatccaagcagacctttgatgaactgtttttcttatcatgccatgaaagggaattacaggcaaatgctaagatgtccatgtctgattcctacaaactccatattgaaataatcttcttcattgcatttgcaggtggtgctgatgtgacttaacggagtcctcagggtggagactatagttgcagtggtagcttcatgagtagaggaagagagattttagcctggcagtctttctgtcacatcatgtgatgtgaagtgccatcgtgggaactccatcagtaagagggtcctcagcacacaggaccctttgaccttttgcacttctctgcctccagacagtgagaaatacactaacttcctttgcaagtaacctagtttgtggagatcagttaaagggatgagaaacagactggtagcaagagactgaagaacgccgctggaaactgctgctgacattgtcataaaacatggaagaaattcctatttgagactctgtcccagctcattgtatccttaagagacctagaaataaaccactcagctcctccccacgatgacctccactctgtttacacaggggctggccagatgttagaaaaagcaagcaaacacttgcagctgttatcagggcgagggtggagcacacgaggttcccaagttttcatccaacacatcagaacatagttaatttttactgcttttgggttaactgtcttcctcgtccttaacttttaacacttagtattgaagcttgtgtcgagagatgcaaagggatccctgagctaactttagcccatggccaaggcaagttgtcctctataaccttgggagaaatctctcttcatctttagttcccctttgttcgagaaggatggctctttgtagcaagtagagtttagaagtatgcaggagtcagtgttttgtggtgagtccatgggctttggaattatgtaatgtctagttttgaatcccatcctagccattcactgatcatgtgattttgggttacacaggctggagtcttattacattgcttatttattgaattaaattcctatcttgtagctgtatagagtatcacttccattcctgtgcagagggcacggttaatgattaactgtttccactgggacactacaataagaggtagattgaaatgacattcaagggaacagacacagaaaattaggaaacctttgtttcttagaaatctatggaaacagaccagtttctagcagacattaagggtggcgctgcttgccagtatagaacccccttgtttgttttctcacagctaacacaagccttgattgcttttcttcaaggagagggatgcaaaaagcctgacctctagtggtccctgcctttgtgttggactgaaggggaagggctaagactataagaacaatcaagacttcactagcacactggaaaccaacgtcacacatttcctagttaaattaacttgtagttgtgtttccattgttttttaacctaagctggcttggagcttactctctagctgaggatggacttggattcctgacgctcctccttcagccacccaggtactgaggttacaggcgtgggccactatgtgtgcctgacaagctgtctcatttggtaagaacttaggacaaattgttagatgtctcgctacacttgtgagtttgcagtccagtttaagatgtggcacaggaggtttgcaggtgctctgagttccagatcctatcatcttgtagcatctgtcacacgagtcagctcattgttgacatagagaaagcagataaccactgggtatatttcacagagagtttccttaatattgagagtcagacatcaaagtgatatccaagactgctttgctcaatgcctccagaggcctggcccctcgagactttgatctctttctttttttctcccagtaggtctgtgttaacaggcatttcacacagacccctgtcctcttgacaccatgtaaactttgcctcagagccagagctttgaagccctcaattaaggtctgttcactttagcaaaccagtcatattcactcaaaacctggaaccagacccatgttaaacgtcttaagtattcagaagttcaggagcaaacgaggtcattaccaacattatgctttctctctctctctctctctctctctctctctctctctctctctctctctcttaactttatttttcaactagcttacacaggattcgatttcatcatgatgtctttaaacaaaatttgttttgttggccccctttctcctctcttctccctcatctctcctggctctcctgtgtaccattccacctactggaggcatccgtttctcttccgctttaattgtcatttgtgccttccctcttcttcaatacttctctccctgtgtcatggtcttccttcttgttctatagccagtatactctatgtatccccagtcatgtaggcacatggaagcattataaatgaggatgctcatatgtgaaggacatgcaatttttcctttcttgtatctgagtcatagtacttttttgcttcatagtacatttcaatttcatccattgcctgcaaatttaatgatttcattttccttaatggccaaataaattttcattggatatatg

SEQ ID NO: 261 - DNA, 3790 bp, Mus musculus
catagagcactacccaactttacttgcaatccttctaattttctccagaaactttagaacacatctcctcaaatccatgccaaaatgagaggcaacccaaactggagaaccgtgccatggggctgcaggaagcttgcttctaccctgacaggttccccattttctcatgcagtctgtttccttcagcttgccccttggcaggctgtgttcacagccggaaactctcaggtgatggtgaactggaagagccagcaaaagcaaggaagccgctgtcttccagaaagagattgccccaggctactgggattggggatgctccctcactgccaaggccaacctccctgtcaatgcctgccaggctagtggcagaaaagataccatgcctctggtttcacagtagccgactggcaagccgctacctcaagtttctttctgtggtattccaagccaacagctgttgcttctctcttgtctccggatgtccccgctctgccttttcttctctttggtctctggttgccttgtctagtgtagactcactggctgtatctatgtagagataaggttcttccaggcagccaaggttggaagcaatgagaatcggccatgtgatctgcagggagccttggtctcttcattcttggtcttgtcccctggtgtaggcctggtgctagctggctgcatagtcttcagatctggagggactctgcctgtcctgcgcagacccttctaggtaggccttcatctgcagttggttgacctttatctgtgccatcctctccactctggtcttcaatgctggaacaatggaaggactcattagttagctgggcctttggtctccacctgaaagcacccaccctttgatgagattacctctgtgcccagttggcacaagccactgtgaagatggccaccatctacccagtctcgggaatgacaaaacattccccaaaactgtgtggaaggatagagcagattctcagtcagttagggatctggcaacatctctatagtacatgtgtctgtgtgcggtgggagcggtgggaagggctaccagaagggctcatttcattattaccaaggcctcgttctctcccttccctgctagatactcccagagtccaactgtacaaaaacacaggatttagaccttcaatgatgcacattccccacttgtccaaacccagcaatacactatggcagggtctctggcctcgtgccatgagagaagagacctttcccaaggctggaatctccaaggttctcttaggacccctctgtaaatggatggctgtacaagggagggcacagcgccatctttctcccaaccaaggctcagagaaccgcttctctcaaaatgcctccccgcctctcacccacttcccttccccactcaacagcatgcgtggaaacaagttcagatttctcttgaaagtcgagaagggctgttaacctcggtcccttctcacccaggtccctgacactaggagccaccagcctgacagtcacctgcaagtaggagggatggagaagaagaccgtaagaaatacagtgggaacttcatggacacctgcggcagagtgcccggctagtgtgtgaccacagaatgcccctccagagcaacactgaacctagcactgggacagtcacctctcctgagagctggcgaaaggggttgtaggcaggcaagctctgcagagagtcagggctgctcctctccagcagctcttgtctcaagcaggccattcttccttctgagagaggcaggccagaggggctggagagatgggtctgcgtaagagtacatactggcctgaattcagtccctaacacccacagcaggcagtgcataactgtcagtagcttcagctccaggggatcagatactctcttctggtctccctggaaatccatatccatacacagagacatataaataaaaataagggctggagagatggctcagcggttaagagcactgactgctcttctgaaggtcctgagttcaaatcccagcaaccacatggtggctcatacagagagcaccctagctacatggaaataacaaggaaaccaatgaagttttatgtcacaagcctttgttgtccttttccagaatcaaagaaccggtacaatggaaaccgaagtatgtctttcctttttcctggagtgccgggagccaacccaggccctcacacttgttaggcccacactcaaccactcagctacatcctcagcctgagaccacactggcaggcgcttccacagccattcaataacgacacagaagaaaaaaataaagttgtgagaaatcaccaaagcctcccgtcttcctctacacacagtgaagcccaggcctcttaagagaaccacaatgcaggcgttagaggccacttgtctccaagcactgtcagaagttccaagctcatctgccactgaggcctgctaccagacgctttccggtgcttattatgtccttggctcctctgcagctgtcctggaaattatacaactgcttgtagtgagggaattgaagtcagggaggttctgagtgcagctaagtgctctgcaggggttccgagggagagtctgacccaggcggtgcccctgtttgtactgatcctgtctggactcagcttaagttaagagctgagcggtagaagattaggagctgaatgtaagcctgaatagatgaaaaactggaagacggggaaacgctttctgaagacgggagtgaagacagactattgaaacaatagagcaaactaacttggcactgggctgaggcctctgctgggcttgcgctccggcacctgtccccgttctccagggatctttagaggtcatcttgggctcctttctctccctcatccccgtatcaaattagtttccaagttctcctgttcctcctgcttttccattgcagtggccgcgtcccagcctagggccttatcacttggggccagtctggactctctggcagtctggggtgagcgcaaggcctggcaggcagctacaaggccagcttaccgcaccgggctgctctgtctcctccccctctgaggctcaggtcttccctttatcagctgccctcacgtgtaccccagctcctccccgtacctcagcctcctccagttccctgcgtcagctccaggctgggccacccagttcaggcttctctaccacggccgccgccccctcccccagccccttcctcgggtttcaattaactagctgcccatagattgcagcaaatttactgtccctgaaatagaagtgccccgtaacgaggtttaatgagatcatcccccgaggaatttaataagggacaatccctttagctagccagatgagagtttagctgtgtgtgcaaagagagtgttgggggaggggaggcggagggttcacgatgcactcactgctcctgggatgagtgggtggtcggtcggagtgaagcgtgttggggagggtgggaccgatggagaggtgggatgtagggagacaaggcagttggctgggtggggacagaagcacagccttgtggcttcaggtgcttaccaagagccaacaggaaacctgactccagtcctccctctgctgctccagagggtccaggccagttctaggggacaagcccaagagcttccaaagcattgggacaaggctctcaagctgtgaccttttccctttcctaaaaatgacagggccagtgtctagcacagtggaacttgccttccaagccgggaaaagagaactgtttctttttcctgctcctgaaaaccgactc

SEQ ID NO: 262 - DNA, 9330 bp, Mus musculus
taggtggcccaattcagtccctgtgacacccctccccctaagtgctattagtcccactttgcttctactggctaaaactgaaaaactctgccttcgaccccaggccctgctgagatttccccctaggaggctagagctgggttctttcgaggcagctctcagcagacccgcacatggggggtgtccccagcgcagggccaaggatgagggcactcacctctgggaaggcccctttggcgaagaccatcatcagtgacgtcttcccgcagcccccgtcgcccaccaggaccaccttgaccgagtgcccgctctgcggcgcctcttctcccgcaacctgggacgcgttcatccctggctggcggacggcggtgcgcggagcagcaggcggtacgcggcgggctggctgcggcgggcgcggggctggcccggcgggacaggaatgtggaaggggcggggcggcgggaggaagtgggagcggggcggccgggacaggaggcggcccggggggcgggggacacccagctcaggtgagaagcccgggacaagatgggggtgcggcgcccgcccaagggtggacgctcctggggtccggtctcctggcgtcctgtctagacactcaagaaagacttttgcagcacctactgcgtgcagtcgctgaggccgcaggggtgagcggagacctacgcctccagagggcacccagggctcgtgggagagtagacaagtacttggagagaggctggggacagggaaggaggaagcacctggactatctgccatgggtgggaggttatttttatgaatgaatgggtgggtgaatgaatgaatgaatgaatgaatgaatatgagtttctgctatttgcggacctcctccaaatgttgtaggccagatgagaaaggagtggcccgggcatgcccttgtgggtcactgcaggacctcttcagccagctccaggaagtttcaatgaaggtggaattaccacgcatctcacccaggcagccagtgagctaaggaaaactatggaaccgtccatctgtagagctcagagctagctctggcacatggcagatgtcatgaatggttcatattatggtatatagtatgatggccttttagttttattttttacgcgtgtgggcgttttatctgcatgtatagacatagacatgcatcctggtgtcctctgcactcggaaaccctggaactagagttacagacattatgagccactatgtgggtgaaccgggatcctctggaagagcagccaatgttcttaacctctgggccatctctccagctctttggtataatgtttaatcaatgcagatgatccttagtttcttagagtctggggaccctgcactgttccgatcaaaacctcgactctgagaagcctagaataggaggtgtcaggacaggagaaaggaaaaaggggctcttcgaagagactggagcaaggtagccacgcccccacttcttagcgacaggacagagggcgggacttggctgaggagctagtatctggagggtggagcactttggatttcaggaataaatcttacttttctctaaatctccgcaaccttctttgtgatcagatttttctttttaacttttggtgagcataagtgggctggaaatgtagccgcgctgcccggatgcttaaccagcactcatgaaagcctcggtcccattcccagttccacataaaccgggcttggagatccatgcttctaattccaatactgatgaggtgaagccaggaaaatctgaagctcaatgtcagcttggctgttcagtgagttcaaggccagcatggattagatattctgtctaaaaaagaggggaaaaaggtctcgcctgtctccccagacctcagactgggtgtttaatggaagctaagtggaccatggtcagaagtctttgggtttcacctccatgacttcatctcccattgtattcaaagtcaggcagtgaagaggaccttcagccctatttgatcctcactgtgtctcaaggaggcagtttccagtttccctctgggccagaggtcagctgtatggaaggagcctcccagaagcctccccagctccaccttttggatgcccctttcccgaaaccgccacagggctgggcgggacttggcatgaagctgggtgtgtggctgaacaggatgcccagaaggagtggtgaggagcccccccccccccagtcagctgtcagccttgtcatccctacctgtcataaggccagtctgggaggcaggtggagctagaccaagggtggaggaagctgagagtcaggcggaggtggccttggttgctatagggataatcactctaatgacacacttgacaactgtcacacgttatagtttctttgtatacctcataataacaacacatactaatgggtgatagctgctattcagggactgtccaccaggaggcaggatttgctagttccattttgcagagaaggaaactggtgacttcttaagggggaccctacggctgtccccaaatctcagttcttgtacattattgctgtcagctctcacactgtgaagtaggtttctacttcttgttttggagacttggggattgaaccccagagggaggcagctgcttggattgggccagcctcatcaacattctatgttcaggctcctgggaaaagcgtatcagtcagtcactgacccatggccatctgccctggtagccaggaatttccccaaatctgacattgctggactctggactacaatgttttcctgacgtttatttttggagtggggtggggtggccacacagttggcctcactggggtgcttgctgtttgctgtttttctgtttactgtggctgctgctgacttccggccgtgagtgactcagccccccttcaggccccatcaattccaagccgagaatcctttatgaaccccgtgtagcatgtgactgccctggaggcctcagagtggccggggaggtggggccagcaacggtctggaatgttgttattggtgctgcaggtctccagcagagccatgaccccctcagagcaggggccacagctgacccatttctgtaccccagactatctcagactggcgccagctgtggttccggatattatgtctaattgacaggctggctggacaaacatagcaagagaaaggaaaggataagtgaagaaaagagggagtaaaggacagaggaagcagagggggcaggaaggaagaagagaaggacggaaaagggggtttgaaagaacaaggctggccaaatggctgagtgctgtggtggcacatgcctgtaaccccaggaactcagtaggcagtggttttctgtgagttcaaggacagcctggtctacatagcaagttccaggccagccatgattatgtagtgagaccctgtctcaaaaagaataataagtgcataaataagcaaacagatgaaggagaagtgcacacaacatgtgacaagaggcgggggtgtgttctgcaaagaagtcattaccttccactctctacttgctccaagaacaaacctaactttctgccccattttctggccccccttctataatcccctgcagctaggcatcacaggctgttctgattctttactgccaccgtgtggccgctctgctctctgcaggttattccttgggctttcctctggggttcctggcctagggtactgggtgtttgtgtggatatggtcttgcctttgggaaggcttgggtagatttcctcaagcctttgtgtgtgcacttcatggcttctctctttagttccaatcatcagattccagaagcccttgggctcagcacagactatgccactcaaaactttgccctcacataaacctagcacctgttgtgtgccagacacttggcacatgacattttagtctgtcctttgacgtatatatgattcctatgcacctttgaaaaatgaagaaacaagaggctggaagaggagaaatagcttgactaaggtctggctggaagttggaggagctaagccttagaccccatcattgagttccagagtttgttcatgcataatcttcaaaaattctgccagggtggtaacaaatgtctctaatcacagcatgtgggaagcagaggcaggagaaaatggagtttggtgttatccttatctacaaagtgattttttttttctttttaagacaaggtctctctgtagccctggctattctggaacccactctgtagaccaggctggcctccaactcagagatctgcctgcctctgcctcccaaatgctgggattaaaggcgtgtgccactgtgcttggcttatatagtgaatttgagactacctccatatctgtgaggctctgtatcttaaaaagagagagagggagagagagagagagagagagagagagagagagagagagagagagagagagagagagagagacaggaaggcagagcgacagctcagtggctcggagcacttgttgctcttgcagaggacctgtgttcggttcccagcaccaggtgggtagcatacagccagtaactccagtttcaggggattctatgctctcttctggcctctgtggacagggggcagacacatggtacatagacattcaagcaaaatctaaatgtaaaatgaaaaatctttaaaatttaaaaacataaagctggaggtgtgaggagccttttgtgagctaacttgtctaaaactctcattttcagttgcagaaactgaggccccgagagtacagtgacttctcatactgcaggtaagcagacccaggtctttgtcctgcaggacaggacctggaagatgcctcctcctaagcagctccccgctgcatggacctcctctttggcttcccctacgtgccctgctacttactgttgggcttacccaatggatgaacagggaggaagccctgtggccacctcagcacttgctcgctctcctgagtaacttgtcactttgggtatgtgcaggcagagaggtggctcaggcaggagacggaggagaaggtaagtgatgctgtcgtcggtgggggctgagggatgcaccttcctcttcctatgggcaggcctgcctctggcaacactgggttagttattggcctccgcacctttccttttgggtgggttcttggtgagaggggcctggaactctgaaggcaggtccatagacctgggccgaaggaataggaaagaggaaagggtggggaaggaagggagcttgggaaagggaagtgctagagacaggcggagggaatcatggaagaagatggggttggggctagtcttccagtcaccccagccatcctgctttctctccagtagcgcctctgatttttaagaaaagatttgattggtactttatgtgttatgtgtattagtgttttgcctgcatgtgtgtaagtgaatcacaagcatgacctagagggcaccagatcctctggaactggaattccagacttgggagccgccatgtgggtgcttgaaaccaaacatgggtccacagctagggcagccagtgctctcaacctctgagacatctctccagctctgaatatccctcactttttttgtttggtttggttccctgacaactttggctatcctggaactcaccctgtagaccaggctgaccttaatttacagagatctgcctgcctctgcctcccaagtgctggctgggattaaaggtgtgcgccactactgcctggagaacatcttatatttcaagttctctttaatgcaccctaaacctagagattgttgagtagtccaccctgctcaccacctctgcctacagctgtgcttgttcccttatcttacaggtcttcaactccccactgagcccttttcttgtcccctcctgccagcaaagaccttctgcctcatctgggatgctggtgccttccaagcccatttcccatagcctctcaggtctctgtaaggctatggttttccagacatggggcactaactagtctgtggtctgtgccctatgacctacgggggatgctgcaagtttaaattttctttgttcttaagcttggcaggggtagtacacatcctagcactcaggaggcagaggcaggcacatcagggctccatagaaaaaccctgtcttgggaaacagtttattcttgagaatttcatacaagcatacaatgaatatgattagctccgcaccacttgccccttactgagacactgagaattcttagcttgcttatgagctcctggggaggaaaagaagaggaagacgtatgttgggatccagagggttctccgctgcccttcaggggctttcgaggaattggaaaaagatcacgtgtcctgggtgtcaagagcatgggctctccaactgtataccctgaacttgatcataaatctgcgactttcttgctgtgtgatcttaggcctgctacttaacttctctgagctctggtttctacatctccacaaggagaatgccatagttgcctgcctttaagtgcttctgggctgcagcctgagcaccaattctcaacgaccttgtaaagcccttttcccactcctggtctgtgttctgcaccctaccccggattcccgtcccctcccagtgtgctagaaaggcaaagaattctacccaatgcttgtcccttcctgcactgtgatgtgctgttactaggaatgcgtttcctgctttacatatgagtactcttcagtgtcaccaccaggaagccttccttgacttctccatcccctccttccccaaccagggctggtactggggttcctcttcagagccccccttaccagcaatgaaggaggacaccgtgcccctgtggggcccaaggttgagacccagtaaaatgactggaggctgagcagggctccctgtatgcctccttcctgccccagttttattttgtttcaagaatcatccctggctgccaccacagccatctgggcacactgtttcatgcagtatagaaggaaggaaagaaggaataaggggatggagggtggggggtgtggtcttccctgcaaagccattggattagaaagagtctgggggcttccagatgacaaggcctggcccagccaccactatccctggcccgttttcacctcttgaatattggccacagggtgagaagcttcagtgggtccagctgtggctggtgtcctgttgacctgtgtccctattctatctgcccttctccttatcattgaccattattagacctgcttccatctgggcctccatgattcattagggccaaggaccaaagccctcttctgaccactcccacgcccactgcccttttaaatcttcaggttcgagtctgccgtggtggtacacacctttaattccagcacttgggaggcagaggcaggcagatttctgagtttgaggccagcctggtctacaaagtgagttccaggacagccagggctacacagagaaaccctgtctcggaaaaaaaaaaaaaaaaaacccaaaaatcaaaaaacaaaaaaatcttcaggttccagagagaaggagccaaaagccaccatttctctaggagaactgcctttctcaagtgacagccagcacctcacgtatgatgcgatcccctcaataactctgaccaaagaacgattctggtagtggtgtacaaccaagccctttgcttaggaacaccatttccccagagttcctactggctcaagactaaggagcagtcttagttttagggaacttgacctacaattcctagggttggattagaccggcttgacaccttcctttctagagaagcctggcctggagggacgcgagccaacactggtgtctgtggaatctgtgctgatttgctttggatccacacaaggatctggacctgggccactggggacttctggttccctcagagtggatggtcaggggagccttcatacggcctactggcttctgttgggcctggtctcctggcctcttcttgtgtccactgtagtgggcagagtctgtgtttgggatggggtagtttgtgtctcttctattgtgtgactgctcaccatgatccccacgacccccatggtaaagatgggatgctattttttctctcaccctcaaagtgaaactccttccctgtctgagagagcctcgctgttaccccacccctcagggctccttcccaagttcatctgcccgggttgttactcggtgccagcatgagagagggcatcttgggttcctggcatcctgagtgctatgtcttgttaatattagccttgccaccacaggaactatcccctcaagatttattaacagctgtcctctaggagaatggcagaaggggagttggcaagttctgaagcccacatccttctgcaggccaagggacatacttcctaaggctcttcaatacagtaggtcagtctggtgggtccccagccagctacaggtagacctcagtggggaaattaccctgggtccccggatgaagagccacacccattcttccatgacagtctggacagaggatccaagatggctgatgagaaatcccccaggaggtggggcagccctggtgttcacagctccagctggctatggagagggcatcgctggatagaactgagatggtgccaggctcctgaggctctgatgcccaacctggcctgctctggctgttagtttcgccggactggatgccacatggacacaggcctgcgtagtgtggccagcatctggttccaatgtgtggtgcccatgccactgacccctggcccaatgatgacatggcccacgttgtccccacggccgtcgctgctgctctcagccactgtcacccggagagacaggtcctgggaagaaggtgacatgaaagattgggaccaggagcagctaaagggttctccctggctccaaggctccaaggccctgtgaggtgcatacagctatttgaatcttcccatctggcttgggaggagagacttgtcctagttacttccagatggataagccagctatgatgtgacctcgctaagtgctaaaaagtgacagtcccagcaggattcaaaatccatctctcagttctctgtccctcgacatttttttctttaagatttatttttgagtttgaaaagatgggtcagcaattaaacacacttgctgttcttgcagagaaccttggtttgagtcccagcatctgtacatcgactcagtcacctgaggctatctgaactctctctgtgggcgtctggcatgcatgttatgcacatacatacatgcaagcaaaatgctcaaacacttaaaataataaaaaccttcaaaaga

SEQ ID NO: 263 - DNA, 34281 bp, Mus musculus
agcggcgcttggagggcggccggagctgggcctgagcctggagactcgcctgatcccgggcggccgaaccaccatcaccacaaccgccccacccccgccgtcgcctcgtggggccccggccccctcccgggtccgtaagtgtcactgccttctgcgtctcggccgggctagaagagaggggctagggcgtcaggttggtagtctccactaagacagtgtcagggagccggctggactggttcaggggcctggggtatctctgtgggtccctcttgaacatctcaagggctcagggcttttcttgactacaggggggttgggggttaagctctaattgtgggtcagagctcaggcatctcccgcaaatcttcaagaccaaggtcaagggtcttgggatagcgagatgagacgcgcctgcggtgttcagaaagggacagggtgagaggtccgatggaagttgtggggaggtagagagagagaggtttgagggaaagaatgtttctgaaagaggtttcagggagtcccctccctaagtcctacccgtgactttcttctgccttcttatccctcaccgctccccccccacacacacacacaccaacacacaaataacctacaaagtggcttcctggaaaaaaatttttttgagaaaaatgaaacacatagcacccactctaagcaagatttgtgacgtctttttccccttttaaataggaagttgggagagccctcctttcagtactccactccatgctttggggcaggccttttggagctgtctgtgggcgtctctgacactccctccagtctagctttgagctgagaagaacaagggaaccatggatggagcttgaggctgtttagggtcatctctgggagaagcttgggtggtagggtgtcacaggaaggaggcagctggctctagcaaggagaggctccaggccaaatctctggagcagcaaagacatccaaaaaaatacaatctctgagccattgtggcagagaggccagatgctgggcttcaaggggagagagaccctctttgaatcttcttcatattgggggtgtgtgataggttcttaagggggtctggagtttgagggtctggctttcagtcaagggaggtcagaggtaggttaagtaggcacagacataggggtgcacctcaggagcctccaggagcaatactggctggtcacgggaaaggcttggcattttgaggaaggtattttgaggtccctgtttagaaaagcccacaccctgctgcctgccttcacctcagctgttgaggaagtgggcaggttaaaagacagaaaggaagatactgtccaatcggccatgtgtgtttgaggggaggtgtggaggcctctgtaccctctgggtacagggaactggctccatctgtggtaacccaaagctgggtctccttgtgaacagcccttcaagcctccagacaataggaagatcagcttaatcaaagcttgagcccaaggaagggatgggagagaaaagctgccagggggaagaggcacctggaatcagcctgggctgtggctagagattctgtgtcctaattacagcccagagggggatgaaagggagcgttgctgccaggctgaatggcaggccaagtggctgcatctgctttgctccaccagccccaggctcccagcctcaggatctgggcaaggtcctggtcgcaggacaagggtatctgcaccctactgtgagtgagggtgtgaattgtccttctcggaaccccttatctcataagcggagtaactaccgacagggaatagaagcacggagtcgaggcaagtggagttcatggagtggatgcctgccagcaggcgcaacagcactcctgtactgtgcatgtagatctgcatgcacaagtaacatgccagccttgggggcggcctcataagctgactgtgggagaaaatgcaaggtaggtttcagtgggctctagggcacatgtggatagtttctgtagattcagatatgggaactcagcgcaggatttttgtccctctgtggtgatttatgaaaataggagtatgaaaaatggagtctccaacctttggtggagatgtctaagtgctggccgtccccctggatgcttgcttttctaagttactgtaggcacccttaggactcaggtttcaaaccacaacttggagaccaaggaacttctgagctaggtgaactgctgaagacaaaaaaatgccgggtgggcagttctcagcaccatggccagggcctgtcagcaaccatgggttttctagctctagatccactgccagctctttcttgggacttagggacagtaggctagaggcaagagattgatataggaggaagtgtagcgaacttagacccggcccagagtacagtgtgaagatgaaaagacaatcagagccaaagtcagctgggtcctccgtgggtaggctcagccccaaacaatgtgtccctgctgggtctgacctggaggcttcccatcctgtacatgggtgtggctgctagctcaaggagactacctactgccctgtcccaccagaacatcctccaaagggcaagcaatggatgacccaaggcccacactcactgtggcctccttcctgagagagagctgataacaccttcatgcacccggacactggagacagagcccactccagcatggtgtaggaacctctgcctggctggcctcacctgctttggcaagggacatggtttcctaaaggacaacagaaatgtggctttggtggcactaacctgccttacctgaacagaaagcaaaatcaagctttttagtctttctcccagactcctaaccagccctaggctctcaggccagggctccagcgtgctataaccatgaacctcacagccgaggagccattttgtgcagcgtcctgcttaaatcacactctgagaacgctccttctctctttcccctctctcctgctccccactccccctctttcttctccctccccctctttcaggtgaatcgtgcttgcacagttccctctgcctcttcagttccacccatccaagctcagggtggcccagaaggactagagcgcaggaggccgcccacactgacagacacacagctaaatggaagagggtgtagattccagaggctgtaggaggagaagaaagggacacctcctaattatgaaaaatcctttagaattaaccaggcaggcccaaattcgaggttccttcctgggccttgctgtcggtaggtcggcccctctgtttctctgatgcttttcagtctagcctgtgtcctttttctgagacaaggatttgtctgtgaggtggcatttggaaagaggtgtgtaactgctagctggcttgctcactggctgacagggatggcagtggggatgcagcccaccttggatttggggtcaagataaaaaataggacgaatctaaaacaagcacggggtacagaggtgtggtgccaaagcctggtattaaacaaaaaaaatccagatgtgtcatttaagggagactgctttagatacctttagaaaaattccctgatcccttccaaatcacccactttgggcctattctttgaacccagccttatgggatttgctgatggagagtgtgtaaggggtgcccccccccccgcctcaccaaaacagatctgaatgagtacccccaccaaatctgggctgctttggggatgccttagcacagagagtctttgggactccctcatagtcactgctggaatcctggaacccgctaccccccacccccactctattgttaagtcaatctctagatcttggatttaagatctttctagggatgactgggggggggggaaggagatatcgaatttttcatatttaatcctttgcctcccaggaatgggtgaagggggtgaatcagggctcatagtgggaggggtgtacaggagcaaggaagacaggatgggtttcaggtgagcaacctctaaaccaccacgtttaggagactgagacgggacttcagtttggtggccaggctcaattctactgtgaaacctcaaaatgtcaattcttttgccctgtaaagtcacttggagtaagtgggctagggtgtgctgtgagcagaaagatggcaggagctgattatttttatgggaggtgaataggagcccaattacggccttggatatctttaaggcgcaggggcacaattgattacatatccttggctgtactaggaatggtcagagggaaagggctaacaatctggtgccgacatttaggacctggtttgagcgaagcatgccatgggaatccctacaagtcaggcaatatatatgggatacattgatctagacacccactccttcccttaatccccagtctctaccgcggtgtctgtacagtgctgggcaagaaaaaaaaggaagagagaccttaaggataaagtgaccggttcgcagcctctcctgcgctcacttggttgccttggagagacctcgaccttaaacctcttccctcaaactctaactctggtggtctgcggtggctgccaggcacctaagacgttgctgggaggtcagagaggtttgagagaaaggccagactgtgtgcatccaagcaagcaggcctaaggcttctgagggcagaagaggcgctcccctgtcctcgcggcgcagaagccgtgaacgccgaggccattgtaaggctgggtggtgccgagcgcgggaagggggctgggatttgaatggaagcccgtgataggccgatcccccgactgacgtcacttccccgcggggcgattagcctgcgagaggagggctgatggtccagtgcgctgggggccgccagggcgcccgaggctgcccaagcgcagagcgccggttacccgagtgcgccccgggacggcgtcgaagcgggccgcgcacgcactggacggggaactggggatggagaaatcgcgagggcgagggaggaagggagctgggcgatccgggtggcgggagtccgtgtgtctgtgtgtctgtcggtcccctctggctctccgcgtgcgcccggggctgcgggagcggagtccgctcaggcccccgcgccgggtcggcggcggcacgtggggcccacagcgcggcagcggtgccggcgaatgggaggcccgtttctctctttggttatctagctgtatgagtgccacagagccgtcataaagctagataaccgaaagtagaaatgactctcacaacttctgcgtgcgatggcccggccggccgccctggccacaggagccagaggagcccagagaagcccacgccacccagggattccagctcgacggagcggccacgccgggaccaggtatccgacctcggctctcctggggacacttgccgtgtcctggaggcattcccttcacctcctcctcggtccctgcacccccatcaccatttcccagcgccgaggctggaaccccgaagtggagtgggttgggggcagggaacgggctggggttgcagaggggtcgctggcggggaaggcgccagcctttgccttcaccccataaatcaggctagaacaatccacgccctgagctgcagactaggattttgggatgcaaatgcgatgagaaagagaacggagagaggaagggagagaggaagggagagagagaggaagggggagagagagagagagagagagagagagagagagagagagagagagagagagagaggagagagagagagagaccggtaggcagtgtgtagggggagtaaaagggtgggcagggggctgccctgccgctaacaatgcagcctttatcgaattattcgacgagtcagcccctgagcaccattagcatacggctggggggttgctggagcttcgcccctcggtgaggtcaagttcttgataatttgatcacttttcaccggctctggcagctgcctttgtgtgcagttggggggtctgtgtgcagcgtgaagcggagcagaactggcggggagtgtactcaatggcaaggggcctaggcggggggcctcccgccccgaccgaccggccctgccctgcatacaaaccaagagcaggctgctgggcgggagagacgtagcccagatcctctaaacctctatagttctggtcggacggctggggccggagcctccccaacttccccaactggttaagggggaagccaggctctctggagctcctctccttcccgccccaataaatggcaacataagatgtattacaatgtctagcaaataaaaaagcaattgggggaaaaaatctgaattccgttcccatggcaacccaatgctgcacaccggccactcaagctccaggtccctcttagctgggcgctgcgagtggggcgtgccaatgttctgtgtccgtggttcttagccccacaaggagcggaaggtccctttgaggtttctctgccttcaggtccctctccttcctgccactccctttactctttccttatcttgaagtttggggccccctgcaacttaggaaaccattagggctcccgcgtggtggatgtagacccagctatggaccctatcaagtgtagggaagaaaggatccaaagtcagttcacataccttaaggcttggggtcttttggggttctttaaggcacatatcagtgtatacatgctttagcagattgactgggaaggattagtgctaccatcctgacttgacccgctttcttttccttgaacatattaaggaagcagatctggggggtgagggcctactccttagggagtagcacacacagcgcagaagtgcagaggtgggcactacctaggtcaccttacctccatcttggcccagttcaatcccaagagcctcttgccttagttatttataagattggtctctcagcctctatccagaacctgcccagcccccttgtgataatagaaatctttttccatctttgtgcctaccagccgttcctcccccccccccacaccctttgcttagcaaaattatcttaacaacaaaaaggtgacttgtgtaaaagtaaaaataaattcagtgatacaaaggagaacctcctgggtctggggaggggcaaggtgtggcttccatacggtagatggagagtttttcactgcattgccttggaatgttagacaaaattaaacgcggtggcaggaaagcagctgtctctgtgcctccttctcagggactcattgggtggaaggaaggggttcgaggtcctttcatcttttccttcccgtttcttaggcctgtgaagggtcactcgcgtgtttgaggacccaggagcctccctccccccaactgcatctactgggcttgctcccccttcctggtgcacctgggagcctgtgtgctggtggtgacctcatttctgaggaaagcagagcagctctctcagcctgcttgcccagcactccctgcctccacgtctcacggatgggctggggcttccccagagcctgccccggtactcagagccttctcttccctggcccctctcctttgctatttttgtaagagccagtccttcctacaccaaggtggtcacatagcttcacgactgtgtcttaggtgtagttcaaatgtgtgtcgcctttggttcttttgccgtccaggcaggctggagtccccccattaggagtcccatggaggtagagtcctagcctgagacagtgcaggacttttactgctttctatgaagggggaaatctgctgatacaaaccttgcactttagggaaaagatgagggcctcaagggaggaggtggtggtggtggtgatggaatgggtctgctgattctgattcacagagtttatctcacacccaccacaaaaggttttcaggggtgccagcccatccattttatcctaacagagagatgttcaaatcccacccaggacccttggagcccgagacacaggcttaaaattgtgttccttatcaacctccctagctagcctatggcttccttggggagcttggagggtcctcagcctttgctcccccccacccatcctgtcccatttgttgagcgttctctggcctgactgcccaagtttgggttacactgctccaacttgcactaactagtctctttctataagaaaaggcttgtgggtcctgaaagcgccggctgaaagtacagttggaagcctaaattggttgagatctcaaagatgtcaacacctttcattttacaactagaaacgcggagcatgtcgcagaaggtcacacggtaggccacttggcaggtcagggttgagaacagccctcgttgagaaggaggcttcgaaggcttcttcctccgttgtccaaagaatttcaacactgaactataccggccatatgggcctcaacccgaccaatgaaagctggcatccgcagtcctcacggaaacgcacggtgcagcgaggccagaagctggctctagactggttcgggagttctcgaccgctgtcggacctcccgggaaatgggaacagagcacgaagcagccgggccaggaggcctcccaggacccagtgcgacgctgaaaagcatgaagggtcggaattaggcgctcatttagcgagcgttactaatccgaagttacagcgctaattccctgatcccgccgctcccacacgcagcgccgggattagaggcgcggccgccgcccgccccgccctcgcccccaacgcgcagccccgcgccccggggtccgcggatcccgctaagcctgcgctggcgctcctggccggccgaagcgtgcaagccggcctgcggagccgggcggggagcgctcagccgtgagccccggcacagtcttgcccggattgatgcgccctcaagggcccccccccgagagccggagtggtccggagaaccgctgggttttctcccatccgggtgtctacacccagaacagcggccctttggaggcttgcggcgccattttaatcgccttctctttctcctcggcttctcacacgcgtggggtgggatgtccttgtcccctcttccacccagactcgagcccagcctaccttcctccaccctggattaaatggccaatcagctttggcctagggtgggatgcgtattaccatggcgacggttatagaccccctagcagtggtacccaatacggagggtgtcttcactccacttgaagagtgtgaaaggaaattgggaacgagctagaggtaagaggctgaaggaaggttctggcgctttatccttacacgctccattctggaccctatgtggatgcggatgatgtggaccccatcttgagagctacctgggcttgtgttcagctttttaattagctgagatgatcactccacagtctttctcatcttggtccgaaggcccttctctctcttcctaagagagtaggagtcccagaaaacttttcccaaactgccctaagtgtaagtcccatgatttcaggcaagtccattttcccatccagaagatgggtggttgttcaggtgcacccaaggacaacattcaagaacaacatcaagcataacagtgatacaagctctgtcgtggttaatgccttcgaggacaggacttgttggggtaagacccaaaagctggggtgtcctttctagctagggtgcctcacagattcctagagctagcttttgatttctcctctagacagctggaaactgtagagaggaaggtcgttaacagaggagccggggtgggggctgtgactggaacaaaaccttggtcagtggctctgagaatgggcggccgcagctcctatagcgctggctccttccttccatcccggtccggcttaagcgccactttaagtggtccctgcattcactggccagcccctcaccgcaattgagccgcaggggtttgaaaagagggccagggcctcaatgacaggaccttgggccaggctaattggttttggttcaaggggatagtggatttgtgaaaagctccaaaccgcctttcccacgccagagccaggtcacagctttaaggaaaaaggttggaagagtttggggccaggggagaaatctgggagccaggtgcctaggactgatcctcttgtaccgtctaaagcacgtctctgcttgaagagtaggggatttgagggacctcaggagcacctgtgttttaggaacgggcaggttggagaccctgcatgccagcactgtgccagaagagtctcccacttctgattctttggctaaccctccctgtgaaaggggcccactttccccgctgggatcattcagaaaaataaaccacaacaaacagacaaatcagagatggccgagggaattaatagttcttacctcaaagaactggtctttgtcctgagacagtactagagttggcctcaagaaaacatacctattccttgatatgtctttaaactactttggtcactagcagatacttcagagataaggaacaagaagtcctcagtatttgaaaaaataaaataaaaagagtgtccaaagttttctttacagtctcaaaaaccaaccattaattgtaccatgccttaagtatcacaacttgtaaacgctttactgctcttgtctcaaaaggccttggaaacctatgcgtttgcaccaaatggtgaataatatacccattatatgggtgtgtatgtacaggctttgctgatatgcagaatcctacccttatattaacagtcatggagaggtgaagagtcagcactattgtttttttgtttttacactatgatggaactccagaccagctcaatgctaggcaagtgctctaccactgagctacatccctggtccagacctatttaaaggaacattgagtccataaagaattgcatatcatctccattgtgtgttgaatggaacattctaatgtcatcgcccgctgaagaaattcttccccaatcttcccaaatctgccctatgtttgcctacttgaagcatttgctatgtagaagaaaggtactttggagagatagagaactctatgtattacattttctggttttatttctatttttaattggccagagcctaatttctcccagcctctgttaatttgcacattggagattcatgtgtaaatatgcatgtggcatgtgtgcacgcctgggccttcttatcaccaagcgtgtgtttaaatacacacaatccgcatctacacatgattatgggcttactatttgcctcttctcggaatcgggttaattttcccttggctaatcctcaaacccattaagttctcctctcctctccccacccccaccaaaaaaaatgcaaaccccactacagaccaatggtctcaccctgcttctccagcaggcagctctccaggctggatgctggagtgaaggtccctattaggcagacttcattaatgttaccaaatataccccggcacatttactcggctactatgaagtattatcataaataattaaaattaaactgcacttgtcaaaataaatgaacaaagtggagttagtgatgtctttgctttgatttgcttgctagggccttgcttactcagtaatttgaagaaaagaagaaagagaaggagggaagaaagagcgactgccggagaagggcagagctgtggaaaggagaggggaagccctcctcaggcatctgccattgggcttccagtcattagggcgctctgggaggctggaatgcagcctcggacgtcagctcataatgaatattgaggtgtggatgtggaagggggatttctttgtttaccaaggaaaggccatgggagtgggggagaggattgcctttggggattaaggagtgggctttgtttttatgaagggcctcacttcttttctgaagttttctgcagctaattgattcaattcagacattcctcttacccacttggccagtgaggccttggtccttgtaagatgtgcacagccccagttccccatctgctctgccccctttctccactgtgacccttggaaaagggtgtgaacctgcacatcaaccagattgggtggatatgtgagatgtgcgcaggagacacacacacacacgcacacagacacatggacacacacacggacatgaatattgctagaggcatgattttcatctgtaaatagattctaggtatacagttctatgaattctgacaaataaatttacacctaagatagcagttccccttttccagaaacttctctcttgattcttcccagtctgcctgctcccgccccccccccccccgttttgaggtccctgtcagttatacctatccagggtttcatataaatggaatgtatgccagcacttttaaagaaagaatttatttcaagtctggagggagcacactccttggaggcctggctgagcatgtgtccaagattatcagacctgggttaagcattctccccctcaggtggacccagaagtcagacctgtaattagatagggatgggggttggcttgggctggtccttccacaggagagccctattctcaccctgggtctgttaatgagccggggacaggtgagcctcacacattccaactcgcctgccttcagcggcatccaggagctggtggtgagctattaatggaaggtgcaggctttgtgctaattagaactcttcagcttccatctgtgcagcactggagcccctcaccggtcagcctcaccacccccaccccagcttgcaacctagtttctgtttcccccatgaattagggggtgctgtgagcagaattgcttctcactggcttgggttaaatccctagtcttgatgtgttttagaaatgtacagggtggcatttctcagacctccctcttggtagggtatagttgcctcacaagttagatggaagttgaggaaccatggccactctccagggtaggccggggttacaatgtctgtctacaatgtctgttacaacgtctgtcggaggttgttttgtaaaggacttctggagagtgtagctccagtcccttgaattctggatgtctctggaatctagtctgattgttcccacctcacctcacctcacctcacctcacctcacctcacctcaccctatggctgctccaatctttgctgcctcagacagcctaggctagagccatgtcccttacccttcatctgaaaacaaaacaaaacaaaaaacaagacaaacaacccaaaaaacaaaacaaaaaaacaaacccaaaactttaaaaatgtagtatttcacctcaagtccaatggatatagtttctgactcttataaaggtttcactgaaaaagacttcattaatgtcatttaaagaaaacacggatctcagaatggagcttgggagaacttcttgcctaaaatatgaagggaaaagagagggtcatctccatgaatgcgcctttcagcctctgtattccctcaggtctcttggggttgtgtgcaaaaatatcaagcccataggccaatgcatctcatatcgttctggttgggttatcctgataatatcattgtgaactgtgagtgggttgtggtcattgtggggcttctctggttccctcaagtttgcatctaacactgaagaagggtggagcctgagagggctacagaaatcccctgcttagggggaaggtagaactggcttgcttgtgtggcttttcctgtgggtgatcactcctcactgaagttctagagttcaagatgaggaagcaccaggtttaaaaaccccacagtgtaaattttagaaagggtgagctgcctggtgtgctccacgctgaggcaggactctttcacaggttcttatccttttccacactgcatgaatccttgaggtgtgacctccacctctctaggtaaaatggggggggcacaatagtacctgtactgacagggctcctgtgaaatttacataaaacatacaaataaagtgcctggcacacagtaggtgttggtcaaatggtatctcaaatggcaggggcacacacacacacacacacacaccccaaagtctgaaattcaaaactccccctgctgaaggcagaatgaagaccccaatagatgcacatagtgtcaccaaagggtccattggctgcctacctccccagctagtaccatctctgctgagtcccaaggactgcaaaagagcacacacacacacacacacacacacacacacacacacacacacacaccaccccgtgtatggaaaaattctgggctgattaactagagggatatgtcttgagacacttgaagtcagcagactggctttagctactcttgcaaggaacgctggagctgaaagccaagagggcgcctcaaggagggcagtggttaatgcatggagaaaacctccgggggtctaaatcctcactagttgtgacattgggaaaagctatgtttgcgccttggttaggtcgagatctgccaaggcatccacgcatccacgagtcctgtctagtaccaaacatgggtactagatagaaccgctccctcccttccatagcaggtaccaatgtctctcccacttcctgggcgcgcgtggtgggagctcaggctgtggtggtgacttggaggacgcctgtgtcctcacctccaggccagtgctacagaacccttgaggattcgaataaaccgtacacacttctaggggtcggtggcggtgcccgtcttatcccctctgtgttacagttgctcaccagcaggcgctccagattcccgcacttccttcctgggctctgcagtccccatcgctagtccctacaactcctcagcatggagggcgccccaccgcacaggaaaggtgagtggctgtagccaagaaaggaggacaagtagagtcaaaaaaaaaaaaaaaaaatcccaatacccaaaaccaaaccccaaccaacgagccggcgaccaggaacgtcggaagaagccaggaccacgatgataaggagactgtgtttctacctgaatcccctgaaaggcgtccccgtccctctcaaagccagaaattaaagtcaccccccacccccattcccaagtgtgctatggctttaataatacacctgctggcttgtgctttgtaaggcaaccccgctgggctgggtgtggagggacccccgcaggcagagcgcactggggtgccagaagcaacctggcctccaaagtggcttattggacatctctggcctgagcttggctcgcgaggggcgatcgggagcctcggctggtaaaggggcggcctgcccggggctcgggacttggtcccgggcgctcgctctcggagcccgtgcggtaggagcttaggcagagattcccttggcggctccgcacgcacctcgagtcccaggcctccccgggcctacggaagcaccgggcgcccgcggcgaagccgactgggcaaggccctcggagcacggcctgagcacacacactggacgcccgggaccgaaaaggagacccggaggagcagccgcgtcccctgggcctgcgccaaggcttcggcggggcgcgctgcggggccgggaggccattttgagagcgaacgagcggcggcaagatggctgcgtgggcacgaggtaggtcgcagcgccgcagggtgcgccgagctcctcctcgcgccagcagggccgagccaagcccgggggagcggcgcgcgcagagagagcacccggcctcgggggccccggactcgtctgcagtgggctggcgccaagtattccagggtccccggaccatcgaccatcgtcgccccaggaccctgaggccaccgtgcctttccgggctgttgacgagaaagcagcaagagaaagtaggcgtctgttgggcccctggcaggtacgctggccagagggtcttctctgccaagctgaggttcaggcccagctgaccaacagcagtgacagtagtgtgtgcttgtttgtttttgttttgtttgtagtttggacccgagagcgcttggacagttatttccaagcagtgctaacctgtgcgaccaaaacccacacttccttaaagctaaggctggaggtagtgagcacccttctctccattatcctggcccctggtatgaccctaaggcaaagatagtccagggctccaacctgagatctgtgaaagtgtggtagaggctgagggtgacctagagacccccattctcgctgctcaggctggggtgagtctgtttgaggatgaaggtgacagaatgggagccaagggacagcatctttggatttgccctcaccaggcctcagcccaagagtcacaatttcatttctttttctgtgccctattccatcaatcattggtctgtctgcctccttaagccatggatgctccaaagcagaccctacacacgtatgtttgtgtacagagtcacccacccgttatcaatttatgttcgtaggactctgccttgtcccggggcctaagaaggccttggacctccttaaatgagtagggtgatgagtcccttaagtgacttccaccaaagtgtgtattcagagctgttaagcctgaggccttgttccttgatttaaatctctgcaagtacacataaacataaatacaaagattcagcctgtctgtcctcctttccagtaaccatcaggtctctcctgaactcacatccccttcttactcagcctatgtgacagatctcttggccaatgtctatcacaaaaccctggcttagaatagatttcatgatgggatattgctattgctctgagcttcctggcagtcaagacaaagaaaacatgatgactttataagcttgctcaaaaggggagcttatcaggatttgtgagagatgaacgttttttttctgacatatgttttgtataaaatttagagctttcgtgagatggggatgtagctcagtggtagagcacttgcctagtggtacactttacctagcaccagaaaaaatatattaaaaagctgggtgattatgtaggttgcacgcatatatcatagatggggcatgagccctccaaaacttgattttaccttgaggccactaagtacaataagaacatggacggggatcctaattaccagtccagtccccaatatccagaagccaggctttactggacttctcaacagggaaagactttacctgtggcctatgagtctcacttttgacgatgatcattctttcggctggggtgctctctcgttctttgccctggttcaaggtgctaaactggacttattgctgtaggaatctataaacatgttgtaaacaaaaaactaaagctgaacccagtattgagatgacagtagggctggagaagctgcagcggtgactggggggcaggtactttgtttttttcagtgtggagttcctttacctggtaatataacccctctgagcccccccccccccagcaaatagtgagagctgggttccccctgtatgctgggcctcggttcctagctgcactcccacacatcctagcccttgctggaaggggtcatttgtctttcagggggagctgtcagtgaggactacaaatccctttaggtgaagcaaggaaggtttcccctgttgtgccaggggatcttttgtcttctttagtggagtgccatgcaggcttcttttcctccacaggtttggttcttgtggctttaagtactgagtaagtcacactgacctaagtgtgactcagcttagtaaatgtcactggcccccgaaggtggagtttgaatccttggcttgatgactgcaggaaatagtttaataacccagaaatctgtacccaaaagtgtccctcctgaatgtggggaggggtatgcttcttagtagggagcccccattttcagaaaggctctggccagatctggtcccagtcctagtgccttccaacagggtctccaagggcaaagctgcagaactgggtccagttcgcagctaaagccccagctgcagaagaaaaacagggttcagctccccagattagttactgtctgcaaggattaaaggccccaaataatggctggcttctcccctcctctgtgccaagggaaggcatgtaaatacagccgcacgccagcttaggcagtagatgtgtataaatcgaatttagcaaatcagatcatggtttaaatgcactatttaaagcagtcctgcagggaagccttttacaaagggaataatcattttgtgatgctaatcatcagcctccaatttatctcctttgtaagttcagatgttggtgcactgggtgttctgaaattggggcgctctggtgtagggcttcagtgatggctgtctgccttcctttcctgacctctcattttaaatgggtgcatgtcctgtttctcactgggggcctcaggatgtgtgtcacttagcctgatagttctcatccatcccactcatcttttcataatctcatagaggccaccattcagctgctcctggctccttttctaagatttttcctcttcctgggggagatgcaagccctgctgttcccaggcattggaactaactccctctctgatctgaaccttcctttgtttcccctgagcttctggtacttctgttgttgatcataaagacgatttcagagatgactacatgacacttaatcaacctctgaatttagaaggcaaattaaatgcaggcacccctttattgaataggtagtgtccattcacagaaggaaaaaaaaaaagcgagccctgaggcctggatgttaaagtgactttttcccacaagttaaaatcagaactcaaagaagaacctgtctcctaattgctataaaagtgttttatacactgagctgtagttcctttctctgcagagaaaataaaatcagaccatctgggtgggagagagaatgaaggaaagagatggatcggagtggaataaaggaagtgggcaggaagctgaggagctgtgaagagcctgaccttgcttagctcacaagccctgatatagtgtctttgtcaatgctgccactattgacgcgttccttggtaattatgactgtgtgttggcatggcgactcagtaagaagactagaggcactgggtaaatgcagggcttgtcctcaccttctaaagcagagaggagcttttgtgggtagttcctccagggagacgcggtggaaaattcaccagaccctgtgctggggcatgggtattgacacaccatgggagccaggcggccctgagcaggatggcacaaacaagacttggtctgacactgaggtctcccagatccaccctccagttcctttccattgtctttgttccccaggcttgtaacatctagtgtgtccattcctagtcctttctgggttgtctatttcaaataggtttatgttgcagtctccctgaacttgattgatcatacagtcatctacctaatagtccatggttgtgcatctggaagccgaaaggaaaggctggtaggcccagctgtaaggagggggtctggggctggctttgctttcttcattggtgccttctccagagattctttaaccacacactcatctaaaaatgaggacttgctgctagagtcaaaagctgtcctgtccaatgtgatatccaatagacgtgaatagtttatctcataagtgtgagcagtatggcacatttaaataatctctgactaaataaaatacataattataatgacctgcttcttctgtctttggaatgaggcttctagaacatttgagattacacaggaactgaaatggcaggtctaaaccagatgatggagccctcttacagacttagacttgtgcctgattcttctgatctcacgcaggaggtgtctaatctcagaggtctatgtttagagtgcagtggaaaagccaggtggagggtctcaggcctggaagagcctgttgtgtgggagaatcacccctcagtctttggaggtggaagctatggcctgagttcgtaggcaacattgtgtttttcagcatagggtgaggttaaccctggaagaatctttccatgaagggtcagcagccccctagtgggtttgtgtaggtagagctggagctgacaggttcattgttccaagagtggcacccacaccaggcagtggtgacttcacactctcccagatacacaagaaccactaaacaaggaaagacagctgtgtgtctcaggttcgtatcaaactcccttttggctaggttcctttggaagatggctggggctgcctatctcttggctgcccctcctcccctcagcctcagccgatgtgcaagctggagcttctgggatactccttggctcaaagccagcattttcttggagaggctcctgctttggctccctgccaggcctctggtctccagagaggtttcccccccccccccaggggaggtgctgggcttgtcctgctgtcagagggctgaggcctgttcagccttctcaccttgggagaccccaggctgtgggctagccttgccaccagccctggcccctttcagaatatccagtttcttgctaggggaatctggtctgggtcaaggagctttcagctcccatactctaggactgtctgaaaagtgcctcctccctggagcctgagagacagggagtgggaatcatgagtcctggggaagatgccacaaacatttaccaggcacaagcactgtgccaggctctgtgctaatctttgcatgctgggtctttgaggcctggctcagtggagtaaagataatacagggtccacccttcttttctcgtcatggggattgcttgaggtgggtctcagaagctatctcggttttcacaaggtccttgtctcccaaggaagctgctaggctttcaaagcagcccaggacttgtttaggctgtgagaagatgtctctgcagcgtctcctgcttcacgcaggccacactgctgaataatccagatgggagagctcagcgctaggcccccaggaagcccaggagaattggagaggtggcaaacagctcctctggtcctggcttgtcttgatagtgtctgtcagctaactccttgctgtacttcagtttatacaaatcagggtagttctaggacagccagagatacatagagataccctgtctcaaataaaataagctaaatcagggtgacccaactccacacgctttcacaattgcaagagactgactgctcagggtgagtgtggtggatcttgctttctgctcctagaaggggtatccttctatggaaggatagaatctatgtcctctgttcaatcttgttttctttctaaggtgtgtgtgtgtgtgtgtgtgtgtgtgtttaacatgcaggagttggttctctcttctgtgtgggcctggtgatcaaactccgttgtcaggtttggcagccttcctgagtcgtgttgccaatctctcccttatgctgtcagagcccagccgtgaggcagaggccacagggctcccgggatccaggccgggcctttctgatccagtccagaaacaatgagcatactgcttctcctctttgtgagctgctgttctcaactgtgaatttggggttagcactcaggaaataccagggcccaagttcagtctctgggtctgagaataagaagagaaaggaaaggaaagggaaaagaggggagaagagatgtcatgtcacacattggttagaaataaaatccctggaagatagtaagcaagggaccaagcttagctctctctcatgttgcactcaagttgttgttttgtcttctgcttgtccacaagctccatagtggagggaaacccagagctgctccctgacttctggatcacagagatcagcttgagcagtgttagcaggcacacatgtaggagtttatgagcacacatacagggtatatgattgaacttgggtccaggaagttaagaaaagagggattttctggagaaagaaataccagagaaggcatcctgtgcccaaacgtgtcttttaggccaccaagagggcaggatccacgccagaggatgatatcctctggccagaggttcagagaagctggaagtattatactacactgggcttgagatttaggtatggagcatcaggtcatatggtagaagccaagaataacaaggcagggagacagctaaaggaactggtctggtcaccatgggaacaaggtggtgaggccccatgccacctaggccagctggagctgagcaggcataccaactctgtgcctggcacctcatcgcacttgccttggactctatcacggagccatttccaactttgtggggtaattgtggagctcagaagttggacatcttcccatgccacattatttttttttaccacaatcatttattcattcaacatttattgactgcacattatgtgtcaggcaaggccttggggacacagaggaggaaaccacagtcctccactgagcccttgagctcttgtaatatggaacttcacgtgtccatccacagcaggaaggtcagcctgagggagggagtgctgagttagcaggcatgggatgtgacagtgaccatcagtctgtggcttcttgcctcccccatgcccctcattcttcaaggacctgcagaataaagtcagaggccacttcacgctttgccatggtgaccatcagctgtcacttagctcagctagacttcactagctaaatcctctagatcccactggccctatagtctcttcttctccatttaaaacaatttggatcttaagaaacagaatatcaataacttgttgagatttatgtgtaaaactagtaggaaatatcttaagtgcaattggatattaaacagtacttggagggattcatggaagaattcgtggtttcttctccttagacaccagaagcttgtccagagtaccagctttggaattccctcctggttctccttcagctggattccaagcacagtttttggcagtcaggtctacatgcaaactcacagtggtgagcacctggccaccacttcccacatagctggactgtggcccagccctgcaaacaaatccctctccctagcactctatcccggactgtcccttgccttcctagaacaggaaagacaaataggtttcttctcatcactactattctggtgaacttgttactggtaacttgttttgtgtgtgtgtgtgtgtgtgtgtgtgtgtgtgtgtgtgtgtgtgtgtatgtgtgtgtgtagataaagcttttagatattgtatggtggttatcacagcacataggaaagagtccattccacttctggctgcttggaagttccttctaaatctttgaatgattgagccaccagaagactagggggatctgtcctgccctcatcctcattgtgcactgtccagttgttgctggtgggcaaggtgagtatacttgaagtaggctttcttctgcggacgggtgagtagcggctgctgagactgcagtgctggattcttcctgaaacgtctgtctttcctgtaggaaaccgagaggtcagtgaagatgtttcccaggaagacagcatgtcctcttagttcttatgctgagccacagagcaaggggatgcacagggaccaacagcaagtgggtcttccctgcactggtggccttaactctcttgtggcttcctttgcttaggtttctggaggcagtttactgaataaatgtcacatccacagagacttgccaagggcttaaatatgggagtgagttgacagcacacacttcagtcacgaggctcctgagagatgcttcctttagagcaaagtggctcacagactcctgtgctgagggagtgggtgcgcaaccgtctcacttcctgttctgctctccctctcatgggccttgtctctcttccaggatgcactccagggtgggccaggagaaaagagaaaagacagcttggtgatgactaagaaggtgggttccctcccaaccttggctgcaggccccacactaagaagctgggttccttcccaacctccgctgtaggccccacatagacactgatagctctctccagcagctgttctttctctgtgtgtggctggaagtccatgtagaattcactcagtttacgtcctcattacggtttcctttactggtacaaaagcacctgctcgaggaaggcattgaaatcgaaacagggaaggcaggtgtgggggtgttcaagtcctgtcctggctactcgggaaactgaggcaggaggaatgcttgatcccaggagctcaaggtcaattgcaacaaccaataaggtcctatctcaaaatatgctacagtaaaattagataaataaacaagtggaatgtttccttcttgtgggagcagttgcttgctaggttgacccatataaaatgtctttattgttaaactgagaacagtcgactattggctattcaagctagtacttttccatcgtggggtggtatatagtaatcatttatgtttctcttcctcctgtgatacttatctccgaattattttaacagcaagaaactggagcctaagctagtactgagaggaaagctacctctgcagcgctccactttgccccagcttcaggatatgttgtcttgggatacaggacaatgcagatgactttcgaagcccagatacaatggttcgtgcctttaaccctagtacttgggagatggagacaggatgcagatgactttcgaagcccagatacaatggtttgtgcctttaaccctagtacttgggagatggagacaggacagtaaggagttcaaggcaagccagggctacatgagaccctgcctcagaaaacaaacaaaggaagagacaggacaaaaaggagagagctggggtgctgccccgcagtggcaccataacctttggccaccccagtggcaggagctcctgacggaccgctcttgtcgtccagtgctcattacaccactgtcagtgtgtgtctgctgccgcctctgggtgtgtgtgtttctttttgtatctcgtgtcagtgtcaggcagtgtgtgtctatttatgtcggcctgtctaggcgtgctcagtgcaacagggagctgggggcggtgttgggaaaaagaagacatttcagagcctcagctctccccctcagggatatcaggatgctggtatgtatgtacttgcacacatacagatacaggattctttttctcttgttcactgtgtggggatgcagtcgagggtctggccaggtatggcctgagcagttgccgggctgggtgagccccatctgccaagagctcccagttgccttccttctgccctgtccatggggggcctgcccctctgcagtttaccatctacttcctaatgtagtagatgggaaggaggagaagatgaaatgttgcctgcaaacaatggccgagacagcctgtctcaccctgcacaaccaccagtgcctctgtccctagccacatctctatagtgagtctacacactactctgctaagcctgaggtgagaaagaaaggaaaccccccaactatgctattcaaaaattatgcccgatgcttgcacatgcagagatagttgtagactgttgaaggaagagccaccaggttgaaggcttgagtcagagtttgtatctatctgctgggcccacaggcacaaggtcctgcatccactctagtgctcccatctcttagtcccaagacctctccctagctcccagccaagcaagggaggggcaaggggcccaaggcagctgcaggggctatgttagtaaacactttactggcttcctattttcttcacacacaccccccacccttctccactccctgatgcccctaacacactccccacccccccagcatccccctttctgtggcctgcacaatgagcttattgtcccgggtgtgatttgaataagggatctgcgggcctgttcccagcattgtccgaggggctgggaaaaaccccagtgcaggcaggaggaccagaccagacagagacagatgcctaaattagcaacaaagctttgtgcaggtcccccggacaagggatcgccttgtctgcgtggactcgagggtgtggagctggccggctgctcgcatgtctccccatgttaattagttttgcatgcatgtctgagaaggtgccaggggagatgtgtttgccttcctcctcccccaggagggggctgtgtttgtggctggccagtgggctggaggctgtggagttgagcttggcaaggctatgcgggcctacctggggagctaggctgtggctctgagtggggaatcccagctttcctgtcctgctgctcttcagcctgtgggaagcctggccttgctctctgtgcccctccactccttcccctacccctgaaagttggtcagctctgactctaggggactcattggcttctacccagacctaggctactgcctgtccatctggcagtctgtctcttgtgacacaaggccccttgggaccaggcagcagaagcgaccagtctgggctctcctctgtcccagagccagatggccagtcggcttatcgcattatggcctcctctgtccccaggcccctgccgtccataacaggtcagggtcttgtttaggatatgatggggaagttcccttttaggcccttgtagtagggtggtagacagggtacagtcatggccttgccactggcttactgtgtgaccttggacagattaagagtccctttgactcttaatgtcagtagcacagtgatgaagctgagcttcaggaactcctggttctgtcccagctgaggacatctctgctggtggtgatcattttagcttgtgttcatttagcacaatgacaagagtgagactagtgagttctgagtgtgggtgggtgaggttatggaaagaaggagttgatcactgcacacgctgaagtctggggttttttgagcaattgatgggaggtcaggagtcagcagagcctgtctccccaggtccttacacagagcccgctctgagacttcctctggcctctatgctgcagtggtggaaagtcaccccagcccagcacaggagaggagagcaactgctgactggtgccctgggtgtgtcccattcactccctgcaggccctgggcgagggcacaggactgagaaatgctgggtaccttccaggctaagctcagccaggcctcctagcaactttccagctcatgtcttcagagcatccacccctctagagctccacaggagccccataaagtaaggggcatggggatgcagccttactccctcatccatgtgcaagtgtctgcacatgtgactttgagctctttgtgggtcatcttccatcactcgtcttgccctcttgtgacacagcctatgggttactggacttccaagcctcgggctagtcagtcctaactccccattcctttctgattagattttattaccaagcctatgccattcttcatatacagaaaaggaactaattaatctgtgtaagtgcatgtgtatgtgtgtgtgtgcgtttcaaattttagatagggtctacatatacccctggatgtcctggaatttcccatgtactccagactggcattgaattacagagatttgcctgcctctgtctcctgtatcctgggactcaaggagtgtaccaccatgctcaactactgtgtgtctctttaataagttaggtgtctttaagaagatgttctaatgcccagttccctctcttatttcttctttggcagccttctctcctcagacatggtgggatgtactctgatctagagcaggcagctggccagaggcccacagggagctcagtgattggcctcagatgaccttggggacaaaggtgagccttgagccattctcttctgattgtatggctctagccagtttcttacttcccgccccgttctccatgtagctatccttcatctgcctccccacctgtttcttagtctatccaggagtctagtggactggtctagaccttagtgaagtcaggtacagtgagcctgcagtaggggtggggaagagtcaagatggcagggacttgggggagctgcctgctgccctccctgcctcaccccactctgagctgcctcagctgctgcctcagctgtatctctgagctccttaatctggtgatcagtgtggtgctgggagggcgggctggcagaggctttagaggtgacaagggatcttaggagtcacactctgctaatggagcatcaccaagtgtcatggcaaagctggggaatcacattccaagcgcagcttcccctctggaggcagtagccttggctgggctggacccaggacgggtggtacccagtatatgttgggacatcagcactgactgcagcaatgcagcaccttgttctttgttcctaagaagaaaacttcccaagatcagtattttctaggcctttctatgtgactaggcttttattttttggtagctgcccttagctgtatgctaggtcctagatcttccagctgccaaatctcaattagaatagtctcctctgagatgctcaggccagggctgagtggttatgctagatggtacactttccatatgagtttgagtggctcagagaaaacccagagtttagaaattgaagtcaggttgctgaatacagttccaggtagttctgggggcatggccaccaggaggcaggaaaatcctggctggagagaagggacagaggaagagatgctgtgggcagacactcagccctggattaatgggcagttagatcctgaatgttctggagtctctaaagtatcatttgtgatgttgggaaaaccctacatagagttgttgtgactggtgccagacacacatgctctcttccttaactgagtgatagctaggaaggccatttaatatggctttgagctgaggggacagacatggtagtgatgtctagagcattcatcaccagtatggcctcggtaccagcatggcaactggcctgaaccagcagcccagtgaagagggcacagctggacccaaataaatctatgtgtctttctgtctctctgctccatcacattggtgtctattcctcaaacacacaaacctgccttagggcaattcctgacaggatggcagaacacaagatttcagggtgtcttttgctctctttcaccaggtcagctctgcttcctgtgggggggcataccccatcagatccaacctgtcccagtctctccccctctccccctctccccctctcccctctccccctctctctctccctccctccctctctccccctctccccctctccctccctccccctctccctccctccctctctccctccctccccctctccctccctccctccctccctccctccctctctccctccctccccctctccctccctccctccctctctccctccctccgtccctccctctctccctccctccgtccctctcttcctctctttctctctctctggaatgggatgaacttctgaatctctcaccttttcagaagcactgtgggccaaggagtggaggcctgtgctccttctgacccacctcctcgtgcctggcttctttctctaggggaggccagtgacagtgctgcctgttgtctgagcctgtgatgctggaggtggaataaagccaaggtgcatctctgaagaaagcttctggcctcaagccagccccaggattttggagactctcccctctcctgggcatgtgcacctagacagtagtggtttctactgagttcttttcttcctgaaatctttccctttcagggtccaaggtggcctaggaaagaaacaagatcacaagaagaccagccccacttacctggaagtcagagaatgccctcctgaccaccgtctttcttagtggtcttaggcaagcctctttcttctccaaacctgggaagggaacactggataggatgccgtctgcggtactctgcccctacattttataatttgggaattcttttttttttttctgctttattaccttcgagtcacctcacctcctgctccctgagtttcaggaaacccagccatctttttctccttcgtgctgccctgagacatagtagacagacacctctacctaaggcctacaaactaatgaacaaccaaccaaccccgatgcttcttttactgctagcctgcagctttgggtggaaagtaccctgtcctgagcaaaggcctggaccagagcacatgcgcttagactaggtgtgctttcaacccgagtctgcatgctttgccttcttctctagctccaaatggcttcaggaaggatttgtcatacttccctgatccaaagcctttagactcaaaagctccctaccctcaggaatccatgagagcatcacttcttgaagcctggtccctttccctgccttccccagccaggtggctctgttagagacacagctgagacaactgtagctgtgaagggtagagggtgtggaacaatacctttgtattaccagggtgaccctgggctagtgcatagtctctcagccagagtctccatgttgctaaaatgagaaaggggtagagagctttctaagcatgctcaaggctttgagatctattcttagactcaaaatagaacaagaacaacaaaacaataaccatacctggactggagagatggctcagcagttaagaacactggctgctcttccaaatgacttaggttcgaatcccagcacccaaatggcagttcacaactatctgtaattctaattccaggggatctgacaccttcacacagacatacatgaagacagaacaatgtagatgcaattaaaaacaataataacaactataccgttcacataagtgtacacaaagacacaaataatctaggagaacactttggaatgattaagttaaatctcttttatcccagctggccccagaagttccaaaggccatggtcataaagaaatccttttttctctgtttcaggagttccctgctggggatgtctggaggtaaagttggaagatcctctctcctccccgtttctctcttcccagagagcaacagttcctagtttcagccctgatgatacctgaatggaattcataggacagcaaccgccccacgtgcaagtgcaagcggcttacagactatctctcttgtctttagattgtcctgtgaagggaagtgatggcacaggctctgatcagctcttctgggaacagacagagaagtgagaattcctgccaaagccacaggatgaacacagagccaagaacctgaaccagaaaaatccagcaggaaaggaacctgcactagccaccatcctgaggctgctgtacagggagcaatcctaccgcagggacttggcaggagaccaggggcctgctccccagtcctcctcgagggcctctgtcaccgacctgcttgtctaggatctcctttctttctgcttgtgccacatctttcaggcctgttctgggtctgatgtgctatagaacactctgttcaggcacttgggaaatagagacttcatcaccagcatttccacccccaaagaactaggcagcacactgggaagttgccaaaggaagggactccagcctcccaggagttaacaacatttctccccagctatcctccccttggtgctcctcttcctccctcctcctgctcacagcaggcagggcctggaaccaggagccatgctgctgtgctgttgccaggggagctgggaggcagatcggagctatgcagggaaaaggctcggcctgtcagagtgtctgagatgaaccaccgccatccctgtgcagctgggctccatgtgtctcagggctcttgttctgtgcctgagaacggtgaagcccagcgaggttcaagggcacactcgctattcatcagtcgggggttcttgacggtcctgcctctcccagggatgggttccccccttcctctttctctccctcctatgatacattcctgggtgcctgtggtgaggactgcacacccccttctccacagcccccccaaaccctgaatcaactcctattaaggaggccaggcgagacagggacaatggcttcaagaaatcattcaggcgggacctcagtcacattcgcatgcccgtcactcccagagcccctgtagatcccactctgctgtgattcagggacccttgggcccccagcttgcacatgcctagacaggagcaggccactaggtgctgccctacacaacaggccagtgcagtgtttgttctcagggaccctggggcctccatcccactggctggatagtgtgtgcagtcagttggagagcagaaactacaatattttctgaaatgtggtaatatcaagatataagaggcacatatacgtgatgactaatttcacttcagatatactggaaaagtttgctaagaacatggacaaagacctgtggttgagtaacgagtcatttcattccatggaatattacacacctgtaagactgtggtagatctacctctgcatgcaggctgatagggaaggttgctaatatacttaagtgaatagaataaagtacaaaacagtcaagtgtgttcttgtttgtatatacttaaaggtcagttacggtggcaggggtgtgtgaagctcagtggtaaaatgcacacagcatacaggaggcctagagccaaaaaaccctgtatcaaccataagtatgtctgcatgaatggttggcaagcaagccctgcccagcagcctccaggaagcaggaggcctttcctcctgtgtctttgtgtttgttttctctctgcgtttgtgaagcacttttattgaaaaaaagaaaggatagtaatcacttaataggtgtaacttctctcagccaacgaagggcatgcactccaagacaaggtggtgatgtggctgagaagtgtcttgacagtactggtggcctctggccactggcggttctccaaccacatgtcatcatcatgactgccactgttaatcgaaagcccacttagtcccagggttagttctctggttcctgcttaggtgagtgtcctagtatttcagtctagccaatgcaggagactgaatggggaaatcagtgggtttctccaagctgtttgggtcaagtcagtatcctagagtgggtaaggcaagtgtgggctctgatttccctctgggaggacctgttttgaggagggggcttgtgggctgtgttgattatgagtgagcactcctacttgctttagcccagtggaggtgccctgctggggacaggctggcttcaggagttgactgtctctgaaccactccatctgcatacacacagcaagtattcagagacaccaccggactttgctgctcccagtgttaatcaaaagcctggccttgccctcaaaggagtaaattgctgagggcatctggaaagcgcaatgtggagctgagcactgagtcttggagccaacatcctgtggagctctgtctgcgttgggccctgatgcctgggagtgggcaaggaaagatcgcagtagagttgaccagaagaacctgggagacccatggaggtccctgggcttagatggcagctttgaaagtcaggaggaaagcaactaggggtggggctgtcaccaggtctcttactttggtgcagtgagtcttagttttataaggtgctggtacactcattttacaggtgacatttaagttcagaaatgttgctacatgtcccaggtcacagttaaaaactgccagaactgagatttaacacctaccccattggttgcggtctgaattcataaccccaaatttattctttttggctgagccacttaagagaggtctcctgagctccaagccttcctagccagttccatacatagagacatagagacttctgccttcaaggttcccccagtatcttgcctggggtcttccctaattccacctaattttatctgtgaggtatactaagctttggaacctggacctagagctggagaagaaatccaaagccatatacagactggggcccttcagttagtgttgctattagcactaatgctatttgcttcctgagtccggtcatctgcattgtgcagatgcgctctctttcttcaggtccttgaccctaaagcctgatgggaggtcaaggatgctccagggcctaccccttgcttctcagagctggatctgctgagggctgcagcaagcctaagactggaggatcaggcatgggagagcaaaaggaataaccaggcttagaaatcattggaactcttacttcaggacaaccctgagggatgattaagccaaattctgagagagaagcactcttctgaccctgggaaacctctgcctcttttaccccagctcacaactaataaaagttcg

SEQ ID NO: 264 - DNA, 118812 bp, Mus musculus
aataatctccaccccctgccgaggcttcaacattatatctatccctccttgctctagcgggcagcaagaagcacagcaccgccagttaccacgcagacatcctggggaactgaggtaagctagggttccccgcgtgaagcgcggcaatgcgaggggaggattctgcagatgagggtaggattccgttgcaaggggaggattccacgcgttagaggattccgcaaaggaagggttccacaggagggaagggctctacgcgaggtgagggttccactgatccggcagctcgagggctccgaccaagagttccaggccgctcaaaggttcccctacgcgagattcagcgctagggtgaagatttctgggctacaagaaaactcagcactagggtgccccactgctcaccagtgttctgaactacacgagggccgatagggccggtagaaagccgaaagccgcgctgccgccatgccgcgtcagcaagaggagaagggaggggggcgtccagcgcgggccgactgctgcactggggggggggggggtttacgggcgatctagagcacgagggtgccacgctgcgcaaggggagcaggggttcgcgctagggcaccacgctgctggagagttgggggggggggtggagatcggaggatttctacacgacctgatccgcggtttgcggggcagggggaaggttcggtgggttccgcggcactgcgcgagccagggtgctggcgtgtgcgctgccccccccccccccccccgttcagaggattttagcacaactccaattgtgctgcgattctggttgtgccgagttgcgagagaggctaagggtgaaaagctgcacaaggaggggattcggagggtttagagggttccgcggcactgcgccgcagtgctgcccgagggttcggagcaattccggttgtgccgtgatccttggttgtgctgagttgcggtgagggaaagggaagggaaagctcagagggttccgagctatcctgagggtgcgaagctgcacaagggcagggttccgagggttccgcggcactgcgtgagccccggtgccgcgctgcccaaaggttcggagggttttaatgcgattccggttgggctgtgattctggttatgccaagttgcgcgaggggaggggaagagacggctcggaggattccgaggtatcctgagggtgcaaactgcacaaggggaggattcgaagggttctgtgatcagggccaacgctcaaaagtgccatgttacaggagagatgaactcaaaagtgccacgttgcaagagaggcaagctcaaaagtgccgcgttgcaggagacggagggaagggcagggtttggcgctatcctggctatgcatgagggtgccacactcctgcgcaagattagggttcctcattggccatgcaaatgaaggtgccccactagcggacaggaggattcagagggctctgcactatccaggctgtgctcaggggcacatgaaggtgccatattctatacaaagggagagttcaaagggttggaccctcagagcgcatttcgagtggattcaggtttcatgttatgttgcctagttgtgctagggttcagcgcaaatctgggcaagggactgtacattgtattcgatgcaatcaagttggccattgtgctaaggagtgcctttaacccaaggcttgtctgagctgcagacaatggggctaatggaagatgggccatctgtccggtcatatccgtaccctcgacctctcagtgacattctatatctgggcccacctattccctctagtctggtcccattttcagaacctggagagacccttctgactttgtcaccaggaccaattattatcctcatgcctaccacccacgtggtaccccacccactacggtctttaggctattgctaagtggctactacaaacagctcttttaacaacccaccagttctcatcacaacactcctattctcagttactaaaaagccttagtagttcttatcactcggtccaaaaccctgaaaaaaattaatcaggccattgttcccacctcctctgttgtactggctggtacatcttgggatcaccttgacacaagctagagtcactagagaaggaggagactcaattgaggaaaacgcctccatgaaatccagctgtaaggccgcattttctcaattagtaaccaataaggaagggcccagccaattgtgggtggtgccatctctgggttggttggtggtcctgggttctataagaaaggaagctgagcaagccatgggtagcaagccagtaagcagcatccctaccaccaccggcctctgcatcagctcctgcctccaggttcctagcctgcttaactatgatgtggaaataagccaaataagcccttttctccccaacttgctttttggtcacggtggttcatcacagcaagagaaacctggagtaagacaccatcctaccctactcacctctccctgagatccaaatagggtgtgtctcagacccatcccactcctctctaaaacataaatggcaggcccctaccaccacaaaatgaaatgttaaaaccctgtctatctttccaggctcaagaaggttcccccaatttcattccatacctctaagccccaccttttaagctcacaatatacagacttcccagttcctatcaatcgctgaggaataatcaccaacttctttgtctgctccctttcctgagtacattccaagttctgcttttcctggatacaatacagaaagacctataactggccctgggcccagtacacaccatggcagcttttccaaaaccccttgacatccccttcactctggtcagatgagcatatcatctgcaacactgtacagtctaagtttaaatggctctcaggcccaggcccctccccaacgcctgaaatccccctgttgacattcctgtctggaaccttcttccactgctaccctcctgtgactgaataattaccaaattaacttggacagccttattctcctatgggccacccacttcctggatcccaaccaattattccctcaacaagagccctgcaatttttcattccagtggtattggaactggagccaacacctctcctgggccacaatatgacaacctacagtcccttgaaaacataagggtggatggggagacacctactagtccttcctcaaatactgttgtgttgattttgttagcccaggagtacaggcagaggcacctacaaaggggcaagcagttgagtcccatacaggaagggggtaacataaggatgacataatttgggagttgcccaggaaaaaaccctccacgtggggtacctacaacttcaaattgggcttatacatccatggggcaaagagcctcctccaaactttacaactgtcatttctgttccgatgagcacaaaacctcaagactgagataccacaaagagagtcaaggacagtcaccccttctttaatctcaacactcctctcatagaaacactaccattggcaaattccagccatctctgatccagggctggggaaggactcctggatttgtctgagggctgccaaataacttatactagggtaggcattcaacttaagacacaccaaccatgaacatataaatctgttagcaggacccctggctgggacagctggggagaccaactaaattcagtaccagaaacaaattgtccccatttgccttgccttgggaacttgggacttatgtgcacatcaggacaacactcacatgattgctactccagaggatactctttctcaccctggactaagatgttccaggggtgggaagtctacagacatcttatctgtccataacagtcagagaaagagaaacttcaagctattccctgtccacctgggaaagacctagcagggccatcagctacgagcacaccagtgacagggctccaacaggtataacacagacaactgaccagttagactaggaaagacctgaccccagtatagcaaagtatggtcaccttacaaaatccaatacacgccctggctacagcgatcctccagaagagtgggcactagatgtaacagctgctggaagcggagcatctgtgccttcctagggaagactgctggctcacaggaccatccagcccggcaggggaaaggctaaacgattattaggagagagagagtagaaaacacttgagatacctggactatttggggaccatgtggcaggccaaatgttcacttttacagctttgctgtttggccctccttttcagctgtctaactaagttcctccaacaaaggctccaagtttttattgccaagacagtcacaaactcttcatggccaaagggtaccagtccttatacaacccagaaggtcaatgagcccctaccacctttgagaccatcacagccaacctctagattctaaggcctagaagacagtagtctcccagaaacgttttccctttgctcctgagccaggatgctgggtaatgccctcagggcacgagggattgagtcaggctgtactgggagataacccagcctcacctatccctccacctgcaacagcaacaacaaaaatatgctgggtatagaaagcacaactcaccctactcccagttaaaccacaagaacagctgtaacttcctgatagctctgtgttcgtgcgctgtgtgtatgtggtgtgcatatttccctcagcccctcaaaggcagctaaccttcattctgtttcaatgagcagcctcagccactcaagatggagtctgagttcttccctcacttcttacaatgcccaccaagatgtcctagagcatacttaccttatactaaaaacaatatttgtattttgctaattaaaacaatgaatcctgtagagactccagagtcactacaggacccattttcacttctaatcacttaaaagtttaggtcagatggtttatggagcacaaactacatggagggagccatgcagtcagtaagtaaatcttggttctgtacatccagtgtcccttcttcattccgtcaggtagatacagttacacacgctctgataggctccataatggctctgatcagatgtgggctcctcctaaagactcgtgtgctgcccacagctcagcctcatctctctcagatcctgaaatgggccaactccaccccagcatgaactgtggtgctttgccaacagggacaacttcaatcatgaattcctggaaagaatctctccccataaactgatctactaataaaaatactaataaaaaaacttgtatgactatggacagtatgcaaggatgcctatcccacagcctaattataatttcttttgggggctatctttagcctcagcaccaacacacacacacacacacacacacacacacacacacacacacacaccacaaaaaaaaaaaaaaaaattccttgcccagctctgcagcagccctaacctttgggagtcaatcaggtgacaactgaggcaggcctgctgctgcaccctgcctctgcgctcaccatgctgtgtcttgattgccttgatttactgttccacatgggaacatgctgcccaaggttagcattggcactgtcactcacatttggctccataataaactgtctcttaatccctctgaggtaagaggtatttttttctatcaaaactgtgaaatcacaaatgtgatttaaatgtgaaccatttactaatgtactactgaagtctaaagtcacggcacaattactataaacatgggtttgtctatttttctctgcctatttttgatatgccttttaatataattactgaaaaactagtccatttttagcaaacttaatttttagatattgataaatggccactattgatattttaaatgctcctatttttaatgacaaaaagatgattacaatcaaatttaaagtagtaataacttggaccaccccactttaaaagaaacattttttaaaaaatagcagagaacgcagttatcaacaggagaaagagctcacaactatctctcaggaagttttgatggtgtaggtcaagaataaaatgagcctggactacaggaccatcaccctaactcataacctactatggctgccttcagctctttcccagattaatctgttaattatgtgcaaatctcactattcccgctccctgggcaaaactgaccacagatagctaagacccagagtcctctcctcctgagcacatctgctttgacccatctcagtggaacctgttcctcaccaagcggtcctgaccctcaaaaaggatactctagaatgactgaaccaaggaaacaagaaaggaagggcttgagtccaacaactgtcctttactgtgaggccacaacaccatcgcttccaagaggtacaaggaaatggaggtgaaggaggaggacaatttaaggcaatttagggctgaagcgatggatggctcagtggctaagatcacttgttcttggacaggaccagagttcagttgccagaacccacatggcagccccaaggagtcaatgccttcttctgaattccaagggcactaggcatacgcgtgggtacacaggcatacatgaaagcaaacatccatacatataaaataagaaatttaaggaaaaaggtgagaaggaagagccatacaggtagaaaacatccttccatattcaatatccaccctataatcctccctaattattgtctgcatgctactcactgcatggaaataaccttgttatcgcatactggatattcaaagtgaaaaatcaagttaaagttataaattttttcccagtttgtgtgtcacctgcatgtggtagccagtagaaaacaggccaatgtgagccatccaacatgggtgctggataaaaacctcaggtcctctggaagaacaataacgttcttaaccactgagcattgaacctgccctaaactgtcttttaccatttttaactattataaaagccacctgggtgtggaagaggtgggacactttcagtgaaagcatagcctgcttttttttttttttaaggtattctaatacctaggagctggagaggtggctctgcaggcacagcacttgatcctcttcccagcacccaggcctggggattcacaaccacctggcagccccagctccatctgaccccagcagagtcctgaactcaaaaggcaagcagccagaatgctcttttaggaaatgtctattagacactgcattgattactatatcataaccatgcagctgtgtacacagctgtaccgcagggcatgctcacaggacagctttacttacccactgagcggcagttctctgtctttaggtcacacatacagatagcacttgtaggcccacagctggaaatacccacatttccacagacgttgatcttataaactgcattgtttttggagtcaacagcttcccatgtgtaactagaaagaaataaaggaggcaagcttgtcattgttattgatctgacaataatcaccttctctctagtctggcattctagccatatttgctttgactactacaaataagaagttactcccattaaccacagataccaagtcaaattcggcaaaacattttggaaaggagttcaagatggctaggaagccctcagactacacaaccccatgtttgttctaagaacatcaacgccattaagcagatactagaatacactgtgtgtaaagtgggactggtccagtcaccccagagttctgaagacccaaatgactattattttagtttgctttgaattatcattattttatgtgtatggacgttttgccaacatgtctattgtgcgccacctatgtacaatacccaaggagtccagaaagtgtcagtccctctggaactggagttacaggcgtttgtgaggttccaaggagtgctaggatcaaacctaagtctcctaaaacagcagccagggaaactgctgagccacctctccagtccctccacgggactgttcttaactctcaagctttttaacctctttgagacaggtgaaacgtctgatgcccctgcctccacctcctgaatgctgagattacagacttacaccaccacacctagacttaagtggtctgaggaccaaacacaggcttagttgaacattaggcgagcactctaccaattgggcttcatccccagtcctgggattcttttgttcttgaaaactagctgtaatgtgtaagcaggcctgcttttggtacagactacagtcctgacgtgacagccatgctaagaactgccatctgcctcacgatgaggtaagatctactgcaggctgcctcactacagagctcagccaaaggcactctaagagctatctatcaacctcaacaccggggtaaaatcagtgaggggtgttccttctgccccaagtacatcatcctcaatcctctactcttcctgggactcatttcctcagcaagagtacaaggaggaaaggaagagaataggtacaaagctgcctgagcggctaaatcagatttgctgggataaacttacccagaagtagggaagtgagccagctcccacccattcccagtggaccacatttggctcttttaagtatggcctcacagaagttcccaaagctaccaggcactgtcctgtctgtcccccaccgtccccacccccaccacccccaccctgccccagcaccaacagctattagacaactcacttaaccttaggtctggagtccaatcagacctccacccctcccccatcccaccccaaagcatccctatccaagcatctggcaggaccagggaatttgtggccactaagatactacaaacctgaaaaactggttacttaagtgctgggcctggggtgatgtcaggctttaaagcaggaactactcaactctgacagactgattacctccagagccaggacgattatgccagaggaaaaaaatctcaagcaatctagctgacccagagaaaaccatcaataaagccttgttccttcttcctttggggggcgggggggggggggtagggggtgcagcaggaaacttaatttgtttcacggtgtatactgtttttctttggggggggagcctggaattgtaaatgtccttcctcctatgtctccccactaccgagcttctacgttactgcttgagaaacgcaacagtgtataaagtgtataagatggcaacagttccccagcttcctgctaacctgttccagtaagggaaggaaagtaagtgaactcggcacaggacaagctctgctgggaactgagcaggcacattaccgaaggtaacagacagaccccgtaactatgtcaggctgggaaacttactcttctgagccctgacagacaagcagcagagctttaggggtgggggaaaaaagaaaggagagctacttgacctaggctgcaggactgagtcagcggcaggtgtggaggccacagaagccacgcctgtcctgcagtctttaaatatatttgaaacaaatgcagccctcggcacttagaaactttctttaaacgtttaggtagtgatttgtaggttatcagtacatttctgttacagaaatgctaaactctcattgggagcctgtgattaagtttttccaagctggcaggcagttcactgaaacccttagcttgtcatcattacagctcctcccagtccgatgactgaagtgcctgcctgtaccacagaaaagaagttagcaatgagaaccaggtctaaagaaatgcagacagaagaaaactgaaaagggtgaaatgagctgcacagaggtcaggaggaaaggctgctttctgaaagcgtacttttcttctatctgtgtctcatacaaaatcaaaatggaagtcatgatatacatacagaaggcagagcctatcacctactttagttcttgaatagactttctctggaactgacttaccggctcacaggcagccctccataggcgccagccctccataggcgcatgcactcagccccatcaaattggcccacagttcccggtgggtggggggtagggcactagcttggcttagtcacatcactcaagagcaaagaaacagttgcaatgtttcctaaactgaaacctgatgacctgcaggctattaacacttgagaaggcctaattccagcaaacattgcagctgctttaaaacaatccaacatgcttggctcctgagcacaatcaggcaactgaaataatgtgtcaggaacctcatgggaaaatagttaattagttctgcagaacagtgaaagtgagtcaacatgcagatacatgtgctctggtactattactttaaaattagtttataataagcccaagagtggtaggaatatatgacaattcttttaaacaaatgccatgtttattaaggagagggccgcatgtttgcagccaagtgtaatggtgcaggtacaggcagtgaaggatggagggtcaatagttcagacagccctggctacacagtgaggcctaggccagcccagactaggcaggaaaccatttcaggctaggcagagcggtgcatgtttttaatcccgatgctctggaagctgatagtctgttgagttcaaagccggactgatctacattcagagttcttggacaaccagggaccagggaccttgtctcaagaaagaaaagaaaaagaaagcaaaaataaacagtagaagttgtcacatttgaaattacaaactagatgactgtaaatttcctggcatacaaaggccaagcagccaaaatggcctgggctgcaatcattcttaaaatgatatttgtaaaaggctgaaaaatcagtatgaccatattaaagaaccccggagtgagggcattaaagtgtgcggttgcatctttaaggggcaataaattttgtcttttaggaaaaaaatctctatttacagagaatatggatagccaaaattaaaatcccatcctgtaacaacagttcagtgctgagcaagaaaggccccttagctgaaaggccccaacccacccttacccaagtttacacaagtgaagcttttaaccttaacacacaaggctctgagaaaagcgcggtgcaggctgtgctgtgcaggcgggcgggcgggctccactcgcacccaagtagcaggcagacctgctacaacagcagagccacagcacaggagtcaagtccctcacctgctgctcacagtactgcttactgtcactggctcctctctgagttccagctcatttgaggaactgccttgggcattgaggaggaggagtagggagaacctgcaaggcccagggatcccgttgtcccaccattgagaaattcagtcactctcctcaaatgagaacaccgagttgtagctagaactacccttctgagcactaagctctactgagaaaccttggcactgaacgtgagcatcagtctcagaagtggcagagtgcacacctctaatctcagtacgcaggacacacaggcaagggcatcactgagcgaccagtcagggctgaagacatcatttcaaaaagaaaaaaggaatggaagtaaagaaaagcaaactaaatccccaatttcccaactcatcatacacccttgaaaagctccaattcttgataccatgtgccacaatggctccactaagccacacagtagaagtgggagggatcttagcacaggtatacggtgtctgtgacctgacacatcgttcctctggaatctaactcctgcctctagaaccctagccagcagggaaacacacagcccattctcagctaaggacatcgctcagccagtattaaggcttacctaccatacatgaggctatggtggctgagtgaaaaaagtcccgcataggcacacgtgttagtggtgctctggtcagattatgaaacaataggaggtggagccttgctgaaagaaccttcttactgggggcaggctttgaggattcccagccacacccagctttggtcttgacattttatcaaagtaactaatccagaagccccaagttccatcccaagtagcacatataaactaggcacggtggtacatgtctgtaatcctagcatgtgggaggtagagtcatagcaacatagcaagttggggatcatactaggctatatgagactgtctcaaaaatattacaaaacaggatggttctgggacacagaaactgctttcttcaattaagttcttcagtctaaactactaagagcgcctggccacaactactctgaaggtcacctgcacttcacttccagggaactactacttacaaagcattcgaaaggaagccaggctaaggcaatagctacacaaaagagggctgctttcatactaacagatatgaggtccccaagaatctatatgcaaaaaaaaaaaaaaaaaacaaaacaaacaataaactgcatgtggtgaagtgtcctaacaactgggcagttaaggcaagacagctcaatgggtaatgctctcgctgccaggcccgacaacctgaggcccatccctgggacccacaaagtagaaagaaacaatttccttagtattgtctgacctccacacatgtgccatgggaaacagatatcacatacacaacacatacacaacaaataacaaattgttttaaggaattttttgttttgttttgttttttgtttttttcgagacagggtttctctgtgtcgccctggctgtcctagaactcactctgtagaccaggctggcctcgaactcagaaattcgcctgcctctgcctcccaagtgctgggattaaaggtgtgcaccatgttttaagtattttttaaaattacaaaactacacacacatacttcttaaaaaaaaaaaaaaaaatccccagaacccacctaaagccaaaagtctgtcagctcagcacccctttaagagattgagacctggtgtgcacaagagagaaacacaaggaccttgtatcacagctacagttaaggcaaagactggcagcagaggttctctcctgacctttccatttgcatgtatgaatctgtaatctgtcttccttttaaaaaaacaagttagtggtccacacagcaaagtacacactcagtagagtcactagctgggggtgctttctgactctatagtgagcacaaatctgactcaacctgaacttccaaatgtgactgtgcttcgggctcacacaccagaatgctccagcagtgcacacaagctgcaacctgcttactcttcctcagcaccagtgtttcagctcatattcagcacacgggtctctactgagagatcaggaagggacaagatagggtccctagtgggcctacagcaaggcaggtagagaaaagtgtatcttgtgggctgtgtactataagaacaaaatctggtctggcagggtgactcaccctgaccagacgatgacagtggaaagcacatgagtttgacacagcagagcccaggattatataggaagtacttcacttcctattctaaccaacccacaagactgtggataaagatctgaagcctaatcacagagagaaggtgcagatgggagtgctgggcattattagtctgccttcccagagagctgcacaggctctgaatgcaggaatcaattgggtaaagaggggtctagcctgaacccctaaatcaactgtgacacctaagtccattttcagaggcagagagagacagggctggcaggcaaccagggcccaataatgtctttgagccacatcatgagggaggtttagcagaggcattgtgaggaagagggagcccaggtgcctctggaaaggcaccatggtcacagtagaagaacacacagacctgggcctatgggcagagtggaatccatatacttccttgtccacaaaccgagcaaaccaaaaggtcacgaataaggaggaacctagatgaggaacacagcactgtgatctagcacaaggatttagattgcttaagatctgaattcacaaaaaagacaagccggcttgaggcctcccaagaaaaatgccacatgacactgaagggggtggaggagaggcaagggcagacccttgtcctgggccacacccaccaggatgctgatgcatctgggctccagctacaactccagaggcactgaagcatggcgtatgcatgcacacacagtgctagcttctgcatggctgtgataacatgtgagacaatttaaaagaggaaggggctgctttggctcttggtttctaaggtttcagtacatggtcagctggccccattgctatagcctaagttgagaccaaatatcactgcaacaggtattcgatgggtgaggctactaacctcactgagccacaaaacacagggaataagggaaagtggaaggcatgggcaggcctgaacaagacagcaccctgatgatccccttcctccatctaggcaccacctcagcactgccgttgtctcccaggcgtgctgtaaaactatgaatgtttctgtgaataattcccttattacatcaaggtccttgataacccagctacctcacagtgacttcatctgtcactagagaccaaagcttttcaggggagggagaggggacacacttcatacctaaaccacccccacccacgtccccacccctgcccctgtccccaccccctcctcccacacacaaacacacacacaccccatctgaagtgggaggggggagatgacacacaacacaaccaaggactacacgacaccagaccacaaagacagacagcttcctcctggttgtctcctctggacaggccagcagctgagcctccccgaccctaaactatccaaatgtaaccactaacagctgccaccacaaacagtggccaggtaaacctgcactgcctggttactcaggagccagaactctaataagcaagcaatacccgccctctaagacacacagctaccaggaatctcccaaaatgtggctttgctcaactcaactccaccactcagactgcagacctactccacgtgggttccctgtgtgtgtgtaaactggtgcatttatctaagactaaggttagtttctcatcgtaaacagtaatgatctggatgctctcttgctttattcttaacttaagaaagaaagagggctgcattaaagttcaacggctgggcatttccctcaatgtgtgtcggcctaagttcatttttagtaccaaaaattaaaaaaaaaaaaaaaaaaccaaagctgtgtgctggaacccagtgcacagaatcctagctccacagaagagctctgggagtgcatgagtgccatgccagaagccctgggttcaatactgcccagcacagtataaaccaggagcagtgacatgaagctagaaccaggtggggacaaaagagccaaatgttaagggtcgcccttgaccactaagttcaatgccaacctgagcaacaggagactgtcccaaagaaggaaagggagaagccagtgtgtggcacaggctctgctgtgaggatgcaggaaggcaatgctagcacagggacccactcaaaacttcttgctagcaaggccccaattctttggggacccaatgtgcttcctttatggccctggacacagggagggctggcattttaactgctgaacagtcagctcagcttgttggtttgtgatgttaataaggttatcagaggctacacatgctatttcttcacaaaaaccacgtaggcagaccaggacttgtacttgcaatcccaggctggtagcctgtggcagaaggactactttgagttcaaggccaacctggaccaccatatgacatgtctaaagagtcctgctctgcaagtactgggatcataccaggggctcagcaagaaactccactgggcaaagagaacctcccaaggcccaatcctgtgcagcacagctgcacctcacttagaaacagtgacacacctggggcatgccatccacggcttctgaacataatcacttagtcctcaccgtctgtcaaggagcacaccaacctccccattttggagacttgaaactagagcgtgggtgtaacttggcaggcagtcccagatcaccaagtgaccaaacacagcaggaagagccttgccatgccctctgctcccagcacggaccacttcccactgcattctggctgcagaactgtcaccaacttcagtacctgaacgataagaagccctctgcacaaaagcaaagaaatcagaactttcgggcattttttattttgtcgtttttcagtctcctttaagttcaggctcatccacttgcctcagctgccaaatgattatcgatatgagccattgtgcttcattccaattttggagctgatttccaatagctccaaagtcaatatggtcgcgtctgggatccagccccagctaactcttgacatctctcctgtcccgtcccatcccatcccgtcctgccccgccccgccccgccccaccccatcctgtccagtccctgtccataccccctccaccacccaccccacttcaaccacattgaccctttggtctcaaacaggcacacttagatcctgcaaagactcttccccattacatacagtaacacacatacccctcatttccttccaggccccctttagattcgcaccttacagaagagcctaggcatggtgagcccttttggacccacacccttgtttattcccaaaagctcctcaatcctctctctcattattaagggatgccaagcctcatgacaccactggctcaccacacttcctctaaaagaccagatacaggaacagatggtggctttcacttgggagtagagagtagcgcgtgtgagctggcgaggtgacaggagggagccggaggagcagtgatgactcagtgggcactgcccttgtcacttctaagaagccctcttctgggtcatttctggtttggtggctgttctatttgcaggccaggcggaggagtagggagtttttccacactaaacatctgctttaaaatgtgcagctgacagccaggcctgttagcatagattggtaaaaccaattgcaatggaggctaagtcaggaagatcacaagctcaagagttgtcttatggtaactcagggagaccctgtctcaaagttttcaataaatacatacatatatacatacatacatacatacatacatacagattggagatacagctcagagtgcttgccacctatataccaaggccctaacttcaatccctggtattgccccaaaagagaagggaagagctggaattagaacaatcttacatttggtcaaagctcagtggccatgtggcagcacaaacctaaagactcaacctaaaagaccacctttgaaacttaccttgcaggccactcttcactggtcacatctgtttttaaaatgctagccaggcctgttagcacatcgcttggtgtttcctacacttaagacacagctacaatcagtagtcacaaatgcctgcaggaatcagtaaggccccagggaacttgccctccagcactaactgagcaagggaaaactgctaaaggtcagtggctgatctgatgtttcacacccgagggaacaggacaacgggattttcctccactgtaatgactgtgtgtgtagcagtgggtctgtcagagtccaaaataggacatgacacaatctttggcacctcaaaatcttgtcagcaatagccgacttccagttttagagcaaggtgaagtgaccaaacattttcccactaacctcttggggctatatgtacagcagacattcccaacctctagggtgctgcctccactatacacaaacaacacagggcttggtggctcatgcctttagttccagcccttgggagacagaggcaggctacgctgatctctagacatatatgcatgcacacgcgagcgcgcatacacacacatacatacatacacacacacacacacacacacacacacacacaccactgcctctttctacttccaggaaatagaataaagcaaaaacgaacgggacccagcccaatagggggcaccggcactggcacctgcccacaccccacacctattgtgcccacaagttctggtgctaggaaaaagtcttgcaatctgctagctcagtatctcagaactgagtgtgaggtgggactagtgacccacaaacccacagcttcaaatactttcagaaagtagaaccctttcttaaacctcatgagcaagcactcactcactgaggcagaaactcttggggcactaaggggtgacaaaaagacggtgacttccaacagtggcttccagtggagcatggtggtactcctgtacgccccacattcctagcactcaggacactaagacaggaggatcacaagtctggggccagagagccagtctcaaaaagtaaggcagctgtgtgggggagggacaaagacccaaaggtgatctgacaccagcttcgtcatccagctgtctcagataggacttacacggcctgccaacaggcagcacacaacgctctgccaactatcaagaggagccaacagctgcctcctggcaggaacagcagcacgaggtaggtgacccacaggagaataaggaaagaccagtctctggcatgtcccgcccattcctcatctcccccaagacaatttatagccaagttccaacaaatgttcccagccctgccctgagcagctgcaaggacgacagatgtccaaaatgagcacaatcaagagccgccagctgagggcaacatgaacacaagacaacaaccaacagaaatgggcccaagacaaaaaataaaagttgggcaagccaggcatggtactgcttgattgtaatcccagcatctgggggctaaagtagaacaattctgagttcaagcacagcattggctatgtagtgaaaccatatctcaaaaaaacaaatagctgagcagtcctggggatggtaggggttggggggagaagcaggcagatttctgtgagtctgaagccagcctggtgatcaaagttccaggacagccagggaaacacagagaaaccctttttttcctacaaagaaaaacaaaacaaaacaaaacaaaacaaaacaaccacaaagctgtgggtctatatcaagggaagttgcaaagcccataggcacaccccatccaaacccagagccatgaacaaaaagtaaacaagacaaaactcaagtgggacaggaataactcagggcagaggcagctgggcagcacaattaataactctgacccaaatagagaccatttcttccaaacatacatggctcttccaactgactaggtggcaggccacaagggaaattccattcactggccacagtggaaaagataaataaaccccctaaaagtcgtttcttgctttatcagcacattttgccataaagaaatgactggagcaggccatattatggctcccagttcttgaaggtctgaggtcagggtgacacaggcgattgtagttttcagtacatgtagtgtcactcgtcaaggtatgggaatatgcatgcgcccaggtggtgtgtgtggtccccctcctcctataaagtctctgggactcggtcacaggccccaccctaaagtaccacgtaatccaaatcccctcccaagaggccttacctctcaacaccaatacgggattaaacatctacctgttaattcctcatgacagggatttaaatgtcaacaatgaagctttggggaccccaacctacgtttaaagcacagcttccggaggactatacatctcagtaggcccaggaaggttaaaactagaaaatggaaacggagagcttaaagactgtcagactgctgtggcgctcaggggaagacatatggctttaactggtttttacattttactatttcatgtggatgtgtgcatgcctgagtgtctatgtatgtgcaggtacacccaggatcctctgggcctggaattatatatccatgggttgactttgcctgttatgaatactgggcaccaagcccacatcctctgcaccaggcactcttaagtagctctttttccagaatccaaagacatgccttgatataatgtaaattaattttaaagatttaagctttcaattaaactaaacacaggaaaattagaggtcagcaagtgagtattaaataaaatagaaaaaaggtgtccacaatatatgaatcagaatactagagcttctgcattgacaagcctttgataaagatgcccacaagttaatgtcaagaaatttttagaggctgaaaagatggctcagcagttaagaacattgtcttactgtgtcttattgttttattgctgtgaagaaacaccatgaccatagcaactcttagaggaaaacgtttaattgaggctggcttacttacagttcagaggtttagtccagtattgtcacaatgggaaacacagtagcaggcaggcaagcaggcaggcaggcaggcagacgtggtgctggagaggtagctcagagtctgacatttgatcagaaagcaacaaatagaaaagagacacactaggcctggcttgagcttctaagacctcaaagcccaggcccagtgacacagttcctcagtaacgccaaccacacccactccaacaaggccacacctatgagccgacagaaccattttcattcacaccaccacgggtctaaaggacccctggttctattgccagcacacatggtggctcacaactgcttgtaactccaatcccaggggatccaacaccctcttctgaggcctacaaagacatggtgcatagacacaaatacaggcaagatacctatacacattaaaaatgttaacataaggaaaacaaacaaaaagaaaaagaaagccaggcgtgactgcaaaaactgctgaagatggcagatctcaagttggccagcccaggctagacagcagcctctatctctaattaatgtaagtttttttttaacgactcatttatttattatatgtaagtacactgtagctgtcttcagacactccagaagagggcatcagatttcgttatagatggttgtgagccaccatgtggttgctgggatttgaactcgggacctttggaagggcagtcggcgctcttaatcactgagccatctctccagccctaatgtacgttttaaagacattttgaggatgggaagacgcctttgccagtcaaagcacttgaacgtaagttggagctccagagctcatgttttttgttttgttttgaagattaatttattatatgtaagtacactgtagctgtcttcagacactccagaagagggagtcagatctcgttatggatggttgtgagccaccatgtagttgctgggatttgaactccggaccttcggaagagcagttgggtgctcttacccactgagccatctcaccagcccctggagcccatgttaaaaaggcacagcacacacttacaatcccacagatgggagagcctgggagtgaggaggtaggaaggtccctggaagctcaaaggtcagccagcctgagtaaggcatcaagcgcttgtgactccagagactgagacagggaccccaaggtaaagccttgcaactctgcacagggtcttcccccctacttacccctcctctcccaaagtaccagattactagaacattactgctaagttctacaaaaatgtatggaccggaaaacgtctagttcatacaaaaattgatcccaatgcattaaaaaaaaaaaaggttggctgattccacaaaactgtcatattcatggtaacacagtcagaaaaaaaaaaaaaattacagcatgataccactttaaatctcagctgccagggctggagaaatggctcagcagttaagagcactggccactcttctacaggaccccagctaaattcccagcatgcacatggtagctcacaactgtctgtaactctgccctcagatatacatgcaggcaaaacacagaagataaaaataaatttaaaaacaacaacaacaacaaacaaaccacctcagcatccaggatggtgaatacaatgacagttagggggaaatgaaccttccccgtcccctcacagatcctagagttaaacaataaggaaatctgtgtccttggggtgcccagtgattcccaaagaggagagattttgtctggttggagtttcatccgaaatgtctagggacattttcctttgtgtcaccaaggtaagggcatatggtgaagagccctggacctactgggtatgggccaggaacattgcctaacacccaacaatgcacaggaaggctcctccagggatggaattctgccacagctatgatttcttagggtctgtggcttgaatgaggatagcacccagaggctcccatatttaaacacttggtccccagttgattgtgacatctggggaggcttaggggatgtggccttggtagaggacatatggcagactttgcttcaggtaaagccgccacttgctgccacaatgacccagccaaaacagtctcttcgcctaccactatggatggtcttggccatggtgtttcagcaacagagagggaagggaggcagggaaggaaacatatctaagatcttgaccctcgacacctgagaaactcctgagtttccataagtacatgataaaaacaaactgccaaggggtcaaaagtcaaattattatttacaaaaaaaaaaaaaaaaaaaaaaaaaaaaaaaagccctacctagtccttctaataaacaagtctgtcattaagtctagcaatgaagacagggacagttctgcttacaccatgagcctgtgagggcacacacctgtaacaccagcacttaggaggctgaagcaggaagagcactcggctagccaagcctactctagcaagaccttatagaaaaggggggagtggagagtgaagaaaagagactcaaaaacatggtgagattagatgccttttcaaaactgctaagaccaaatgttgacaagaatgtggaacagctagaattcttgcatgcagtggatgggggtgcagaacggtacagccgacttgggctccagattggcagttcacacagtgaggcagctctgcttctgccacccaaaaccaccaggtgcagcactatagaaaggccccattcactgagacaagcccaagagaatgatgtcaataacaaagtaatgtcagtaacccactaagtggtggaccactgtgggcccctgcacattgctctggacattgctgaaatctctgcacagcacaatatgctgtgtgccaagctcagaagagaggagatgggtctggggatagactctgtggcagactgcttgcctagcacgcacgcaagaccacatcacacacccagcaaccccaaaacgtttaaaagaatagacatcctgattatttttggaattccattttctaaaactctttttttcgagacagggtttctctgtatagccctggctgtcctggaactcactttgtagaccaggctggccttgaactcagaaatctgcctgcctctgcctcccaggtgctgggattaaaggcgtgagtcacaccagcttctaaaactctttctatacgtgaaacactgataaaagatagaagcctaaggagctattcatttcctgggagtttattaaaatgctaggtttgtttgattggttgcttaggtttggttttggttttgactcactctgtagaccaggctggcctcaaactgcctctgctgggattaagggcatggactaccaccgcctggttaagatgtgatttaagaactgagagaaggtaaaggcgagaggaccaggagttcaaggtcgtagtgagggcattgtgatatcctgtcaaaaaagaaaacaaaaaccatattggaaccataattaacaatcctaggctaacacacacttttatggttaaaggaaatgcatgtacacaaacggaggtgatccaggctaacatgtggcccaaattaggcacataagcattattctttgcgaagagttacaggagaaggggggaaaaatctctagagatagcaactaaacctactgcaactcccagctggcttcattattctcttgtcctcaatataataaaaactctccagtattcatacccaaacaatttggagaaaacgtgtccggtataaatttcaaagtagttaaccaccagaccaagcactttataatcagttccaactgttaagccttccccaaaaaacactgtgaacacctaaatcaagggtgggaagcattttacatacttaacacggcattctgcaaagtttaaagtagtaagctgaaccactgaacaaccagccaagagcaccagtgcatgcggtccactctgagggtcctgcattacctggcctcttcccccctccctgtgttgttctcacttatcctgccccactgaccttcacatgttccctacaccagaccttatccaggccagtgccaccaccagcaggctcatcagtctagtgaccttttctttacaccagcatcccacatcttgagagacccaagtaacttcttctacagcacacttccctccagacatttgacaaatatgtatgatcagccaggtctagcagttcctgaaatctggctacaacagagactgaggcaggtcgatggcaagttcaagaccagtctgggcttggcaagcctttgtctcagaacaaaagataaaagaagggatggcacttccctcccatgcatgaggacccagggtcagttggtgcccagtatctgtgtgactgcatctgtgtgcatgtacatctctccagtctcttcaaagagtaagcaggctgtgtaccgtgctgttccagtaacctatactcccctctgctgtgtctactgtacatacagttcacagagcaggcctctccactgtgcaaatatcctgagacctgctgctgaaatgatccctccacttgggttccttgacccctcccccaaagccagattccgtagaaactgcacccctatcccagtggtcagagccctagctcatcccaacgctccacaccaaccagacaccccagaaatgggtcaggactcccctcctgctctctgaaaagtatcctctcttgaaagaggctgttctcccacaagtccaagaaccaactgcccaggctcaggaacgtcccatgatgcctgggcaggccaatacctttacagaaataatttccggtagtgctctgggcaccaaaccacaccacatccatctgggttttttttcaacagggaaaatgtagcccctgtttcagttggtttaccaacccctggaatacagtcctgaccacataaggagctgcctccaagtgaccaggtgccaaaaacaaacacaagggcaccaactacaggagtctactgttcactcaggagaccccagggggctatttacatctcagccatggagtctgtaggcggtgaggcggacaaacacgccatactcccttgatacgttatgggcattatactggatttagaaagaatcgctaacctccttgtgtgtgcgctaaccctaaggaacttgcaggtgacgttttctagcagtaactgcccacattcccaaggaagaggctaaaagcctgtggcagagactcttaaagggctgtgagtccagctctggaagaaaacagctgcctagcttgcccctgactttgagctcctgggtttaagctcccagaacaaaaaaactaaacagaccatacaagacaaactacactctgcaggctccaagacactcaaaatgtttctaagaaagagcatagttacaggcaggggataggtgagaaggactgggaagttcactactcctgaggaaagctagaggaagaagaaccttagagacgtcagaagctgtgaagggcacctctaacacaaccttagaccctctctagcactggcaaagtcacaccatgtgagacagtggccccagtagactagtacaaaggccattcattccacaaggtaaggaccagcatctccactggagatgaggtgaaagaccacaagttcaagacaatgagatgaccatgcacaagtgagcagctctgagactccatgacgctcagttctccttgacaaattctactctactaaaatataaactctaaactgggtgggattaaagtgccgcctttaatcctggcacttgggagcacacaggcagacagatttatgggttcaaggccagtctggtctacagagtgagttcaagaatagccagggtgacacagagcaaccctatctcccctccttcccctcaccaaaaaaaaaaaaaaaaaaaaaaaaaaaacttaactctaggagactagacagttaacagctcagcagttaggagtgcttgctgctttcgcacaggatccatgttcaatgcccagcatccacgtggagcctcacagccatctgtaacttcagtttcaggggaatctggtgccttcttcaaggacaccgtaaggtatgtggtaaacagacataaattcgaacaaaatactcacacacatagaataaaaaaatattctcttaattttttcgaagaaattaacctactatagctagagagttggcctttggaggggggggggatcaattcttagcagccacgcaggctgctcacaacctgtaactccagctccaaggactctgagacccttttctggcctctgcatggcagacacaatggacacgcatgtgcgcacacacactttaaaaataatggtgtaaaaaaaaaaagtgaattctaaggcaaaggccgcaggtctgtagtagagtacttgcttagcatgcctgggccctaggttggatcccctgtaccaacgccttcaaaagaaacaaattccagttatctagcaagaccgtgacttccacagcactagaccagctgtgttaattcttggtcacagcagccctaaatccaaaattttctgttctaaatgttcccccctgggcctactattgtttaaggggcacccttcctccatatcatgaagttaccggggcagcaatctatctttgggcagctaattggtctataagccgcagtgcagcagtgtctccctccaaatactctccaaaatgagaaatagaattctggtcagctcattcttacactaacaagtcctacaaattattaactccaggtgagagaacaaaactctctgatacaaaggactaaagagcctggactaccattagaaacatcaagtttggctcagccccgtctcattctgagtcacttttgaaagtcaagggtaaagctggcttcaagattctcttcccgcttccttcttatcaaagtttttaaaacaagaaaagatttggtttcccttcaccctaaagagcccagaggaggcctgtctccaaactaatggtattggaagttccctaggcccacaagtctgtgtccaacaccaacaaacttcgacaggactggaaattatacaaccttggatcccagagcagaagactccactagaataatctactctggagacaatgacatcatgtgagcaaccacacaggaagctaactgagagacgtgaagggtaaagtcttgaaagcctacagagatgaccacctctcaacccttgtcaaaagaagaaaaagcttcaaccactgacaaatggctactttaaataaggaaaactgagagttgccacagaaggggtcaatctgcagttgaaaccaccactacccaactccaagagcatcgcgtgggttcgcactccctggagactgcacactagaggggacgcctccgaagccccacggctggaacttcaatggaaacgtgcagcgggacaaaagcccagccttagctctgccccctgcaacttccgacggacacaccgggccccgggagtcgcacaaagccgcccgacttatgacagccacaagtggccgggcacggggggctccgggggccagtgccacggcggcgcgtcctcctgcgccgccgcggccaccacgcgggcaactttcccgcgggggcggggcggggcggaggtctgcgtgtcctcggggctccgcgcccgccacgcaagacacccacctgcacagggcgtccaagtcgacggcctgggcctgcgcggagcccgcggccgccaggagcagcagcagcaggagcggcggcaggagcgcgacgcgcggcccggagggcaccggtcccagctgaacggcccgcatcgcgtgtggcgtggggctcacggcggctggccgtttggagccgcgcctgggacacggtcgcgccaccacagcggagtcgaagctgcaacgggagctggagggagaaagaggagagagaactggagccaggggggagtgcgacgaggaggcgctccgtggccgtccccggagcgtcacgtgacctgagtcggcccgcccccgccccgcctcctgctcacgtgacgtcctcgttcaggtgctctccgcccagtcccgggtcacatgagcatcgcacgcgcgcgggacaggaagtgttgcgggccgggcacgagcgccaggtacctactcgaggcctgacaaccccagggttgctcacgcgcggcgaggggtgacgcctcagagccagacctcagtttccccgtccagcacccaggttgcgtctgcgcttgagcgcttcctaactctctcttcttcaaccgagaccagtacggtggccgagatggagttaggtggaaaagcccaggttgatgtttagtgttgcaagtggatgcagggttaagaggtcagtctttctagaatcccgcgtgggagtttccgactcatgccccggagagcctcacagcagctctgtggaaatgtgacttcccaagcagggctttctacagcaagttaggtgactggtggactaatatgcagtgtgcagagaaaccaaaatgtaacaagcaaatgacaaacaaaaaaaaacttttagcgtgagattgcttactatgtagctcaggctatactggagttcagatccctctacttaagcctaccgagttctaggtttagaagcgtgtaccaccacctctgttacaaagttttattattctgtaaagataatatgcagcatccatattacataaggcggtaacctagtgaaagtacagtaaatgagccttaggaaatggctcagactgtaatgtgcctgcgggtctgagctcaagccccagcacccaacccctggaactttggtggggaggcagagacgagggcatctccgatgtttgctggccagccaggctggctgaatgtggccaggtccgctgttattaccaagaaaccaagaagaggtcactgggcaggaagacaatctggctgtgacaccaggattggtcaactgatcttactagctaggcagatattccattccttcactccacgtgcatccctccaggagctgcctgctggatggaagaggatggcctgttcctgatgaagaaggaccatttgagggtcaggggtacaggagtagtcccttgatagaagctggagttcatgtttgtcctctctagtgttagaactaatgcaggcaagtgttgtcagtgagaaaaccgctaaatgaagagttagctgtgaaccagaatgtaaacttccactcaaagtatcatccccaaaatacattttctttggatggctttggaaatggagcaccccataaaccaagcctttggtgaagtcttgtgtccccaggtgatggcattattgagaggtggttgtatcacgaagactgtgacctgatcaatgaagtaatccattcattgattcatgatctgatggcatctcctagttagcttcagctctcaatgtgacacagcccagagctgtctgaggttgtctccatgttgatggccccatgggcatgtctgtggagcattttcttgatcaaaaattgagcgacaagggtacagcccactgtgagcagtaccatcccctagacagggaatcctggactgtgtaagcgagcaagctgggcagaagctaggaagagcaagctggtaagcggcattcttcagtggctctgtttcagttcctgtctcagtcctgccctgagtgcctgtcctgagttttctcagtgatggactgtgacgtggaatgtaagccagtcctgccctgagttcctgtcttctcagtgatggactgtgacgtgccatgtaagccattgtaaccctttcctccccaagctgcttctgctcagagtgttccatggcagctggtatcacaaatttggggaggggaaaaaaaaaaaagacttcattatctcttcttgaagtgatgccataaaaattcagtgaagcggagttctaaagcacagagccacctcacaggtacagaattgatgtgtcaaaaaaatatcccttacgttattcaagtaagaactgagatcatgttaaaacagactcaaagggaatttaaaaacaaacaaacaaacaaaccctaatacagacaacggaaagttgggaatgcagaagagaaattagccaatagataaagggttggttaaaaatcaaatacttatctgactcagacacagctttaatttctcaagtcaaacaattggatattttactaacagtattctacaacttacagagttgtaaagtacctcgtgacaatgaaaagctcgggtgccatagattaaccattggtccccttttctcaccatagaccagggcatattcaacatactaaacgaaaggttccagaattattaagtcacaaggtctcaataacctattagcatgttattatcattgttctactgtatgggtatgttgtgcttttattgtccctgttttataaaacaaacttgggggctggagagagagctagtggttgaaaagcacctaggcttgcagaggacccaggttcagttcccagtacccacagcaggtggctcacgatcacctgtaacttcaggttcagggtatctaatgccctcttctggcctctgtgggcaccaggcacacatgtatacataaacactcatacacataaaagtaaaatttatttaaaagtctttataaactttcataagtatgtattggtagaaaacacacatataaacacgtgcacagcacacacacacacagttgttccaggctagctctagggtttgggaatatagaccctggaaataagggagacttgaaaatctaaaaggatttattaagcagtacgtagcttttcattgaagcttatacacacagagacacacacagagagacacatttgtgtctgtggtgctaaagatggaagccagggccttggctcttaaggcaagagctttactaaacactaactttatatccccagccctagccagaaatattttgatctatatctgtctttcacaatgttctagacaaggcatgctatgacttatattggcatccttaccaagaagttcatcttaacttaaatccgcatagtaaagcatgattgacaaaaactgcacaggaggattccaaacgctctgcaaacctccagcactctccctccccgtgagacactgccctagagcactggatcatgctatagcccatgggtcgaatcaggtcacacagctattttgtaaatatttttactgggatacagccatccccattgcttatgtgtcggactggctgattttgcccacaagagcagagataatagaaaccatggcctgaagagcctaaagtatctacatttaaccatgaccctcaccaagaaaactcacccaacacctcttttaggttcccagttcccaggagtgctgcctttaaaccagcagtttgggtctcatctgccagcctattagaactctcagttctaatacaagctataacagtttaatttgttgggcatagtaattccagctctggaacaagtaggaggatcagacattcaaaatcatctttagctacgagtattttccaggccagcctgcactatatgagacctgatatttaaagttaaaatgttttaaatatatatcagaaacatcacacatggtggtgcatcactataatcacaacacctgggaggcacaggctggcagatctgagcttgaggctgggctgatatacaggatgaattccaggacaggacagactggactacaaagagaaaccctatctgaaatcaaagaaaaagaaataaaagaaacgctatctctcagaagtctggaagatgtacacaagactctctttgagggtttaaactatgtccccttgtagctctgtaagagccctaagccttctgcagaatgtgtgtgtatttgaaagcagagttggggttggattagccaagataatatactagaacaggctcctcagtcaatatgcgagtgttttgtcagaagtaggaaagagaccgacaggatgagaacaacctgaggatgtcactcaagggtagcggtgacactgcctctacaagccaaaggactgcctcagatcactggtaacacaagaaactcagagaatgggcctagggttaacatctccctaacctaagtgagagccagagcctgccatcaccttcattttgggcttctggcctgcaaaacccagaggaattacttagtgacctcccttccctcagtggtgctttgttctatcactgctgtagggcaaaataggctcagaatccagctggttcaacctctgtatcattatgctggcttttttttttttgtccctgctgtcttggcctgatgctagaaccacatctcaagtggcagatcacccgtgtttcctgtggggtgcagtagtagggcaggcaaagctaacccttgcctttgtggaacacgaaagccccaagctgtccaactgacagtgtccagagtaccttgtgaatctcagatagaggcttaaagaaaattccagacacttcccagaacacacaggaagaacctgattgtatggagattctggaagtatttttccattcctttaattgtcccttgccttcagagataaatgaactgttttttcaaaactcaactggaggtctgatggcgtagctcagtggttcaatacttgcctagcatgtgtaagactctgggttcaatgcccagctttgaaaaaaaaactatgtagtagataatatttcattaatgttagtgtctgaggtaagatattggtatttagctatgcagaaaaatggctctgttcttaggagtacgagagttctcaatgttagcaactttgggggggggatgtttgttttgttttgttttgttttgttgtttttcgagacagggtttctctgtatagctctgactgtcctggagctcactttgtagaccaggctggccttgaactcagaaatcagcctgtctctgcctcccaagtgctgggattaaaggcgtgtgccaccaccgcccggcttgctagcaacttccaaatgctttgggaaacagacagaaagcagatctgaaaaatgcttaagagctcatcgtaggtgaaactgttacggtgaccttggactgtggtgtaaccttacctgaagctttcctgaccttggactgtgggatgacctttcctgaagctttcctgaccttggactatgggatgaccttacctgaaactttgactttatttttttcaaaaagagaagttgagaacaagaatgaataaaaatcacagatagctttggagatgagcccaggagagcaggttgaaaatacagagaaaggacattgaaggcgattgaaagtcacaggcaaaacaagtcatgaaagacctgtcttttatgcaaggcctttagcttgagagaagtcacgtgggaatagaaactatttttggctgaaaatggtgctaaatcccgagcttataaagcataatcctttcctcaagctgatcaggttcggatgatagttcatttagtataaatttggggggggggtgtcttctagccattcttagaggctctagttctttaagaaaggtgcatttaattagccataaagtggaaatgctggcagatgacagcagttcacactgaggctcactctgagtcaaagccacattgataccatccctgctctagccccttggcctgggtccttttgttcttgtcatttatgaagcatgagcatctcagacttgaagaagcacagtcagaaaacagttctctgcagttcatctgttgccccttctcagagagacccggaagttctttagctggatctacacacacacacacacacacacacacacacacctttaatcctagaactccaaaggcagaggcattcagatctcttgagagttcaaggctagcctggtctatgtatcaagattcaggcttaccagggcaacgaagtcataccctggcagaaaaaaaagaagaagaaggagaagaaggagaagaaaagaaagttgaagtgaaaacttctagattctttggaaagttgtgtcaaatgatgttttgctagggctcacaggtgaaaggatgccttgctaaagcaaacaggtgaaagaatttttcctgaggcagacacagatgaaagtatgtttgatatagcaaacacgtgaaagaacgcatgatgatggagtagaaatatgaccccacagacagtgggagacaagcactcagtttggtttggtttgctcccccttgctattcttcgctaaagacacacatgtatttgttcactttacatagcgttgttgagctcaatttgtgataacaccagcattgtgagaagctggactaagaactgctcgtgaggttcctgcagcagcttgcccttcagcggcctctcctcaggctggttggagagcctggcagtttcttcaggattaaactacagctgccgggtgtctgcttgctgaaaggactggactgtagctgctggttcgtgtgtggtgtctgcctgcctagaggactggtctgcagctgctgagtcgtatttggtgtttgctaagagactaaactgctgcccaagaagattgagctcgcccccgaagaactcttgtagaacatgttcacttccctccatatcctaataacttttctctcccagtacctctgctgggtggtgggctagaggagaggttgaacccttattaaaagtaggttgccaaacatttgtgcctaaagaaagttgagagagactcagagcaagagagaaatggtcactgggatacagacccatcttgttgcaggattgatgaaagctgcctcattcaaaggacccgaggcagccgggtgttgtaggcactcctataatctgagtccctgaactcccaaggtggaggcaggagaactgctctgagttcaaggtcattttatgtttacagtgagttccagacccaactaggctatggtgtgaaaccctgtctcaaaacaataaataggtgtggtggcctatgcctctaatcccagaatgaaggcagaagctggaagctcaggagttcaaggttatcctttgatacacagtgagtcagaagccagcctggactatgtgagacccccagctttgaacagcaagagaggaactggacatggtggcacacacctttaatcccggcacataggagccagaggaagacagatctcttgagtttgagtctaacctggactacacagagagtgggatcacagtgaggaactgtctcaaagtgtgattctttgggtgtgcatgccatggatgccatggtgtacctaatggaggccagagaacagtttcagcaatcagttctctccatccactgcggattcctcacatcaagttataaggcttttattggcttatgcattctgtcagccccaaaccgtcagaatctgtagttagaattttgatttcattaaaaacccagttaggccgggcgtggtggcgcaggactttaatcccagcactcgggaggcagaggcaggcagatttctgagttcaaggccagcatggtctacagggtgagttccagaacagccagggctatacagagaaaccctgtctcgaaaaacaaaaacaaaaaaaaaccaaaaaaacaaaaaaaaaacaggtgaatgtttttgttttaatcccaggtgtggtaggtatatggggctgatgcaggctgtgcacagatgctggagtactctaggaggggtgtgatttttgccagctgcagatagtttgtttggaattctgatgactcttgagacggtataaatgtctgagctccaagagggcctatgctgctcccctgctatgttagctattttgctagattgctggttagagatatcctgatgatggagattggtcttgccccaagaaacccaaggctgctagtcagcaagaagtagtctaaggaggcctacaccaggagaatctacaccttctttggtcttctttctcccctacctagtgttgggtagttggacgggattggggtagaataagggttggaaggatggtagatactagaacccaataaagtagcccaagaagcaagtcaacaagaattaatatgacgacgtgtacactggatagttttctgacaacttgacacaagctagaatatctgaaagaaggaacctcaactgaaggaaaaaactcaataaaatccatatataaggcattgtcttaatgagtgattgatgggtgagggcccagctcatttgggatggtgcttgtagtcctgggttctataagaaagcaggctgaacaattcatgtagagcaagctagtaagcagcacccttctatggcctctgcatcagctcctgttcccaggttcctgacctgtctgaattcctgtcctgattgcctttggtactgaacagtaatgtgaaggtgtaagccaggttaacccttttctcctggcttgcctttgggtcatggtgttgtttcactggagcaatggaaattgtaactaagtcaccagctgtggtggcccacacttgtaaccccaacttttgggaagctgagtcggttgcatcatgttcccaaagctaacctgaacttcataattctaggccaacgaaggacacaaagtgagagcctttctcaaagggggaaatgcaacaaaagagaaagccaacagctttttctcctcaacagcatattttctagttggtaaaaatctgcttaggactggaatcctggcctatagcatggagcagagaggggaatgggcaggtggagcttgctgtcttcctgtaggctcctgattcccttctggccagcaaaggatatctctagattgagagcatgaggtccttggctttactatgcttacaaccagagtcaatacctttcaaccccatcctgacagaggcttggtaggcaataacctggggcatgctgtcaaatgctcttctctccaataagataaaatttgatcagattggcctctgtccatgaaggcactttcttggttgctggttgatatatgaaggcccagcccactgtaggtagtaagatccctaagatgattggcctgctataacaagaccgaggggcaagccagaaagcaatgttcctctgtggtcttggcttcaagtcctggccttcagttcctaccctgatttccctcaatgattgcctgtgacctggaagtgtaagacaaactttttctccttggtcgtggtgcttatcatagcaacaaaaccagagctagaacaacagccaacactgtgggaacaaaatggaaaagaccgaggtccgggaccccactactggccactcccctcaagcctcggaaatacagaccagtgtgtgattgtcaccttgcaggagaatcagtacgtttgccaagaccccatgtgccagtaatcagctttaaggatgcccttcaccctgtgctgtagtatgcagacagcacacttgcctttagtttgcctgttaaatgagcatgatgctaagctttctagcttcctaagggctctgcagaagagggtttcctggagggctgggcacattcgtccataccagtgtgtgctggtcatccgttctggacttgatgctacaaagtggctattgtaggacatttcttgaagagatgtgaacaaaggcctgctcgtccagatagtgtcccgaggacaaaccaaagaagtcatcccacctaagtccagcttggagccagtgactttatagaagggtgacctacaggaccatgggtgactcgggacagctgtatcatcaagccactccaccatgaaagctgcatccctggatctcactgtgcagcatgcaggtaacccctctggtaagcctctccctgagtctgtttactgctcagaggatcttggggtggagccttatgatgaaccttgcaaggacctgagcttcctggatcttatgaggccccatccttcctccaggagggagtgtgtcaatagaaggaaatagctaacaaccatgtttactgcaaccacagacctgcgccagcagagctcatgcaaggcgcttctgttccatgttgggctgaaccacatttcctgtgagatctgagtcccttccaagctgtctgtttccgagccacctctctgagcagaatcagagacccacataaagtttctttgtatcttcatgcatagctctcctgttagttcatattttaatgatttatttttgttttatatgcattggtgttttgcctgcatgtatgtctgtgtgagagtgttggatttccttcaaactgaagttacagacagttgtaagctgccatgtgagttttgggaattgaacccttgctcttttggaagagcaagcagtgctcctcttaactgctgagccatctctccagcccctttcctgatagttaataatgctatctttggggatttaaattttgaaatgaaacccaggcttcagtgagacagctcatctaattgggagaacaaaagctatttttaatcgttagggagtgggtaggggtcttcagggagagtatatatcattggctggggccagggagccaaggatgcttcacatacatagagaggaatgtcagatattcctggacatagccttataaggagaggaagcccaccctggctgccaggctacgtgacctcttccgaggggcaaggacgagggtgcagggctgcgggggccgggatatacaggctccagggaggcggggaagtgatcctacccctgccctctcaggaggagatttcctccagaccagctcctctagtcccacggctcccactgactttaattcagtgttctactctggtttcagttaggttgtatggtagagagtgctcacttgagctctgagtttaaggacacagtttgcatcttttgtcatagctggaatgtagtatataaagagttcataattccttattaaactttcctcaggaagttctcatacaccctttacctaccttcccccaacagtaccaactcacaaaaatgaaactctatcataaccacagtatgaagtatgggtaataataacacctacagatcttctccaagccccctcccagttttgtttgtgtgtgtgtgtgtgtgtgtgtgtgtgtgtgtgtgtgtgtgtttctgatagactcttggactccagcacttgggagacttaggcaagagaatcaagagttcaaggccatcctcaacaactatatagtgaatttgaggccagcctgggacccctgagaccccgtcccaaacgaagcaaaacagttcaagcctttgagggattccttttataaccacttccttctcagtctcctgccacatccttaacctctgctacccactaatctgctttccatatctaaggctgggtttgtttattaaaccactactcaggacaaatagtgtatacatggagtcccaggtactcaggagtggcagacaagaggatcactcagtcccacaaatttgagattagcctgagcagtatagtgagattctgtagaaatatatacatgaaaaggagtcagaagttgtaggcgaaagggttaaacctttaggaagaaagcagagaccagacctctggcagctcccaaggagggcgggcctgcagttgaggggccctgtgagttctgtatggggactactgcccgcaaagcatgcctcacagagccagaatgggaaggagcaaattccctccccaaagcagtccagaattcttaactcttactgctgagtaggtatttggtgatgtggccattctgtggtttgtttcctgacttctgcattgtcctcacaaatgaagctccacgaacgtacatgtgcaagcttttgtaggcacatacgagttcactgactgaggaaagctaagagtcatgtacatacattcctatttacttatttttgaaagagcacctttgtgcagctaaggctatgctggaacttacatgtagcccaagcaagcctcaagcccattgtccccctgctctggcctcaggctaggattaccggcttgtatccccacttctgaaattaatgttgtatttttgtttttgtttttaacttagaccatttattgtggctcacaccaaaaccctagcactccagaggtagaggcagaaaggtcagaagtttaaggccaccctcagttatataacctgtttaaggctagccctcagttatataacttgtttaaggctagcctgaggtacctgagttccagtttcaaaccactccccacaaaagaaattgcaaatctacaagttatggtggtgtgtacctttaatccaagcaattgggaggcagaggcaggtagatctctgaattccaggacaggaggccagctcataagtgctaggacaaccaggactatgtaccctgtcttgaaaagcaaaagaaaattaatttgcaactctgagggtttttactatttaggcaatacattattaatttctataatcaaatgcacataaattaagaagttacatatctaatatactgtgttatccccatacaagtgggaaaataagttaacctctggccaattaaattacagtacaataccaaatgaacatgataaattgggagatctttttccaaagctgactgctaaagtttctagacaaaaacatttttcagagtagccattctgacatttatcctgaggaactgtgtatgatatatccagtgttttatattctcataggtactgggcatgtctttgtttgttttgtgtttttgtgattcctcatttcgtaaaactccctattagtgggatctaggaactcccaagggcagatctatgtaagatatcacctgctaagactcttctctccccaactttagcaaaagttagtagcatattagacctccatacttaacaagtcccttcctcctacattgttgagagagaagatagtgacattctctgagcaagggcaagctgaagacctaagtctgtgttgttactggcaaagcaaaggcacaccccactgagaaactcacaggtttgaaacaagattgacagtgtgccaggcaggtagctttaatacctactaggaagccagcagtcagccacctagaattctaactgtttgcaagaagcagagagattcccaaaagaggtgttttgagctggaggaggacgacaggaaacctaatttttaaagttttgtaaatgggggatacggaaatggcttataggtaaacacacatgccaccaagcctgaaacatggaggtgtcacatgcgtgggagagagcacctgcacttatgcacatatgcatgacatacaaataaatgtaataaattttctaaagttcacggagctgcactgatgactcagtggatagaacactcctcccacccccacccctgggatgatgaactgagcgagattctctgtaaaccacataaagttggccagagtagcacacatctgcgatcccaatgctcctacttggatatgggggtggagacaggcatatccctagaagcctgtggtccaactagccttatgtatgtggctaacaagagactgtctcaaatgaggcagaaagcaaagactgacgtgaaagattgttgcctgacttccacatgcatgctgtggtgtgaacaacatacactcacaggtatagattcacaaaggtggggaacagcctgccttagactggcctgtgacagacttgggaagtacactagatctgctgtggctaaacacagacaagagcgggggcagggtgaagtatttagaaactcggagtttcgataaaggaagtgaaacccagatgactttgagtggagtcaccacataacacaattatcatcataagtagatcacggtggctttgtgggctctttccccagccttctagctcccttccattctcaggtgctttttttccccctagagtactgcaccctaactcagatgtcatataagttcagctgaccctcaagtgacactgaggtcccaagcctcatatcaggatgtgattctatctgtttgctttctgtagctgtgaaacgtatcctgaccaaaggcaactcggtaggagaggggcttattgaaataaagctcacactttcagaatgcattccatcactgagggaagatggcaggaactccaacagggcaggaacctgcatgcaggaactgaagaaaaggtcacaaagaaacacttcttattggcttgctccccacgctcattagggttttattttgtctttatgtatggggtttttgttaatgtttgagtgctctgtctgcatgtatgcctgcatgccagaaaaggacttcagatcccattatagatggttgtgagccaccatgtgtttgctgggaattgaactcaggacctctggaagagcagacagtgctcttaaccactgagccaatctctctagctcctttctttgtttcattgttttttgtttttttttgttttttcaaaaaacaaaaacaaaacctcagaactacttgcccagggatagtaccacctacaatggactgggccctcacacttcaatcaataataaagaaaatgcctcacagacttggttataggacaatctgatggagacattttttttaaagatttatttatttatttatttatatgtaagtacactgtagctgtcttcagacactccagaagagggagtcagatctcattacagatggttgtaagccaccatgtggttgctgggatttgaactccagaccttcagaagagcagtctggaagagcagtcaggtgctcttacccactgagccatctcaccagccctgatggagacatcttaactgaggctccatcttaccagatgattttagcttatgttaagttgaatgcaataataataattaataataataataataattttttaaattaaacagcacagtgactttatttggaaacatttactggcataagaaaacatccaaactcagttcaaatgctggctgggcttagcttagcagcccgtattggtaaatccaccactcaggaggctggggcaggaagatcttgaatttgggaacagccttgctatgtagatcctgtctttaaaaacaaacacacagggtatcttagttagggtttcattgctgtgaagggaagtatgaccaaggtaactcttataaaaaaacatttaattgggctggcttacaatttcagaggttcagtccattatcatcatggtgggaagcatggcggtgtgcaggcagatagcgctggaggagctgagagttctatatcctgagttctgtatcctgatccaaagccaccagcaagaaactgtctccgcaggcatccaggaggagggtctcttctgcattgggcagagccagagcataggaggagacctccaaggccaccccacagtaacatgcttcctccaacaaggccacactccaaatcatgccacttcccacgggccatgtatagtcaaaccaccacattccattccctgttctcccataggctggttcaaacacaaccatagcataatgagaaatacatttagtccaacttcaaaagtccccatagtctatcacatctcgaaaatgtttaaaagttcaaaagcctcttctgagacccatgcaatctcttaactataatcccctataaagtaaaaaagatcacatatttctcacatcatgagatatacattattagccgggcagtggtggcgcacacctttaatcccagcactcgggaggcagaggcaggcagatttctgagttcgaggccagcctggtctacaaagtgagttccaggacagccagggatatacagagaaaccctgtctcgaaaaaccaaaaaaataaaataaaataaaagatacacattatccttccagaatagcatagtgaagaaacactgggccaaagcaagataaaaccagctgggcaaactccaagctctgcatctccacgtcagacgtcaaagcactcctcgggtctccaactccttctgtcttctctgactgcaacaaactgctttctcttgagctggttctactccctgttagcggctttcctcagcacgtatcccatggctctggcattgttaatatctcagggtctccaagacaacttcaacctcacaggctcttttttttttaagatttgtttattatttatttatttaatgtatatgagtacactgtagctatactgtgagccatcatgtggttgctaggaatttgaattcaggacctctgcttgctccggtcagccccgcttgctctggcctaaagatttatttattattatatctaagtacacttctagcaccaggatactacagtatacttagactactacagtatactaccagtagtacactggtattcagacacaccagaagagggcatcagatctcattatggatggttgtgagccaccatgtggttgctgggatttgaactcaggaccttcagaagagcagtcagtgctcttaacggctgagccatctctccagcccccacttcacagcttcttatttcagtgtctgggatccacacatgatcttctgggctcctccaaagggcacgggtcacttctctagctccctctgtagcactctaggctctggttgactccattccactgctactgctgttcgtagtagtcatcccatggtattgacatctccaatatgctaggtcttctgctacaatatgcaatatgcaatatggtaggcttcaccaataaataccctttcataggctcccctcttgatgccaagcctcaatttctttgcatgaccccttcagtcctgggccatcaactacaactgaggctgcaccttccattcaatgactgtttccatcctctcacagtgccaaacttcagctgatttccatgaccccttcatgccttcaaaaaccagtaccacctgggtgactcttacacattaccaagtccagttgcaacacaagatacaaccttgactgtatctggaatataacttctttgtgctctcagaaaacacttcccagaagatttcacctcagggatactggtctcttcttaatcaccactaatttcttagctccaactagccagcatcaattgtcccagtaatgtcttctatttttaactctatagccagagctacgtggccaaagctgctgatttctgctacttgctggggctggaacatgatccctttgttctattacatcattatcagctttctgttttccaactcctttactgcctaagcttggctgtcctggaacttgctctgtagaccagacttgaactcagagatctgcttgcctctgtctcaaatgccagcgttaaaggcatgtaccaccatgcctggacctaagcctttctatacctttgcacaagatctttataagcatggacattatgcctcaagatctagatcacaggtttctggattgtagttcattccagatatagtcaaattgacaatcaagaatagtcatcacaatccattccttgtcaattggacagacaatcatatctccttatgtccaaatgaaaacaataaccaggtcataatgatgcctagatataactatcatttgttcaactgcaaacacaaacaataagtttacctgggcaggatcttgccctgatgttgccagccccttgatctgtttatcaatttaaacggaggattcagcttcattccacttcatggcactcctttaatagtttaaccatatattttgtatttttcctttctcagcttcttccttttcaccaaaatgcttttcataagagtgaactttagtaaccacacaacaaaatttatactagactgttttgtgatttcctttgctaacacaattaatctaaatcttttcactttagcctcaggacaaaggcaaaaagcagccatattcttcaccaaaacatcacaaaaacagtttgtaggccacatattaacattcttctcctctgaaaccttttgagtcaggccccaagagttcaaatcacccccagaaccaatgtcttctatattcctactaagacggtctcaactaaagcattccattgctttccaaatccaaagtcccaaaatccacattcctccaaacaaaaacatgatcaggcctatcccagcaatatccaattcctggtatcaacttctgtcttagggttttcattgctgtgaagggacaacatgaacaaggtaactcttgtaagagaaaatatttcattggagctggctcacagtttcagaggttcagtccattatcatcaaggtggaagcatggcagcgtccaggcaggcatggtgctggaagagccaagagttctacatcctgatccaaaggcaacagcaggagactgtcttcctcagtcagctaggagaagggtctcttccatactgggcagagccttggcataggatgagacctccaagcctaccccaacagtgacacaccgcttacaaggccacacctactccaacaagcccacatatcctaatagtgccacttcctgtaagccaaacatattcaaactaccacacagaggctggggagatggctcagtgcgtaagagtgcttgacatgtgtagaggaattttaatccagcaacatggctgctctggcaaaggatcaccaacaaagaccttctaggtctgtgtgatccagctggaatatacagacaccccctcattacatacctttaatccctaacaatgaactaaagttagtttgtagaaggaagcaaccatgtttgaaaatgacatctaattgactggcagacaaagtgacgaatcagaaaagatttgacagtgagtcagagaaaggatatgtccagttctcatgagaacagtacaggaaagaagccttttaagaacagtgtagggagagagtcagctgggagtccatgtgcagtggagttgagttcatttgtgagatcatgcatttcagtgcaggtcagcagaggcaactgaaaccagagaatgaataaggagtcaaagagtacaacaaattactagagttagtttgaggccaagcagagcaattcagggagaacccaagagaaaccagattgaatcagtcagcttgaagaggagtttgaagcagaacatgaagagaatatgaagcagagttagaccagcaagccagacttcagaaagagctagaaaaagtgagcttattcagctataagcctgtgagacaatcacctctggtaaataaacgttaacgtttacagttgtggacaatataggactcagttcaaatctccagcactcatgtaaaagcccaacacaaccacatctgcctacaagcaaagtgtgtggagggagagagtgaagaatcctgggagcttgatggccatccagcatagcagaaatggcaaacttcagatacacacacacacacacacacacacacacacacacacacacacacgagacagagtgatcaaataattgagaaaaatactagatctcctctgacctctatatatgagcatacacacatgaaaagggggtgaaatgggggggaacaaagacccaaagacagaaacagaaaaagagagaggtacaaaataattgaggaaaacactagatctcctctaacttctgtatatatgagcatgctctcaagtgtacacactcacacacacacacacacacgtaaaaattaaaaaaaatgaaaatagaagtcacacctaatctcaacacttaggaggcagaagcaggtgggattcagtgagttcaaacccagcctgcgctgctgagagctcatcttaaaagaattattttaaaatgtggtcaataccaaatatatattgttttaatatcatcaaattaaatatgaatcgacattttgtctgcatgaacattttatatatgcgagtcagaatcttactatgtagtagccataaaatggtctagaactctctgtagaccaggctggcctcaaacttggagttgccctcctacttgtgtctcccaaggactaggatacaggcatgtgccaccataccaaggtaaagttatttgttacgacttttattttatcccactggttattgaaatattctaatatgcccgttggtcctggtgtctttcagaaattgggtatctgaatctaccatgccccaaacaattattctgagcagtgatggacttcctctagccatactctttagaaccaggctcatgtaagcctgtgtgtaaaatgagatagaacgttactagaggcttctgggtcatcatagacatggttttcattttctccagccctgctttcagcctcccccttttccagacttatttactttatgggtttgcatgctttacccacgtagcatgcacatgcctggtgtcagagaaactcaggcgaaggcatcagatgccctgaaactggatgttgtgaaccaccttgtgagcaacagctactcgcaggcagtcactgagccccttttcatattcacatgattttttttttcctttgggtggtatggatgttttgcctgcatgtaagtgtgcctgggactggaagaggccagaagatgcccccggaattggagctacaaacagttgtgagctgccatgtgggtactgggaatcaaacccaggccctcccaaggagcccccaagcactcttgaccactgaacaatctctagcccctgaaacacttgtttctaagaatggatcagttgtcacagaggttgactcatgcaagcttaggtcagcctcattctattttggcatggcagaaatgccagctcaggcacagaaactcccctggcagatctggggacagtgggtttatgggctcccatccctgcttcctgtccaccctttgactttggactggttgtttaatctccgttccgctttcttcatccagagcagaggtcagcaaactcatcaaagggtcaggccgtaaactgtttaagctgtatggatcctatggctttccggcacagctactcagctctgcccctgtggcatgagaacggcctcaggcaacgtgtgagcctatgtacgtggcagtgagccaagaaagcttcacttttgaaaatagccagatatggttccatgtctatagcttgccagcccctgatcagatgacgcccccctccccagccccctgcaaatggaagaatgtggaagactttacggttgactgttcagtgtctgtcacactccagctgatagtgtaagccaaacaaacatgtccatcccccgggtacacttaagcctgtgtgtgaaagatgtaaggagatgattaccagagctcctgggaagatagcattcatgctgccatgggaagttgacctctctctaacaacaggcatgggcaggaagctgacaggattagtaggggctgacactgctatcagccttggggcactttgatcacaaggctgggagagaggaatctcactggactttttttttttttttaacctgagctaggaaatcttccatctcctctttattaacttggaattgggtcatctgttacttcagctaacgggatccctggtggaaacctcgttggaagagctgttatgagacccactaggaaagcatgtgaccgtcgcctgctaattaaaaggcttgccactgaaataatcagcaggcacatgcccctggcacacggattccagggaaatgcaagcctttcatctctcttccatagtatcttttttcagttgtaaattcttggttcagtttgcttgaaattcccaagctacataagaaataacttagtagaaagaaaaggaagaaaactgtgagaaaactacaagtctctctctctgggcctcttcttttctttttcccctccctctttcatttcctctcacacacactggcctctagctcactggtctcttacctcagcctcctgggtgctgggattacaggcccaagccactacgtccaagtttgactatcaaatttcttccagcataatgttggctctttcaaagattcttttccctctctcccattgtggatgacatcatggaaagagtgtgtcggagctagccagacaggaagcctgagagacaggcccaggcatgtacctttataaaaacactctctcaagagcccaaccagggtatcacgggccccacatccattccttccttcctgagcgctacatcccccaacccctgaggccaggttctacctcctgtagataccatcacatcttaaagtcaccatgctaaggactaaacccccgacatgtgaatgcttaaggaacaaatggaatccaaactccaagagactgaggtggtttattaagctaaaacagttagacaggccagtatgccagatcactataaccagaaaagttagataggccagtatgccagatcactataaccaaaaaagttagataggccagtatgccaggtcactataaccagagccctcgcaaggctgagacaggagaatggctacaagtctaaatccagcctggtctatatagcaagaaccaggctagctggagctataactcataataataataataatacatgctaagtataaagtcaaaatacatagccccaccaaagaggtttagcaggaaaaaaaagcagtatttttttctatttcttttctttttttgttttactctttccatgatgacctagatacacagtgatgggaattttgaaaaggaagtaaatcagtataatatttcataacttgtattgcttgcaaccatcctataaccagggatgaattacaaatcacaactccaattcagtttgtccaaatctacatggtatcagcaatctgtagcctgggggttgacagtcgatgaaacctttcagggaccaacaattagcaccgacaatgccaagaagtttgagccgcttgcctaaaacgtagaataaggaagcggaggagtctggagtcacatccaggactattggactccagaggcgttttagaaaactcatctcagagcagaaaccatgagaagcaggagcctgccagctgctcttgtttacacagttctgttggctctggaacacagttcaagggttgggcagggtgtggccatctggagaggcacgtgctgaaccttgaacaggcaaagtgacaaggcatccagcctgtgagactgcaggatgagagccaggatcagggcacaggacctgtgtcactagccttggtcccccacagagggggccatgctagcctaggttcacccatgtcagattaacaacagaatgggggagggggtggctcaagggaatcctctttctgatccacttttcttccgtcccaccagctcactcatcccttcctccattttgacacgtttacagttcttatctccatcagctgtgtctcaggcttgccacacaacagtgtagacgctcagataagtcatcctggtacccagcaagaccttggaagaacagtcctaagcaggatgcaaaagtaaacttttcccccgttggattgattcaatcctggtatttttctgaagtaaaaataaaaacaaaaacaaaacaacaacaacaaaaaaaaaaccaaaccaaaacaaaacaaaaaaaacctaaaccctgaatggcataccttgctattgtgagagtccgtggactttgttcatcgcttcaggcagaaaattctctttttttccatattgttcaccatcttgcctttgggattttttttttttttttttgatagagtctcaagtaacctgaactggcctcaaacttgctatgtagtaagaggtacctcgaacctctaacctcctgtctccacttcccaagtgctgacattataggcatgtaccaccattcctggtttatgtggtacatgcaagcctggtcagcactcttccaattaaactttacccataatccttataatacattcttctggttgggtctacatgagttcggcctgtcttcattcctcttaaaaatgatttcctcaacaagcaagggtggaatagttccaccacaacagacctatagacagtttcatggggggaaaagaaagacaatgttctattgttttttttttttaaaataactattcattgactatgtgtgtgagcctctggggggttatgagcaccaaccacctttgcacagtgaccatagaagccagaagggggcttcagagctcctggaaatggagttgcaagccactgagaggcactgcataggtcctgggaagctaatgtgcacaccctctacaaaggcagcaagtgttcgcagctgctgagccatctctccatccccaagattttttttttttttttttttttgaaatcgctatgtactaaatggttcctgcaagcagctattgccgattgccactttgctctgcacctgggagctgcatttgactgtttaagtggttctgtcccggagctgctgaaatgcccagtggaaccacaagcactccttcagacttcctgtttcccaagagcaggcaacaggggtgtcgattacagctcgtgcaggcctggggcagggaggcccacatgtcctgtgtgttttctatctgcaggctccgtacagatggtgaggttgttcccacagcaaatctgccaccaaaggggataggaaatcttggcaggaagctctctcaagcaccaggggagagtctcccagtgaccttggcctccacccaaccctttctcactactaaatgaggaaagcatcttgaacagattctgccaagactgatgggacttgggcctttctcagcgctggaatgttaggtgaaagcaagcagacacatgttaacaactagacacaaaacagcttcgatactattcaatcacaacaagggagccctcttcctggaggctcctagccacgtaggagagagaccagctttcctgggtgtgttcgcccgaaggcattcgctttctctggcaagatcttacggttaaccaagatttccatggagtgagcagtccttggcagaagaaaaacagaagcaagaccacaaaatattgaaaagactcctgaggctggcgtggagttaataatcacttgtacaaacgggcggaactggtctcaatggggcccagaagcaatggatgtaggggtatatgatgtggcatcgcggggttcgcacaggcaaggaaaaatatcagcggtctattcttttccatctccgaggccaccctcaggatagctgcttgatggtctttgcctccagaccaggcctcccccagccactggagatgcctcaggaggtctgacccacttagagctggaggtgtagggctggagagatagctcagaagttaagagcactgactgttcttcataaggtcctgagttcaaatcccagcaaccacatggtggctcacaaccatccataacgagatctgacactctcttctggtgtgtctgaaaacagctacagtgtacttacatataataaataaataagtcttttaaaaaaataaggaaaaaaaaaggtaggtggtagacttcctagtgctcaaagagaccagggtttgagtctcagccctggacttgagatacatagactgcctgggaactccctatggagctgggaacagtgttgaaatcctgatctcccttcctctatctcctgagatcctgtgtgtgtgccaccataactgggcaaaactgctaaggtgtcctcaaacagtctgtccctgtcaggacacttccagatgaaaaacctcatctcaggttcacctcaagctacagggttccagaggcatctgcatcctttgaggtctgtccttgcctctgtgcgcttctctttcccttgtgcctcctgaacaccatcacagatccccagtttgctgtcaacctctcagtcgactctgctctactgagaggtttttctgatgttcctagttacatttccagattcctgaagacagataaacaataccctgctgtggattagcgcctggcttaggcagaacagacccactctctttcccagacgccctcctgtctcccttattcactttcagtcaatcagtgttttaccactcatacatttatttatcttgctgggggaggggaatgtgcccacctggagctttcgagtggaggccagaggttacctcacaggaactggttctctccgcccacatcaggtttggtggtgagggcctttacctgctgaacactgaattttaaaacaaaactcatcagaataatcttaaataacccttctcattaaagccaccggtgtgggtgggtgagtgaatgtgagtgtgtgtgggggtatggttatctgtgtgtgtgtgtgtgtgtgtgtgtgtgtgtgtgtgtgtgtgtgtgtaaacagacctgacaatcctgtgggatgcgggaagaaaacacaagagccaatcataatagcttcctttccacttgtgcattaaattatgtccaagtattttacaaatacaatactttgactaggctgggcaatgggactagttcacgtctctaatcccagcccttagaaggcagaggcaggcagatctgtaaattctaagccagcctggtctacaaagtaagtttctaggacagtcagagctacacagagaaactctgcctcaaagagctgaaaaaaattatgtactatgactgggatagtggtacttgatccaaaaattttgtactgacccacaggtttctacctagaaccctcctatgtgcctcctttggtttgtctttatgacagggtctcatgtgtgctagacgggcctccaactcctgattggcctgtgtctatccctcacatgctgaagtttcaggcaggcccaccatgccctgttttcccaagaaggtatagtgactccctagagggactctagtgccacctttctcagtagattttgcctgatttccaaagtgtctcaaccccagtccattgtatctcttattataacaaatgcatgctttgggccttgtaatttagatttgaactttttttatttttagacaagtggctctgtcaagccaaggctggcctcaaactagtgaccctcctgcttctgtcttcctgtgacttgggttgcaggagagtgccatgccaccattcctagtttagacgtgtatataagttgccctttttcagcatttttagagctccctgaaagcagagatcatatctcattatctctggaagcctaacattgctccacacagcaaacagacatcaactgaacgaacatttgaggttatcgcacacaagaactgagactgatagttgtgtttgtttttgagaccaggacagccttgacccatggtcctcttgcctccacctcctacatgctggggttataatgggtgtgcacccccattctcaactttaaaattactctaaggggctggagagatggcttggtagatgagagcactggctgcttttctagaggacctgagttcaatacccagcatccacatggcagctcacaactgtctgtaactccagttccaggggcatctgacactctcttccgacttccactcacaccaggcatacacatggtgcacaggcataaaatataagcaaaacacccatatgaataaaatttaagaaatatgttttaaaaaattgatctcagtataacttgattttttttttgagacaggatctcacttatagagactagctgacctcaaacatgcctctgcctcctgagatgggattatgggtgtctgctaccacgttctgctataatttgctgtttggataacatattcttcatagagtgtaatggttattaataaagaatcctggaaggctgaacttttttcttttcagaaaaggaaatatcctggataacttctaggttccagtccacaataaataaacagatagaaagatgatatagataggcaggcagaataggtagatcgatagatgagagatgagagatagatgatagatagatagatagatagatagatagatagatagatagatagatcctgacaatgtgattaccacaagatggcagaataacattgcagtccaacattcttgcagcccttttccagacatcataggtatcactagacattcctctgagaatagaaagtgcccacaaagaaattttgacaggagctggtgtgacctacagattatctgctctgtgtcttgctgttctttgcaaaaggtgttggacaacaggcaacacctacctcctgagcatgtgatgggggactcagacccagcaggctggatctcttgcagagcagcagaatacagctgtcctgggagaatcacgtgctggagtgagaccagcctagagaacacagagagaagctatctcaaaacagaagcataaaagaacacagtcctgcctcggggtcagcactgtgggcagccagtgccttacatggctcctggtgaaccagaggaagttagctttggggatcatttcatgaatgagcccatgtttctccgcaacctgcaggtcccacagtgtttcttggggtgtccatgtctgggacttaacaagcagataacatccccagaaaccacaaaggttagctttaggttttgagtgtctggtcaaagtactttgttgtgatttggggtgtagtctcactgcatagcccagtgtgaccttgaacttcagccacggggttagtgacgtatgccaccattgccacagggagtgctttttagaagaatatgtcctgtgaggggctaaacttgatgcctttacatgtgctcttatcactgatagagcctgcaacaaggagattccctgatggaccttcgagccagtcctctccagctcttcccttgaagagaaatgatcagagaggcaagtggccgctttcctggggacagtggataagcactgtcccaactccacacgataatatcactcagtagagactcactgggctcttactctaagaacctacacatttaatctttacaacaacgctttgagttaagcaacttatcatttgtttgagacggggcctgtctttgtagaccaggctagcccccagatctccatgtagcccaggctaagaaaattcccattatttgcacacacacccacacccaaggttctacataaagcctcctcagcttagaagttaccctgaagaaggtgccaagaagagtggtggacttctactctccaataggttgtccaggcacaaggacttgagttcagttccccaagaccgacatataaaacaaagcaaggcgtaggatcatgtgcttgtaattccagcactaggaaggtgaggcaggaagctggctgattccccagcctttcagcccagtcttcttggcataccccaggccaagcagagactgttgtaaaaaacaagctagacagcacttgaggaagaatggcccttaaggctgtcctctgacctccacaagtatacacacacacacacacacacacacacacacacacacgaaaaagaaaaaaaaacatttgcttatatattgtatatctgacttggtggactaaaagtacctagagaatgaattctaacatttgggaagctgaggggtagaagactgacagattcaaggccagtctgggctacatagtgagttctagacaagccaggattgatagcaagactctcatcacaaaacaaaacaaaacaaaacaaaacaaaacaaaacaaaacacaacacaacacgcacagatacacagagatacacacatgcagagagaggttaattttatgtggacctgccctgcagatgcagatttcagggttgctaagttccacatatcaagcccaagcatatagaggccgagggctttcgactgctaagcacacgctatccctagtggtgatactgcagaactcagagcacactgtacaataggacatcaggctcctaggaagccctgggagaacagggccgcacagctaagagatggatggtacctgtgtgctctgccaagtgccgcacactctccatccagccgagcccatccctctgcagaaggctcatagacagaaagcccccctccctggagcagctggctccctttggtttgcagcttttggcaccgtcttatcttactttgataaaaaggaattttgcaataaaatttcttggcaatggttcagtgaagaattttcatattatcattttaaaagctttgaggggtggacccggagagatagctaagtggtaatcttccagagggcaggcatttgattcccacagccacactgggtgactcacagaattccaactgtaatttcagctccatgaaatcctcttctggcctctatggccatccatactcatatgtgcattcatacatatacatagacaaaaacaaattcaatcattaaaagtaaaaaaaaaaaaaagggctttagagggctatggaaacggctcagtggatggatatgggcttgctggggatgagcttggagggctatggaaacggctcagtggatggatatgggcttgctggggaaggataaggatgtatctctacacccacattaaaaagagccaggcatggtccacacggatgctggagaggcagagacagagacaggaagatacttggagcttgctaatcactagcctagtacaaaagtgaggtccaggttcagtgagagaccatgtcatataagtagcacaagattgtcgatcacattatcagagctctaaaagagaccatgcctcaaaaaacttaaggattatgataaaagagacagctaaggtgtgctcacatgcacaaatgtgcatgagtgcacacacacatacttcacagctgggtatataactcagtagattgcttgcctagcacacacatggtactatgttgattcccaaccacacataaacagagtatggcagtacatacctgtaatcccagcactaaggaagacagaggtggggggaatcagaagtttagggccatgctctgctatacagacatcttgaggtctgggtacatgacatcttgtctctgcaaacaaagcaaacacacaaacagaagattattaaagtatcattagtaagccgtaacttgttgacacacagattgcctatagcagaaaatttgccattttttgaagcatacaaaggcccctgagaccatcagcacaatcccccagaatggccctctgtctctccagtgtagtccattccagtgtccaccaagcagacattggtgtttccatcattttctagagcagaaatggaatcctacaacaatatgtagtcctttgtcagaatcctcccactcagcatagttatatattgttgcatggggcccgctagctcattcgtctgtgttactaagtaattttccactgtggggatgttccagggttgatccctctccctgtctttggattagtactgtcttttctttggaacaactacctggcattgggtagattgagcatatggtggccatgcttaagactctgctaaacaattagaccttttaaaaaatgtttgcatgattctttcattcccaaggaacagagttcttccatatcttctttgttagtatgttttaatttatcttaatgagggtgagtggtatctcattggttttagtcggtatttgaattaattacatctaatcttggatattctactttgtcttatttgtagtctatatatcttttggggacagtaatttggggtgggtttttttttttggtttgtttgggttgggttttttttgtttgtttgttttttgtttttttcaagacagggtttctctgtgtagccttggctgtcttggaactcactttgtagaccaggctggctcgaactcagaaatccgcctgcctctgcctcccgagtgctgggattaaagctgtgcgccaccacgcccagccaatttatgctaatcttcctccctcagcttctcaagtgctagggtaacaggcatagactaccatgcctagctatctgccatctgtttacttcctatgctaaagtatttgctcaaatctctgcccattataaaattggatagattaaaaaaaaaaaataacgcttatcagggctagagaaaatggttcagcagtcaagagcatttgctgatcttgcagaggatccaggttcatatgcaactggaaatcattagacaaaatgtaagggaagtggggtttatagggcctcctgaatgatctttgcaatctgccaataagcataaaactagtctgaaatgggaatctctctttaaaaaaaaaaaaaaaatatatatatatatatatatatatatcaaagtagtcatttagaagaacagccagggaaagtttattacaattgctgtgaaacactggattctaaaaaatagtcatccctataatatcttcccaactgcaacacagccattggcttccaaccttccagatgctcctgtctggctggaaatgtgtgtttatttcttcaagctgtaaaacggttctcacggggctccacaaagcagaagggttttaatcacccccacccccagcccctctcagcgccctcactctcccagatgtttctcttcccaactaactttgaccacattactctcgctcatgtgtcagagatacagaacgtcccttccgagaagagcccagagatgcttaatgtttgtggcacgtcgtaaaacacaaagagagattatactctaaagtcactaccaggaatcactgtgctttgtgtacaagtggaacatgtgtgcccattcacccagaaactgagaattggaaccctgctgacaaaggcattctgaaaacgcctatcacataccagggatgagcctccaaagcaagaactcaaaagagcacaggactttgccccatgtggataccaattgagtttctagattcctggtatagctttgcccaggaagaaagtctcacaagatacacagtgtttcaacaataaaggaacctctggtggaaccaccatgcctgacattaagctgtactacagagcgattgtaataaaaactgcatggtactggtacaatgacagacaggtagatcaatggaatagaattgaagacccagaaatgaatccacacacacacctatggtcacttgatctttgacaagggagctaaaaccatccagtggaaaaaagacagcattttcaacaaatggtgctggcacaactggcgattatcatgtagaagaatgcaaattgatccattcttatctccttgaacaaagctcaagtctaagtggatcaaagacctccacataagaccagaaacactgaaattaatagaggagaaagtagggaaaagctgggcacagggggaaaattcctaaacagaacagcaatggcttgtgctgtaagatcaagaattgacaaatgggacctcataaaattgcaaagcttctgtaaggcaaaagacaatgtcaatgagacaaaaaggccaccaacagattgggaaaggatttttaccaatcctaaatctgataggggactaatatccaatatatacaaagagctcaagaagctggactccagaaattcaaataaccccattaaaaatggggttctgagctaaacaaagaactctcaactgaggaataccgaatggctgagaagcacctgaaaaaatgttcaacatccttaatcatcagggaaatgcaaatcaaaacaaccttgagattctacctcacaccagtcagaatggctaagatcaaaaattcaggtgacagcagatgctggtgaggatgtggagaaagaggaacactctctccattgctggtgggattgcaagcttgtacaaccactctggaagtcagtctggaggttcctcagaaaattggacataatactaccagaagacccagcaatacctttcctgggcatatacccagaagaagttccaactggtaataagaacatgtgctccactatgttcatagcagccttatttataatagccagaagctagaaagaacccagatgtccctcaacagaagaatggatacagaaaatgtggtacatttacacaatggagtactactcagctattaaaaacaatggatttatgaaattcttggacaaatggatgtatctggaggatatcatccttagtgaggtaacccaatcacaaaagaagtcattagatatgcactcactgataagtggatattagccaagaaacatagaacacccaagatacaatttgcaaaacacaagaaaatcaagaagagggatgggtggatacttcattcctccttagaatagggaacaaaatacccatgaaaggagttacagagacaaagtttggagctaagatgaaaagatggactatccagagactaccccacctggggatccatcccataatcagccaccaaacgcatacactattgcatatgccagcaagattttgctgaagggaccctgttatagctgtctcatatgaggctatgccagtgcctggcaaatacagaagtggatgctcacagtcatctataaaatggaacacagggcccccaatggagaagctagagaaagcacccaaggagctgaacaaccctataggtggaacaacaatatgaactaaccagtacccccagagctcgtgtctctagctgcatatgtagcagaagatggcctagtcgccatcactggaaagagaggccccttggtattgcaaactttatataccccagtacaggggaatgccagggccaagaagtgggagtgggtggttaggggagcagggcgtggagaaggtatagggaacttttgggatagcatttgaaatgtatataaagaaagtatctgccaggcgtggtggccgggcgtggtggcgcacgcctttaatcccagcactcgggaggcagaggcaggcggatttctgagttcgaggccagcctggtctacaaagtgagttccaggacagccagggctatacagagaaaccctgtcttgaaaaacaacaacaaccccccccaaaaattaattaattaatttaatgaatgaatgaaaaaaaagatacacagtgttaaaatgacagggcagccaaccctgagcccagtgaggcttcttctagctgagtggaacccatgatggtttagtcttccctgaacctcagctctgggcttgtgaccacagcaaaaccacaagaaccattcagagtgtgtcagacaagcacagagccatcccaagccttggaggtgattcctagaaagaccaggaagaaaccaaatattcactcatctgccagattcactcatctatgacagaggtccaggggagaatgtgctgggggggggggggttactgggagtcccctcccaggacacccacctcaggagtttgtgcctttgctgaaattggatctgtgactcatactgtaacaacagattattccagaagtgacaaagtatctttccatgattaagtgcccacataaataagacttcatcttatgaacagacaggcaggacttgaggaagctgttctgaaatgaccacaatagagaaggcctacctactgaccatggcaaggagccacaggcaaactctagtaactttgagcagcttcccatcagcaaccaaagctgtggcttgatgctaaaaatgagtgtgttctgcccatgacctgctggatcccaggaacagatctccaccatttagcctcagatgaatagcagcctgtgtcaaggccagagcccagaacccagctgagtcagacagaggcttacagaagattctcctatgtcacccagccattccatcttcttttgtagaccagaatggcctcaagcactgtgatcctcctgcctctgccttctgagtgctaagactgcaagtgtgtgcagtcacttcctgctactgtttttctcccattaattcttacacactcgaaggagcatcctttcactcccctactgttacagagcagaatcaggaatcagaagatcccatgggaaggtggtggctcaaaagatagacacaggtgggtctctgtgagtttgaggcgagcctggtctacaaagtgagtttcaggacagccaagactagacagaaatctggtctcaaccttaccgcccccacacacagaaagaaagaaagaaagaaagaaagaaagaaagaaagaaagaaagaaagaaagaaagaaagaaagaaagaaagaaagaaagagagtgtaagagaaagaaagagagggagagaggaggggagggaggggaggggaggggaggggagggaagggaagggaagggaagggaagggaagggaagggaagggaagggaagggaagggaagggaagggaagggaagggaagggaagggaagggaaaggaagggaaggaagagagagaaatctgaaggtcctcagggatcagttataaataagtacaaagacagagcagttcctcaaagaaagtgtgtggtcttcaaaccataattaaaaataaatcaagtgggactggagagatggctcagcgggtaagggcacagactgctcttccgaaggtcctgagttcaattcccagcaaccacatggtggctcacaaccacccataatgagatctgacgccctatcctggtatatctgaagtcagctacagtgaatttatatataatgataaataaatctttaataaatgaataaataaagtaaaaccctccaaacaataaccaaatgataactttccaccgaagattctgcatgagacccaacccatttaactttgacagaacaatcggctcagagagggtgatgcctttcaagagttacacagccatggcagggctgagaggccgcctccatcttcctcacacgagcaggctaccgaaagagaagcagctgctcgactgtcctttgcaaatgttctcaactggcttttgtagagttgaggctgaattccatcatatacccacaaacaagaataacagaataaggaagagggacatgttaaaaaagaaaatggtgcgggagcgatggctcagcaaacagcaccactatatataacatacttccctataggtttacactatcaatggtcttcataaagtggggcggtcatgggaagaacacttggagactgtataatggaaaacacttggagactgtataatggaataactgagcaatcacaggcaccagcttcatgctgggccatgctctgtacagctgaagcatctctggtcatgcttccttccttcttcatgtgacctgcaccttggggacagtggatgcttctggggacagcagcagccaagaaaacagtgtcctgaggtcaggacacagttacctgtggaccctagtgcccatgaagttaaaacaggggacccacatctttctgggctcttggaaggcactaagcatcattaaaaatctgttaaaaatctgtcaaaactgctaacaatgttagtaagatggcttttttccccctgctgatgtttggaatttttaaagggttttttttttgttgttgttgtttggtttttgtttgtttgtttgttttgagacagggtttctctgtgtagccctggctatcctggaactcactttgtagaccaggctggcctcgaactcagaaatccaccttcctctgcctcccgagtgctaagatcaaaggcgtgcgccactacgcccagctttaaggatttttatttgtttgtttgttttgttttctctgtttttctcttgtttgtttttgagacaggatttttctgtaggtttctctgttttggaactcaatttgtacaccaggcctagcctcaaactcacagaggtctacctgcccctgcctcccaaatgctgggattaaagtcatgcgataccacacatggcctatttttgttgttgttgttttaaagatctattgtatttattttatgtatgtgagtatactgtagctgtacagatggttgtgagtcttcatgtggttgttgggaattgaatttttaggacctctgcttgctctagtcaactctgctcactcagtccctgcttgctcaggcccaaagatttatttattatcatacataagtacactgtagctctcttcagacagcaccagaagagggcatcagatctcattacggatgattgtgagccatcatgtggttgctgggaattgaactcacgaccttcggaagagcagtcagtgctcttagctgctgagccatctctccagccctgtgttgtttttgtttgtttgtttgttgttttttagaatctgtatgagtatttgtctatatgtatgtttgtgtgccacactgatgcttggtgttcacagagagcctgagggcattggtcaggctctggagttacaaatagttgtgggctgccatgtgggaaccaacctaagtcctatgcaagagcggtccagtgctcttaagtgctgaaccgtctctccagccccaatatttgttgcttgtttctttgtttttgagacgcctccctacatacctccatactctcctggaactcactaagtagactaagctggcctcaaactcagatatctgcctgttcctgcctctcaagtgctacaattaaaggtactttgttttgttttgagacaaagtatcacaccatagcccaggctggcctaaaaattactttgtagcccaggctagcttcataagctttgccaatcttcctgtctctgcctcccaagtgttacgtttataggtatgagcccccacaccctcctatgctggagatgggcaatttgactcacattgggctttcccttgccttcctggctgccttaaagatgcagcatcccctagggctatttgaaacagtttgtgctggattttagctatcacaaaccttgctcaactcttatcacaaagatcagaagggaagccctccccaacccccccctccccccgcggatgagttgaggaattactgtaattggtgccaaagggacaaagctggaattgacccttcatttagtacaaatgtgatgtgactggtacacacacacacacacacacacacccctccagctacataaggctcttggtaagctgtctaggataaaccctcaatgcaccaccaacaccctcccattcccaatagtagggcctacctaaagccttctcgtgagcatgtactttctctctctctctctctgtctctctgtctccctccctccctctctctctctctctttctctctctctctctctctctctctctctctctctctctctctctgttcctctctgtctctctgtctctctatttctctctctctctcaagtcaaggctagcctcaaattcctgatcgtcttacctcgaccttccaagtgacttgggtagtctctgcttgtctatgttcgcagtgtaggctaaggaaacagagcagaaacatgaatccatgaggtgccactggcaactggcactggctgctactgtagagggaacgcagccaccatcatgaagaagcctggcctggggaggcctgggggagatggtcacagtcaggatcataggctcagcagcccatgtgaagtccagaggcagcaggcaggattgtcctcccaaacatctcatagcatcccacaatagcaagacttaaaattcatagagcagaaatgctcagcaccttccccgtgctgggattccaggtttgccgccactgttccaccctctgactcatgagtctagctactaggggaattcaggtaaatagaatcatatgatgtttgtccttttacaatcccctcattccatccaggattgcttcagaggtcattgctggccaagcatggatcaggactcttgtctcctcaaaggctgactctgtatgtatattagaagttgcggcttgcattccctgatacacatatggaccatgtcttgctcatctgtccctctctgacaggcacctgttctagaaatgaggatgctagctcacaacgtggacacatgagggtctctttgagtctgttggtctgttagggaatgggactagaaaaatgactggatcccatggtaccctagatttaacttttgggggaccttccaggatgcttttcacggtgactctattcgttcctattgctattgctagctgagcccttgttgtacctggacaagcaagggtgacagggagttcatctggaatgtaaggccctcggctcattgcattgataactgttagtgttgagacttttcctaatttagggtcctcctctttccctttacggttgttttgtaatgagccctgtgtgatggtcctccacatctcccctgttgtttatgcctgtctgccaggccaaatatggttttagccatttagagccggcctactttacaaagctcacaaactatgccaaacatctcctaaccctatgtatataagacaaacgctgttctgtaaaagctgtatagtctggcttctccagagaaataaatccaaaagaatatataaacatgtgtacatattatagacatacagacatatgtgtgtactaatatagtgtatatacactaataaagcacatagtatgtgtatataatagatacaatcatatatacatgcatgcatattaactgcatggcatagttatggaggctgagaattcccaagatgtgcacttggcgcacaggacgctggagaccggcagagccctgcagcagaaggccactgtcccagctcaaagagtcaggcagtccccaagttctctctttaagtctttcttattggggcctgcagcagactgaatggggcctgactacttcagagataacatattgcccagctcagcctgcagactcgtgatttcacccagcaatctcctcaaacggtacagattaatttttagctaaatgcttgagctgcctaagtcagtccagtggatttgtcaagtcagtctccacaggttcccacgtgccctgatcctttgaaatgctctagtctagagccttcccacgacaaacttagtctcctattctccttctgtggaggagttggcttgtcctctccgggtagccttcctgattacagtctctggacgtcctttgttaggagcagatctttagccagccctgccacagcaccgccttgaaacgtatgcagcaatagtgcccccttgtggtataacctctccctgcatcagccacgaaaatttttttaattggttatttacatttcaaatgttcttcctcttcccagtttcccctccacaagcccccattccatccccctttccaactcaaccacccaattctgcctcaccgccctagcatccccctacactgggtcaccaaacctccataggaccaagggcctcccctcccattgatgcctctactacatatgaagctggagtgtactctttggttggtggtttagtccctgagagatcttggggggtgggggtggggggcggggtctggtttgttgatattgttgttctttctatgaggttgcaatctccttaagctccttaaagtcacttcccctaactcatccattgcccccacaacccatgctcagtcttatggctggcttcgagcatccccatctgtattggtcaggcactggcaaagcctctcaggggacagctataccaggctcctgtcaccaagcacttcttcagccaccaaatcttgaaccaccacccaggatagtccaaaaccagaagactgcttttcacccttcttgttccagccatgtgcttgggaaaatgcctcatatcaccttgacttctgcaccaagtccattcccaagccccttggatttctatccatgtccagggtattgtgggtcaactatgggtgaaagggggaagagtggaggtaaaaacaatgtctgcattcttctgaatgcaaaattcactgcactcccattgacaataaccacatctttaaaaagatttgggctagggagctagaaaggcgactcagcagttaagagcttgtactgctgtcagagggccacgctctggtctcggcattgaagcagggcagatcagaaccacctataattccagttccaggtgatctgacacccatacctcaagcacccatacacacacaaacacatacacgtgcccacacatgcacaaacacatacacatgcccacacatgcacaaacacataggatttttaaactcgaaaataaatatgttcaagttgtgttttgttttgttgggcctcagggccctggcttgttggtgtgcttagcacaaagcatataagcctgctataaaaattagactcttagccaatattgcagtattcgtgtttagcacagtgcatggcatatagaacatgcttgatgaaggtttgagctaatttaaataggtatggtaaataatattagactgactacatcatgtggaggatatatttttttctccagcaggccccgtgattgcaattacgtgttatggaaaaccctcgattatatttattattgtttccttttaagcaagactataatgctctggtttcagcaatgctttcaaagagagagagagagagaggcaaaattgcttcccaactaaatgattaagatctctaaatttaaacagtgacattccccctccagtcactatttggtaagaagccgaatttgcctgttgccaaaacacaatgtaaattaataaaaagtttaaaaaaatgtactttaaaaatattttaaacaattctttttgattccggaaaaagaaaaaatgcaactgcctttgtaatctttcatttgtcttattattttgtaattaatatgtatatttggaaatgcttttccttcagaaaaagatgttagagagagggttaatgctcttcataagatgacaggcagaacctgtcaaaggctatttacagcttgcaccagagagctgaagaataatttattggcttattaagttctgcctattccccaaagccaacaaaactccaaaccctcaaattctgaaatgccagagccctctgattaaatgtcttgatagccgccgtctgtctgaggctatcatctgtggagtgtgtttgcttttgccaaatgcaatctgcccccatactctgggtggttgggatttacttgtggttcaaagatatctagcatcaaagggcctcctggaaggatgcacccaagcaagctagggccaaccagagatggacaaagacttctgagctgtagctcattcccagatgctatgcacaccaccggagtttgcaagaaacctctctctacccaagacttctacagagcctggagattcatgggctcccccaaggatctgtgaacagaattgtattgctgtataattagtctctgtaattccaggagtagggttttttttatggatttctaaggagtccacaaccttcattatatgaacaaaggagtcctgacaatttatgatattcagtatttagaattcaaccccaaattatcaaccataccaaaaggaggggggctacaaactgtaaattttatttttatttgcctgatgtaattgtcatctaggaggctcagtctgctaaccgaggcctagccctgaagcttctcccctctatacagtcttatctaacctcgaatgtttttagcctgagacttactgctgaatttgcttaccctttctagtgcttttgaactctggctggctggtcaactccacagttctggttcaaaactcctcttcatgctgactggttcaaactggcttctttcagcttctgactgaattgctctgcttggcctcatactacttttggcaatctgttctaatcttctggctccttctcattctctggctcattctgtattcacttatgtctagcttagtttctctctgcagcctgtctctgtacagctgtcccagtaacactgtcttctctctctgtgctgctctctcttaagtcatgtcactttcctctctgttctcatgaggattgggcagatcctattgtgtcaaatctttctctgattcatcactttgtttgctactgaattagacatcactttcaaacatggctgcttccttctacaaactaacttcaccttcattgtttgggattaaaggtgtgtactaatggtgtgtctgtattccagccagagtagccatgttgctggattaaaatccctctgcaacaagcaatacaagtcctttgaacttgactcactgctaacagttaggaagcactattcataaaatgaaacaccacccgtaagcagaagtcgggtggctgtcctggctcctacaaccccaccagcccaggctcagcctccatctcaagtgctgattgatgaacagtggtaaagctcacagaaaggaacggattgatcagtgcggaatggggagggcacaagtaggagctctcctgacaccaggttcatctgagggctggcctgagctttaattaacctgtttatggctttgtccctttatctttttctttttctcatagaatcttaggaaacaaaagtgccaccatgcctggttttatgcactgctggtgataggaaatagggcaggttgccaggtgactgctctaccaatggaactgtttctccggctctcaggtatctttgtgccttcagccttgaaggagaatgaggtagatggggtattactggcttgtttgtttttgtcaataaaggcagctgtgtgccaccactgcccagggattactgttttttaaatagacccaccttacaaggtgattgacatgcctatctgcagaggggagcaggtggctcaaagtgaaggagacaggtacaaattcaggcagagcagacagactttcaccctgcttgtagttattctgtggggccaaagtgaggcttttgttcttattgtttttagcaaaagtaatttcttaatgtgtgttttatcgtaatctactgtaagctttaatttttcaaaacctacttttaatgacagttctcaaatgctttaacctttcttctagcccaccacctaccagaggtagtggaaaagaaaggacatgggggaagtggacctgtttagaagtggttctttgaagcagctctcatctgtgttatcaggaaatcggcagtttggtttacaggtcagcaacagcagcttgatccacttgcaaacacttcacagatacaccagcagtccagttcgggagagtccgaagagcaaacatgaatcagcagtagtgccatcacctaacagggacatccaggcctcagccagatcagcacaagtcagcaggagggaccagaaccaacagggacaccaggagttctttgctgtgcctctctcagtgaagcaaagatcatcaaagatgagagaccaagaagtattgcagagctagctctacaagcaagcccctctcagtcctatttacactccctccaaaaatcacgtgctctccacagctcttgcctcagcatgtgagtctgtcttagcaaaactccacgagtctatatcagctgacatcactctgccagttgacccaagtcctcagaagctgcaagaagccgcagcatactaccagaaggtttttttggtgtatttcgatttctggagtcctgacaaatggcgctcaactacacaatttaaggcagaccaatacttgtgtgttgttaatgaagaatccgtcaccatgtgtcctttcacgtgcttgctttagcagaaaatcctttcacgcgtgtctgcttcagtgaaacattccttcacaagtctgccttagcaaaacatcctttcacctgtgtccacttcagggaaaaactccttcatgtgtttgtcccagcaaaacaccatccaacacaactgactttccaaagaacccttcaacctaaaaaaaaaagaagaagactcggaaaccaccttagaaatgcatctcacaaaatacctgccaggccattagaaaactacagaaagattttaaacacatgtctgaaaataccctaaatatcctaaagacacacttctttccccagaagtaatctatatatgtaatatgattccaaataaaatttcaacagggtcttaaaaaaatatagctcctctaaggccaagctggatgacatgatgtgggtgacatgatgtgggtgtaaaaccatgccagggagtttggtaaggtagagcaggtcgagacccagagactcggtggtcacacacctgaggcttaggtgactcttagctccctgccagactcctgatttggaacacgtgccatgcttctcacataaaagaaacctgtcctatggtcacgtctgcccaaaacagagttccccgttctaatgaggtacctagaggcagaggagtgcttagccaataagcttcccttcccgttcttgcctgcaaaaggtatttaatctcaggcccaccctgaaaagtgagatatagttttacgaatccattttctgccatgacaataaactgtttagaaccatgggctgtatcttttcatcaagatctgcagtgaggagccatgaaggaggccttcacctacagagtcttagcctaatctcccgtagaaggcccctctacgccacaacagccaccaagcctgcctccacctagataaagacaatcaccacatgagacaagccttgtgccccagccccaggctagatggtataccagcccacggatcccacactctgttctctgctctttggtgactcccagtggtgcctggatatccaagagtctgagaagaaccccacagccccagccttgtcacaggcccagggaccccaagccagctccaatttcccatgtctcagactgcaccttcccacccccagatctgtgtcttgccactttcctacagctcagcacccacctcagcagtggcggcatggggtaagcacagtcaaactcccagcattccacccagtgtcagagtagacacaggcaaacaaccctacaagacatctcagaagttctgctctcagacatggtgtctggggatgcttgccatagaatacaagctaaggactttcccaaggaggaccttcccaagtctgcccacctcatagtctttttggtctcacgagctgtgatgacctactttgtctgggaaattaacagatcaggacccaagtggacaagaaagttgtggaggctgagggcaccatggaagcacctctgtggtagttgcaggcatgtgtgctgtgcagcactcttcaacctaagagcaccaaaactttctctgccgagtgtatcagcaacaaatgcaaaggccacttccataagatctggtcacccacagtatcactcatactaaggtatgcctgcttcttttctttttttttcctctcattatggatggttgtgagtcaccatgtggttgctgggatttgaactcatgacctctggatgagccatctcaccagccagtatgcctgcttcttgtccaccagaagacctgccttggggggagtaaggtaaagagggcactctagctgaaaaaacctggacctgacctggagaggcggcagccacagaatctccaggaacaaggtgttccctaaggatgcgatggttgacggcatcaggctgaccaggagcaaagaggtcaccagctactgacacaccaaaggtcatgcaaagttacctgtgttgaaggctgacacacagccctggtagccttctctagcatgaactgaacagataggctaccatcactgagctgcaatcagcagcaaggccgacaatagattggtcagggcttcaatttccagctcagcgagctagtcaagaacagtgcccccaccaactatgacctatctgataggagcatcaaccctattatggcaaagtgacagatgtctctgtcatgctgaaagctgtatggtggggaccaggaagtacttgtgtaccctacgtaagtccttaatggtgcagacccaataaatagcaggctctgtagaagatccatcccaagttcatcaacactaagttgggctgtggccacttctaacatatagagaagatatcagtcatggaatatgtacaagagacaggactgaatgggctgaagatatggcttggtgggtaagcatttgccatataagtgtgaagactgggcttgaacccctccagcccatactaagctgggtgaactcagtagcaagtgtctgtaacactagtgtttctacagagagatggacacaggagactctctggaggctcacggccagctagcctgtcatgcccagtggcgaacagcagaggccctgtgtcaagcaggtggaaggttaaaatcaatgcctgaggttgttccctacctccatacacaccgtgaaaaatgcatgcacacattcacatacacaaatgttcaggcacacacatacaagatgattttcaaagagggagggagagcgcagggaagcaaatacttaatgtcagcatgttacatgggtggtagaaactccgttttcattcctcccatcaagggacataaaagaacacccaactttattcagacataattaaacatgtcatatgactcaccttagaaaatatgcaacagtggttctaaacgatttcctcctaacctgacaagattctaaaaatgtctgtacagtgtagacagtttaaaataggttggttcccactgaggctaaaaccatgtgtggcaaagtgttcccagggcagggagaatgggaagccatctaagggggcacgggcaggagtcactaaataaagtccacagggagcggggaaatccctgaaagtggagcttgcatacagctgcagcagtcacagtagacacatttcaaacactgatcagtggtcgggctggagagacgattcagaacttgacactattgcagagaactcaggttcaaatcctagcatccacacggagactcccactggtgctttggttccaggagatctaatgccttctttttctactggtactgcacacatgtggtccacataaatgcatgcgggcaaaccactcatacaaataacacatatagttttaaagaatgatttttttttaaagttgaccagttgggggaagcgaagatgaggaagaagaggataatgattagaatgaagaggaggaggaggaagaggaagaggaagagctgccaccacagcagcaagggtcaggaagaggagccagctactcactcaaaaaagatcctggaccctaacagtggagagccagctcctgtgctgtccttcccatctcccacagacctctccaccttcctgtcccatccccagaagagctgctgtgtctgggtcatcaactaaatgacaacaccttttgggatcctggggactctggaagaggtccatatgccacagaacagaattaaccaccctggcgtcatggccctggctcaggcatttgccatcaaccccccgttgtgggtcatcaacctaaatgacaacaccttcattgagaagggtgaggtggccatggctgagatcctgaagactctgggacaagtggaggtgatcaattttggatactatctggtgtgctctaagggcaccgttgccatctcagatgctgtccgtgggggcctgcccaagccgaaggagctgaacttgtccttttgtgaaatcaagagaaatgctgccctagttgttgctgaggctgcggctgacaaggcacaaggtctccgtgctgatattccagcagactgatccctctgaccctgagaaggttgtttcagccttcccgaaggtggcatctgtgttccggggcgaggcctcagtaagacagcagtgctggtaccatcagtgccctcctgaagaaggcaggagctcttcctccttcaattctaacaccttccttaccagcctgcccatccacacgggtctgctcaagagtgaagatcaaggccattcccagcctgcatggcccccaatggtattgaaccatgtggtgaagcgggactacttccccaaggcccttgcacacctgtctttggcattagtgacaaagcccaatggttcactggaaacctgctcctttgcctgccataatctgctacagacactgtacaaaaatctagatttaaagccagcttcttcttgtccctcaccctgccccagtgacttggggactggatagactgagcaaagccagcatctccgttgggtgggattttgaccagaggcaggggagggtcttgtcttccatgtcatattggtccaatgatactgtgttgatttgatgtctgtgggcatgtacttcctgtctggattgcagatcttcatctccctgctggaccaacccaggttcactgtagggtattgatgcccaggggaagggtggaaagctgtccagcacctcctgaagttgttcacagccctctttctcctaaggccttgccattgaggtccagcttctccagctcagccttgccagccacagcctcagcaactaggtatctctcttgatttcacagatgacaagttcagctccttcggcttgggcagacccccatggacagcatctgcgaaggcaacagtgcccttagagcgcaccagatagtatccaaaattgattacctccacttgtcccagattcttcagggtctcagccatggccacctcacccttctcaatgaaggtgttgtcatttaggttgatgacccacaacagggggttgatggcaaatgcctgagccagggccatgacgccagggtggttaattccattctgtggcatacgacctcttccagagtcccgagaatcccaaaagcttctgccagagcagtggctccataattctccaggagattttggtcagccacaaatgccttcatggccagtgacttgctttaggcactggacttgcggtgacactcagtcagagctgctgccagaatcttgccaccatcgatggccgtgccacagttgttaagcttgagttcctgcagggtgaagcaggctgggctcttgaggagggcctcaaagcctcgcactccatcaggtccaaatgcattctcactgaggtcaagttctaccagctgtgctcctacagtgatgagtccctcccctagtgagatcagagctggtgggatcccaggcccaccagatgaacatgtcactctcatggcatcacttcagctccgacttctctaagcccttgacaatgtctctggccgtttccgtgcccaccatgttgccctccaatcgtagagcttcgaggctgtcaaactcttcaatcttcttaatcacatctttagcatcttctgcagtatttagtttgagacacttgcccttaaaatgtagcttttctctggctacctgggttttggccagggtctctgccagtttggcaatgttttcagaggccatgactacaatggtgggctaccctggaggtctgtaaactcaaactagccatgctgccatgttgggccggggggacggaaaatgagtctgttactgcttgagagctggcatgagggccaggcctgtcaccgagcctctgtatggtgggcccagtgatcagtctgctcgcctatccttcctgccacagctgctctcctaggttgtacacaccacctgctccatggtccccagcaattatattttgaagcacctgtaaggagatatgtgtaaaagattttagacagcaatgttttagtttaaaaaaacaaacaaacaaacaaataaacaaacaaacaaaaaaaaaaaccaaggggctgtgccttccacttgggcagactatcagcatgtctactcctctaaagaccccacagtctgaaggcatcgcaggaggtctgctacagccagggccacaggcctcctaggagacctgcagcaactaagggacacaggaggcagctccagacatagagagccaggccagttaacaccagagatagccagatggcgagaggcaagcacaagaccataaacaacagaagccaatatattctgacaccatcagaacccagttctaccaccacagcaagtcctggatacaccaacacacctaaaaccaggatgctaaactaaaatcctctcgtgaagataatagagtcctttaaggagtatatatacaactcactgaaaggaatacaagaaaatataggtaaacaggtagaagcccttaaagaggaaacacacacacacacacacacacacacacacacacacacaatcccttaaagaaatacaggaaaacacaatcaaacaggtgaaggaattgaacaaagcagtccaagacctaaaaatggaagtagaaacaataaagaaaacagaaatggaggcaaccctggaaatgggaaacctaggaaagaggtcaggaactaaagatgtaagcatcaagaacgtaatacaagagataaaagagagaatagcaggcatagaagataccttagaagatagtgacacaatgatcaaagaaaattcaaaacagaaaaaaaaaaaaaaaaaacttctaacccaaaacatccaggaaatccaggacacaatgaaaagaccaaacctaagaataataggaatagaagagagtgaagattcccagctcaaaggacctgaaaatgtctttaacaaaattatagaagaaaacctccccaacctaaagagatggccataaatgtacaagaagtctatagaacaccaaatatattgaaccagaaaagaaaatcttctcatcacataataatcaagacaccaaatgcacaaaacaaagaaagaatattaaaagctgcaagggaaaaggtggagtcacatatgaaggcagacttatcaaaattacaccagacttctcaacagagaccctaaaagaagatcctgggaagatgtcatacagaacacaatgcctaagagaacacaaatgccaacccaggcaactataccctgcaaaactctcaagcatcatagatggagaagccaaaatatcccatgacaaaaccaaatttaaacaatatttaatcttccatttcagaggattctagaaggaaaacttcaacacaaggagaatccctaaccaaaggaaaaatgatattaatcatctcacaacaaaaccaaaaggagagaatcacatacttataatgccacctacaacaacaaacataataggaaccaacaatcattgttacctccttccagcctagcaaggctggctgagaccatccaccacttaggcagagccacctgctgtgctgtttctcatccctctcctttgatataccactacctgctacctgcctgaggctgaaccggttctccaagatcttctagagttagcaccaaactgtgatcttcaagagttcctactacaaggctgatctgacaacttcaaaggaattttgcatgactgggaatgggcctcccctcttctttataaagcgtgtttgccgacattaaaattgaaccttgagcagactagttgtcttggtttcattatttctcaacccacctaggctccctcttttcttccagattccaagatgccttccaggctcgaacccggacatgagagccacaggccagcctcaacaaatcatcagtctttaatatctgtcaatatcaacagactcaattccccaataagacataagctaacagactggatatgcaagcaggatccagcattttgctgcatacaagaaacacatctcaataacaaagacagacacaacctcagagttgaaagcttgaaaaaagtcttccaagcaaatggtcccaagaaacaagctgaagttgccatcctaatatctaataaaatagactttcaaccaaaagttattaagcatgatgaggaaaaacacctcatattcaccaaagggaaaatttaccaagagaaagtcttaattctgaatatctatgcccaaaatgcaaggtcacccacattcataaaagaaactaaagctcaaaacacacattgaaccccacacaataataatgggaggctttaacaccccactctcacctatggacaggtcattgaaacaaaaaataaacagagacactaaacagaaactaatagaagctataaaccaaatggatttaacagatatagagagagaacatttcaccctaaaacaaaagaatataccttctcaaacttcatggtaccttttacaaaattgaccatataattaatcacaaaacaggcctcaacagatacaagaagattgaaataatcccatgcatcctatcaaattaccacagactaaggctagatttcaacaacaaaaacaacagaaaccccagatacccatgaaaactgaacagctctctactcaatgataatttagtcagggaaaaaaataaagaaaaaagactttttagatttcaacaaaaatgaaggcacaacatatccaaatttatgagacaaaatgaaaacaggactaagaggaaaatccatagtacttcatgccttcataaggaaattggagagatcttacactaacaacttaacagcatacctaaaagccctacaagaaaaagaagcaaatgcacccatgaggagtagactataggaaataatcaaactcaacatggaaaccaaccaaatggaaacaaagagaactatacaaggaatcaacaaaagaaaaagctggttctttgagaaaatcagcaagatagataaaccctagccaaactaactaaaggacacagagacagttttcaaattaacaaatcagaaatgaatagggagacataacagaaacagaaaattcaaaaaaatcatcagatcctactacaataagcctatactcaacaaaactggaaaatcaagatgaaatggatgattttctagacagacatcatgcatcaaagttaaatcaagagcaggtaaataatcttaacaggccatatctccaaaggaaattgaggaagtcactaaaaagctcagggccagatggacctagtacagaattctaccagccttcaaagaagagctaaactaatactcctcaaactattccataaaatggaaacagaaggaacactacctaattcattctttgataccacaattactctgatacctaaaccacacagagatccaacaaagaaagagaacttcagaccaatttcacttatgaatattgatacaaaatgctcaataaaattctagcaaaccaaattcaagaatacatcaaaatgatcattcattatgatcaagtaggcttcaatccagggatgcaaggtgattcaacatacaaaaatccattaatgtaatgtaatccactatatgaacaaactcaaagaaaaaaaattacatgagcatctcattagatgctgaaaaagctttgtcaaaatacaacagtccttcatgttaaaactgttggagaaatcaggaattcaaggcccatagctaaacataataaaagcaacatacagcaaaccaacagccaatatcaaattaaatgaagagatacttgaaacaatcccactaaaaatcagggacaagacaaggatgcccactctcctcatatctattcaatatagtactcgaagttctagccagagcattagggcaacaaaagaagattaaaggggtacaaattggcaaagaagtagtcaaggtatttgcagatgatatgatagtgaccccaaaattctaccagagaacgtctatagctgataaacagcttcagcaaagtatctggatataaatttaactcaaatcagtagccttcctttatacaaatgataaatgggctaagaaagaaattaaggaactgatacccttcaaaatagtcacaaataatataaaataccttagggatactctaaccaaacaagtgaaagatctgtatgacaagaacttcaagtctctgaagaaataaataaaagaagacctcagaaaatggaaaggtctcccatgcttatggattggcaggattaacatagtaaaaatgaccatcttaccaaaagcaatctacagatgcaatgcaatccccatcagaattccaacacaattcttcaaagacacagaaagagcaattctcaaattcgtttggaataacaaaaaacccaggatagcgaaaacaagtcttaacaataaaagaacttctggggaaatcaccatctgacctcaagctgtactacagagcaatagtgataaaaactgcatggtattggtacagtggcaggcaggtagatcaatggaatagaattgaagactgtgatggtttgtatattcttggaccagggagtggcaccatccggaggtgtggccttgttggattaggtgtgacctggttggaataggtgtgtcactgtgggtgtgggcttaagactctcaccccagttgcctggaaagtcaatcttccactagtagcctttggatgaagacgtagaactctcagctctgcttgtgccatgcctgcctggatactgccatgctcccaccttaataatggactgaacctctgaacctgtaagccagccccaagtaaatgttgttttttataagactgccttggtcatggtgtctgttaacagaagtaaaatcctaactaagagaaagatccagaaataaaaccacaaactatgaacattcgatctttgacaaataagccaaaaatatacaatggacaaaagaaagcatcttcaatagatggtgctggtctcacttgcagtcagtatgtagaaaaatggaaatagatccatacttgtcacctgtacaaagctcaagcaatccaagtggatcaaggaccttgacataaaaccaaatacactgaatctaatagaagacaaagtgggaaagagcctcaaactcctgggcgggggaggggggtgtcgaagatttcctaactagaactccaatggctcaggctctaagatcaagaattgataaatgggacctcatgaaactgaaaagctcctataagacaaaggacatagtcaataggacaaatcagcaacctacagattgggaaaaaaaatcttcactaaccccacatccgatagtgagctaatattcaaaagatataaagaactcaagaagctaacctccagaaaacaaacaacccaatcaaaaaatgaagtatagaactaaaccaagaatttacaacagagaaacattgaatggctgagaaacacttaaagaaatgttcaaagtgatcagggaaatgcaaatctaaacaaccctgagataccaccttacaccaatcagaatggctaagatcaaaactcaggtgacagcacatgttaggggagaattcagagaaagaggaacattgctggttggattgcaaactggtacaatcactctggaaatcaatctgggggttcttcagaaaactggaattagatctacctaaagacctagctataccactcctgagcatatactcaaaagatatcccaccatgccacaagggtacatgctccactatgctcatagcagccttatttgtgatatccagaagctggaaacaacccagatgtcccacaacaaaagaatggatacagaaaatgtggttcatttacacaacgaggacatcatgagttttgcaggcaaatgaatggaactagaaaatatcatcctgagtgaggtatctcagacccaaaaagaacatgtatgtatggaatgtactcactaataagtagatattagccccaaaaaagcacagaatatccaggatacaatccacagaactcaaaaaggttatcaatccaatagggcccaagtgaggatgctttaactcgaaggcagagggagggagggaactgagtgagagaggggaggggcaggggaaaagggggacttgatcaggtattgggggtggggaccaggagtgaaacccgagggccaacagaaagaatggaaatatacaacctcgggaggtgggagaaccctctaaaatgtagcagagacctggaagtgagagaacctcaaaactcaaagggaaagaccttagatgaaatgcccaacggtggtgagaaggaacttgtagaatctacctccagtagaaagacagagtatcaagtagaaggatggggttgctatcccacagtcaaaaactctgacccagaattgttccagtctaaaagaactgtggggacaaaaatggcaaagatactgatggaaaggaggtccagtgactggtccaaattgagacccatctcaaggtgaggctccaaggcctgacactattactgatgtcatgatgtacttacagtcgggaacctagcatggctgccctccaagatgcccaacaagcagctgactgagacagaagagataattatacccagccaatggacagaagctggggagccctgtgattgaattaggggaaatctggaagaagctgaggaggagggcgaccctgtaggaggatcagcagtctcaacaaacctggaccccctaagatctctcagacactgacctaccaaccagacaatatacaacagaggactgcctatctggactcagtcagagaagatgcaattaatcgttgagagacttgaggccccagggaatggggaggcctagcagggtggagggtggggtggggatatcctcttggagagggggggtttggggggaaggaatgggatgaggaactgtcagagagcagaacaggaggaggataacaactggactgtaaagaaagattaaagataataaaaacaaaaacacaggtctggtgagatgtctcagcgggcactggctgtggtcttcaagaagtcctgagtttaattcccatcaaccacatggtggctcatgattatctataatggtatccaatgctcttttctgccatgcaggtgtacatgcaaatagaacactcattacatcaataaataattttttaaaaaacacacaaattcacacattccactgagaaggtaaataaagcgttgtatattgacctagtagggtatatttcagcagttaaaacagagggactgtataccacacagcaaccatgcatgaaaaacaggctgagcatggccctcagtggttcagcacttaccttacctagaaggccctaacttctaggcccaatacgagaaaaagaaaaaaaaaaaagaagaagaagcgagtcactaagcataaggttaaatggatgaaagatgcagaaaatgacagattatgatacaattctttataggcctctgaaccacacacacacacacacacacacaaacccaatgtatcatttgcatgtgtgacccaatgttgactgggaagctatgaaaatgtaggggcttgaaatttggttcagctggtagaatgattgcctacctaccatgtgtgaggcctgtggtgtcctgtgaatgaaaatgacccctacaagctcatagggagtggcattacctaggagttaggaggtgtggcttgtccgatgaagtgtgatctgagggtgggctttgaggtttcagattcttaagccaggcctagtctctctctgtctctctctgtctctctctccccacataccccactggggtacactgtgtctctgttaatagaattgttaattctataccgtcagagcctcgtattttataaatagttgtttcttcttcacttgcctaaggcaatctagaattgtatctgattggctttaacaaagagctgacagccagtagctggacaggaagtggagaacaggacttctgggaggagagagggactctggtagaactgagaagcaggaattcagtcaacatacatggaggtgaatggagggacgagagcagagaagccaaactggccatgcagtgggacatagtgccaggattagtcaggttagagtagctgggagactgcccagcaaaagacctaagctttaaaatattaagaaagcctctgtgtccttatttttatcactggcaggcctgaaaaagtcccactctatagctctctgcccactgcctgcagatccagataaagaactctcagctacctccccagcactgtgtctacctgcctgccatcatgcttcccaccacgacagcaatgagctaaacctctcaaagccaagcccagctaaatgctttcttttataagagttgcagtggtcatggtgtctgttcaccgcagcagagctttgactaagacaaggctgtaggtttgatacctagcactgtacactgcataataccaaacttggggttatacctgtgatcccagcacaggggaggtagaggcaggaggatcaatctcagctacatagtgagtgcctgccaacttaggagttgaaagacttcatgtcaagcaggcagagggtgtggggggagggggatttagaataatggctaatgcatatataactagattaaatttttattatatttattttgtggggttaggatgtcagagaatgactttgattctctccttcctccatgaaggtgccagggattgaacttggatcaccaggcttggaggcaagcacctttgacatactaagccactgccgtccataagaacattacacaaagacctggaatcttcaaagccaagctgtgtatgatacacagaagtgggaaagaggcaaatcatttatttgttactaggtactttttcttgtgggaagaaagttttttgttaattcactcaacatttattgagagatgcaagccatcaaagaaatggcccctccagaaactagacactacagaccaagggtgaacgcctagcctggatcaccgcagctcaggaagaggctgcagaaacagaaagtgccctagatccttgaagactttacaattgtttaaaatcacttaaactctctggtaaaagatatagatactgactaattattacataatttatttttattcataactctgtatactgttaattcttaaagtaatttcattcttcctaatccattattaaaatatttttttcatgcccattagccttctgtttcagcatctaatttctctcctcctcctatgatgctccaggactgcccttcatgttagcagccccatctgtctaatatttacattctgttccctcagtcttgccaggttctgctctggaacattgatgtcatctgcttctctcgggcctcagaccccgggatctagtttcagtcagagcaacctctaggcagacacagcccacaaaacaaggttattcatacacctgccaggcccagcatccagtctgcaggtatgcatgctggtacctggctctcctctgctcgcccacagtagtaacaaaacctccctttagaattcgagataagagctttggagtggtccttgttccatctccccgcctcccaaactttagcagtaatacaccaaaccttggcagctgggctggaggaggaaggcaggggacagggaaggaaccagaacatggagatttgctttgctgctaggcagtagttatctctctggacaatattaagcttgaaggaacagctgaatgttttccccagtgacttcccaaatcatctgtgtcccaggtccatttcttatcttctccttcaagggaaatagagagaacaaagcgttagtcagtctagaaatgaatctaataattgaataagatgaagagcggaggctggagtcagacagtcatggtttaattgaggccttgtgagctgggtggtgagagtacacacttatatggctgaaaatatcaagtgagttaagcatgggaaccttgaaaggagtgcctgcaaacaggaaatagtcttacagcagcctcaccctatccaagggggatacgtcccaaggctccagcagaagcctgaacactcgggtacccttaaccctgcatggtggacgaaggtaatctacccagtccgtgttgttagcacttacagccccttcgtaccaccacgactcttgtactttggagccattattaagcaaagcaagagttacttggacacaagaaccgtgaaacctgttagcggagatggctgtctaacaacagaaagaggcatatactatgtggatacactacatggaggaatggtaaatgtcccaagtgagatggagacaggccacgccagagttcactgtgccactcaaagtagtgtatgatttaaaacttatgaaccgtctactttccagaattttccatttggtatcttcagactgtagctggcatcatgagactaagggaagccatacctcagttaagaggagactactgtaggcgcagggcccagatgctgttttacaaagcttccattccagccccactgcaggacaaacaaaactcaagacaacaaacatttagtaggcccctgtagtctctactttttacaaggtggtgaaatttaatttgcatatcattatctatgcaagttaacatttgatacatagatctttcaacagaatatgaaatgaatgaaagaaatgtaattttctttcagaggctcattcagcatggtgaacatttgtaatgctggtctcgaacttgcagccaggcaaatcaaagtcaaccttgagatcctgatactactgcctccactatgggtttaagtggtactggaaaccgaaccctggggagccctgggctttgtgcatgcgaggcacacatctaccacctgagctctgtcccccagtttgctacttctctttaaccccagagaaaagactttggagcaaagagaagggacacagaagagcagtaccctcagccatacctggtcttggatttgtacatgatgactgagaacagtgaacatagaaagagggggaggggaaggttaacataaggctagggagcttgcgaatgacacatgtgtggctgcgaaaggtacagacagaacagatcttgtcatctgtggagacccagctcacacaaggagaggaagggacagagaggccccctctgggagcatgggcacagacatttccaactactccctcaccagcattttgggaagacaaataactggctagaatgtcattgtggtggccttctggaactgcagtggcagcagcccagtctccaggggcagtgtggccagtgtcagaaatagcaagctggcgagaccggtccaatcgggtgactcagcctccctggtacaaatccaagagtttccctccctgcagtcatctgactgcttttgtttgtacctagcctaaaagtgtgcaacagcacacacaatacaccaccacacagaacactgcagaaactacccaacaaaattcaatgcatggtagtgcacatctctgatccctgccagcacttgggaagcagaggcaggtagatctctgagatccaggccagcctggtctatagagtgaattccagaccagtcaagggtttacacagtgactgtctcaaaaccaacaaaatcctcaatacagcacaccacaacacaggacaatcgacatagcgcaatacaatatgacatgaccagtctatatctgagatgttcccaaggaccatgtactttggacttgaaggcttgggccccagcatgtgtggtccaagggttgaaaggagtggaactcaggtagctgaagccacaacatcactggggcccgggagtccaacaccagcctgggaaacagcatggccttgtgtcctagttaggattgccattgctgtaaagagatagcatgactaaaaggaactcggggaggaaggggtttatttggcttatacttccacagtagttctcagagggaagtcaggataggaactcaaacaaggcaggactggaggcaggagttgatgccggggtcatggagagattctgcttactggcttgcttccccttgtttgcttggcctgctttcttatagaacccaggatcaccagcccaggggtggccccaaccacaatgggctgggctctcccacatcaatcattatgaaaatgccctacaggcttgcctatagcctgatcttatagaggcatttttctcagctgaggttccttcctctcaaatgattcaagcctgtgtcaagttgacctaaacgcacagcctgcatcaagaaaagaagaggtgtgtttggctagaggaagccgagtcaccacactagacttgtacctttgaatgggatattagaatcccactctcctcccatccccctccccacatgaggtaatccgttccctgtgtcacatgtacccatcgtagggtactattcatggatcaaggaatgttttgttatttgttttgatttctgaaactttgaagaaaatttgtaaaaatatttttaaatagatttttgttaaaaggggtcatatagaactccagctgtgggaactaaaaaaggggggccctggggaaggaggggaagagacccacaccccaccagagtttccctactctctggtcattcaggcatgggagagctgctaccaaccctttccactcatccctgggtgggcattcctctatcccactcttcagggagtcgccaaggggcagccctatctggggaacctgaagctaccttgctaaagccccggggttataggagagagggatgagggaagaggttcccaacactgaccagagtgtgcagcggatcttgatggagcagagactctatggtttaagagctttattatagaaaggcagggggaaagagagaagggggagaggggaaggctagagagaaagagagtaagagaaacaagagaagaagacagagaggggagagagggtgagagagagagaagggtaagagggagacaagagagtaagcagtaagagagtgaggtgaggctgaacacccctttttatggtctttactgttgctaggtaactgggaaggagtttagcctgaaggtcagaagcttgggccattgcctacatgactactgacaatgcttctcttgtggggactgtgggaggcggtaacttaggcaggagcataagggaacgcctaccatgtcatggaggtgaattatgaccatcggggttcagacctcagctcaactggagaccagcctgcaattccccacacccagctaatattttaattatgaaattcagtagttaggaagtcgctttgtccaataaacatatctgtatattcagtctcattattcagtcactgtgaccagtaagcagccagggtctctgcccacagcaggagaccttctgtaaatcagtctaagtcctgcccattgacctgtaactccagctccagggggacctaatacctttggcctctgcaagcatctacacttcagtgtatacagagagggggagggagaaagagagcgagagaaagagagagagagagggagagggagggagggaaagaaagaaggagggagtaagggaaagaggagagggagagttttaaactaataaactttttaaaattataaattaataacatttttaaaggaaatgaaacttacttctcacagttgcagaggccagaagtccaagttcaaacctgcaggaatacttgaatggtgagaaatatttgctggttcacagatggaaccttccggctgtgccctggctctctggctcctcttgttattttattttaggcccagtagcaattttattagagaggaaaccaacttaagcgagcccctgggacctaatccaggctctctccctctccttgaaagagacctatatgaaaagggctctgtagcttaagtacagaagctttgcctttgaagctttaactgtgagcagctgtggggccagggagcctgatgagaggaacagagaagcctgtgcagaggtgcacggggtgaggaagaggtgtccagagaaagaatggccagagtgccagaagacttgctcaggatctgggctggtctatcccctccccaacacacacacacacacacacacacacacacacacacacacacacacacacacagagagagagagagagagagagagagagagagagagagagagagagagagagagagagagagagagagactgagaaactgagagactgagagacacagagagaaggggagatggagagggtgagagaaaggaggagagagagagacagagagaaagaggggaggggccagaaggaaaagaaacatgacaccttttacaattagaacaggtaggcttagcaatgaggctctataagcaactgcctgggttctcctttataaaaagtcatcctagccaggcataagtgtggctcatgtctttaatcccagcacttgggaggcagaggcaggcggatttctgagttcaaggccagcctggtctacagggtgagttccaggacagccagagctacacagaaaaaccctgtctcgagaaaaaaaaaaaaaaaaaaaaaaaaaaagaattgcctagatcactttggtctgtgggcaagtctgtaggggattgtcttgaccttcagttgaagtcggaaggtccagttcattgtgggcagcaccatccctaggcatgttggtccaggactatataagaaaactagctaatcatgaactaagaggcagcattctgccatcgtgtctgattcagttcctgctgcgtccttgccctgacttccctcagtgatggactgttgacctggcggtgtgagccaaataagtgctttctctcctaggttgctctgctcagcattactttattacagcaacaggtggaaagtagagtcagtaaagggaggtgagcaagcagggactgtgtagggttgatgacttttgaagggtcgctatggaatgtggagacattgttcatcacctccttagaggacagtctcagagaacaagaccaacattgaagacgtatgtcccatcagactgacaggcaaatcttgtcctctgactcctctttctatctccttcttgagaggagcctggcgtgctcaatggttctgtttgattcctggaaacactgaggcacagcccagcagcatgaagaggcccgataggtttccgtgtctcaccgagccactacatcgcagcaagcgctttagggaatattttcacattctccatttgcctaacagggaaccattctaagagttgagttttgaccaaaagcacacaccaataaatcagtgtggtaaggaatgaccttcgtagctgagctcctgagacgtttatgcagccgcttgggacaaggcttccattctctgcctcgggcagggaaagaacagagtttccaagtctgaatcagcccagtattaggagtgtttgggttttgaatgtgttaccaactaaatttaattcatactgaacccaagatccacatgtggaatcattatgcttctaaacacatacaaaaaaaaaaaattcttatgcatgactatttcagtcttttcctccagaaatgtctctccattccttcagaacagagagggcatagttttgggtgactgaataaaaattaccctagagggtaaaattgaaattatatgcacaaccgactcactacagaaaatgtttccttcagagctggagagatggctcagcaagtaggagtgcttgcttttcttgtagaagacctgggtcattcataaagagtgagacatggattaggtaccaggagaaaggcatggaggctggaaactgtttctttcatcacaagtaggggtgctgttctcatttggcttttaaaagaagggtctcaagcaacccaggctgacttcaaactcactatgtaataaccaaggctggttttgaactcctgatcttcttctgtccatctcagaagtgctggagttatagatatgaggctgttagtgttaaccatcaccttggtgtctggcatttgagctccgagtaactcagttggtaactctggggagccttaggaggtgtggccttgctagaggaggtatatcactgagggtgggctttgagagtttaaagactgccatttccagtgtgttctctctgcattccttcaaggtgtccaccctcagctttcagcttctaggtccagtaaccacgcctgcttgctgccacatttttctgccaggatgatgatggagttttatccctctagtaccatagacccaaacaagcccttccttctagatgttgcctttatcatggtgtttcatcccagcaatcgaaaagtaactaagacaggtatatgccgtatgcctggcctcaacaggtactgtctgcctgttcttctcctcatccccagaatttcttagaaatggctctgagtgacttgggcaaattgcctaaaagccccttttctctttatggctgcaaatttatgtattatcatttcagtttttaatttattttcagttgttttgttttgttttgttgtttttttttttttctgttttgagacaggatcttgctaggaagcccaagctgactgttaatgtataatgttcctccaaatctagactagccttaactcatggcgctcctccaactccatcctccccagtgctgggattaggaacctcactatgacatttgacacttggccacaagagaacagagctagtccagagtgccgggggtccagggcagagggactgttttggttgtaagaaaggtggtcatttctccaggcgatcgaagcgaggtgacgttccaggtctactgagactcattactgatggcagcacacagtccgatagcttgtccccgccctcagcatccctcacttctgctcctgcaggtgtcgtgggtgcacgggctggctttcttggacctctgcctcatctttcttctcttgtgcttcagcctgcgcattctcttcttccgccacttcgctctcatggcgcaggagtctcaaggaagatggcactaagaccaagccactttggccttttttaaaaacaggatcttacactctaattagcatagcccaggattgcccgaaagttactatgtagcctagactagaacttacagcaatccttctacctcatttgcctgagtgctgaagttgtgggcatgagctgccacacctgataggagtttttaaatttttagtacatttattttgtgtgtacgtgcacacacacacttactcactcacatgtgtatatatgtgggggagggcacacacatcgcatctttcaggatttgattttctccttctaccatgcaggtcctgggtttcaaactcaggttatcgggttgggcagcaatcacttctatctgcagatccatatttctgaccctagttttaatctattgttcactttgagaatagatttaagggaagagagagaaattcagctttaaaaatacagaattctgggctggagagatggctcagtggttaaaagcatttccagagggcctgagttcaattcccagcaatcacatggtggctcacaaccatctataatgggatctgatgccctcttctggtatgtctgaagacagtgacagtgtactcatatacacaaaatttaaaaaaataaaagcaaaagaaaaaagagaaaataaaagctgattttaaaaaaaaaaaaaacataattctatcaagtaatggtggtgcatgcctttaatccatgtgcttggagggcagaggcaggaggatctctgagttcaaggccagcttggtctacagagtgagttccaggaaacaacaagacaacaacaacaacaacgacgaatagaacgtcaaaccctgcctctctacaaagcatcacttgttgagaaattggggaatcttcaaacacaatagtccattcagtcttctcacctcatctgcaggaaggaaatatattcaggcttctggtcagctcagagtgtttcccttgaggtctctgtggcttgacaatgtccacaaagccctatgttcctcatggtttggccatgagtgtgtgactccattgggagatactgggacttttggtcctcacctttagtgggtgggacttaggggaaggatgttagagcattggaagcgtgccctggaaggggatattgggatggtgttgaacaacccttctctacctcatgctcctgccatgaagtcttatgccactccggactcaaagtgatagggagaggtgactgtggactgaaatcctgaagtatgagaccacataaatcctgctcataagctggctcatctcaggtgtttgtcatagtgacagaaagctgggtaacaaaatctcttttgggatgtgataaggctgaccctctgccaatggcacagagacctgctacatggcatccaggagatagtggaatcagaggggagccaggctgtgtggtatattccactcttccctagtacagaaactccgcttccaactgaaaacaagatcgttgtaaatgtcactgctctacaccccatctggactcccaaacacaagctgcctcgcttctgaatcagatgccatcacccactgaaaagtgtcctgcatccaatttggctagcatcggggtctcagctcagtgagagactcacagctctccttcagcaaagcagccctacgtgactgtcattattgctcctgagaaagacacagggtggagcgggcagcagggaagactcatttctccagagatcttccagccccgaggagcacaaacaatggagacaaatactaatggctcatttatggatttaaacatttgtctgcatgaagaactccagcaagcactgccatctctatgagactccctgagggaatgtcaggaaattggcaccccagtgtatccgtctataaactaagacagtgttcagtcaaaaatccaaaacatgtggtctgggaatggcaactcgagcaggaaccagcttgcctgagccagtcctgagtggagaggcccttcagaggtcggttttggggaaaagcattcagatcccttaaagatgtgttggtatcctattagctctcaccaggagcccccttctcagaatgatgagacacaaaaagcttggtgtctgtggcaaaacacttgccatgcaagagtgagaagcagggttccccggtacccacacaaatgctgagtgtgtatggtagcctgtctctaagccctgtgttaagaaggtagaaacaatgatccccaaagcaagctaatacgttagactatccatcccagttggtgactctggattccactgagagagcctgtctcgatgaataaggtggaaagtgatggatgaagactccttgtccagccatgagcacaatgtgcacactcacatactcacatagatgcacacacacacacacacacacacacacaccacatatgcagacacacacattcacacgtatgtaagctgcaacatgagtacatgtgtacatgtgcacacaaacacacagagcctcaggaaaaagaggcatcaggtgcagagatgtgtatgaagctgcaggcaagaacttcctagctataaataacccatcactatggggaacaggtcttcaagagcacagttgtcctcagaaactcctgaattaagttccatttgtgaaattgtatatgcagtaaaaagatttccaagcatagacttccactccatgtgttattccctaaggaaagccatgtgaaactcttccaagagggaacaaatgtttgtttccagaatttcaaatgatgtcccaatatgtggctgccttgattgtaacaattgccgatgtctcagcggaggtgttagaccacaaaaagctttcatgctacaagccaaaagacctttggggatctacattcaacatttataaacacaaggcaatatttgtataagcactttgtgttctagttaaaggatgaggagagatggatatttattgaactttgacaatgagctgggtgctttgcctacctcatcagactagacaataacctgagctacaggttgtcactacttccactgagtggaggaaaccaggctccccaaagccacttgcctgatgtcacataggagcacacagcagtcattacacagtctccccaggttctccaggtcacatttgggatacttcctgctagagcagtctttatagttcactgttgatcactaccagacagctacgagaagaatgagtctttgataacgatagaaaagacagagcccatcatatcacatatataggtaacaatacaaagtcatcagtgcatgacccccatgcatgtagaatgcttccctctgtatcatagttaggagatttaaatgtgcttaaattgcattccaagcacaagctaaaagcctccagcattccactgtttctgtccacaatttcccctgctgtcctcagaccacagtctcaatggatacagtgttgccgttgccctcctggcgcctgggttgcatttcatctttgaaagccctggtcaggacgacttttaaggactccctgaagcgcttcttcttactgctgcccacaaaaaagtagatgaaagggttggcgctgctgttgatggtggagaaaagcaaggagatgttatgcaggttcccaaaggctgaccagtactcgtagtacagcaagtagaggacccgcatgggcatggcaaagatgaggaatatgataatggtgaccatgatgacaatgtacagcttcgaagaatgggaggcccacgtgttcttccgtatcttcaccaccaagatggtgctggacactaacatgagcggagtgaagaccaagaagctgaggatggctatgaagatgatgaccgcccggcagtcactccgagaatgactctcttctccgctgtcaatacacatgacatactccatggtggtcaccaagcacgaaagtgcccacagaagggcacagacgaatgctgactggtgcttggggcggtggcatctgtaccatatggggtagaggaccgataggcacctctccacactgatggctgtcagcagatagaggcccgtgttgtagccaaatagaaaagtcaccgataatgtcacgattgtgtagtgatggccagaagagagttcatagtctaaagcatagtcaatggacaggataaaaatacagaacagaagagagatatcagcaatggacaagtgggtaatgtagaccgtgaagggatttctcctcatccggaagcagaggaaccagaggaggatcccattctccacaaagcccagaggggagatgctcatgatgacccagtgcactatgggaatgggtgggtgtgagctccccagggaggcatttctgctggaggtattcatggctttctcttcagcaagggatgtcatatttgactggtccatgaggagttcttgccctgggtcacttcaggtcattttctgtagataaatcaaacaaacaagatgtatgaaagtttcaagaattgaaatgaaagagacagctgaggggtgagggtggctcagttaggaaagtgtgatctttgcaagcacaagaaaatgagttggatcccctaaacccacattttaaaagcaaacaaataaacaacaataacaacaacaacaaaaaccacctaggtgtggggcctggagtgatgattcagtgattaagagcactcgcttctcttgcagaggacctgggttcagttcccagaacccatgtagaggctcataatctgtaattccagttctggtacatacagcgtcctcttctggcttctgtgggtactgtatacatgtggtctatacacacacatgcagataaaaaattatacacataaaaacatgtatttttaagagctaggtgtgatgacacacatttgtaatctcagcactgggaagagatagagaaatcctttgagctttctggccagtcagcctagactacgtggaaagttccaggccagtaattgatcctattttttaaaaaaagtgcaaagcagccgaggaacagctctcaagaccaacttcaggcctccataaataaatatacccatctacatacatatgtacctgcatgcctatgaatgcacacagagagaaataataaaataaaataaaataaaataaaataaaataaaataaaataaaaaagagagagctacaaatcataaccttgacattgtgggtagaaagtttagatcctggagagatggctcagtggcaagagacatcctgctcttacagaggacccaggttctacacccagcacccacatgggtgctcctaaacagcctgtaactccaatctcaagggatccaacaccctattctgaccttcaaggacacctggcatatggtgcacaaacatacatacaggcaaaaatgggaacaaatcactcacacatacaaaatagaattaataaataggggctagagagatggctcagtggctaaaaatgtattgctcttacagaagacccaggttcaattcccagcacttacccagtggtttacaagcatcccaatgggggaatctggtgccatcttctgacctctgcagatataggcatgcaggcggtgcacatacatgcatgcatgcatacatacatacatacatacatgcaggcaaaacagtcatccaaataatattaaataattttttaaagaagcaaaaataaaccggagaaatttattctgatgctctattttatttaacctgatgagttcaaaatagcatttaatcatttatccaatatgaaattaaaattgaaaaaaaaggatgtgtcttccacatgtagcatctacgctagcagctgtgccatatctcctgtgctcaacaggaccaggtgaccaatggccaccctgtaggaaatgatacacgtttaacatcgagccacacttcctgtgtggagcgggtgactggtggctaccctgtagtacacctcaggcttcaaacgctcacaaaacgaaatgtctcatacaaagatgggtagtctaacttcttaggagcagactcaaaccaaatactggaaatgtgtaaaaccagacctaagctgtgttcttaggaaaggtgacaggggcatcctgctgtctcagacaaggctcaagtttcaagtccctccagcctcaaaggcaatcagctcttggtttcttgccaagagggctctcctatttgattgtaatcatggggtgcaaggggtccccaccactgtgcctgcctgcctcccctctccttactccagagccctaaattcacagcctgttcctccttactctgaaaatgtgtgtcccacactttcattttatgttccaggtcccacccaccccaccaccccaacccccccgttcaacttttctccctttctcaaaaaagcttctaactaaattcacagaaagagttgagaaagcggtttgaacactttgggcccaattgcgtgtcttttttaaaaaactcaaacccaccttatttaattctatagttagagatttctctttgtggtgatggaacaggctttctccattctttcaagattgaattttaagtcattgtacagagtgttaaaaataagaaccacggcgtagttttgccggggagaaagaacagaatctaattcagttctgtgagtggaatgaaggagagcttgccaaaaccaggcaagcacacagcaaagtatagctttacatggttttaagggaggccttatatcactggggtttgaaaggtcagcaggagttcatttgctgaataagggggtgtcttagtcagggtttctattcctgcacaaacatcatgaccaagaagcaagttggggagaaaagggtttattcggcttacacttccatactgctgttcatcactaaggaagtcaggactgaaactcaagcacgtcagaaagcaggagctgatgcagaagccatgaagggatgttctttactggcttgcttcccctggcttactcagcctgctctcttatagaacccaagactgccagcccagagatggcaccacaaggggcctttcccccttgatcactaattgagaaaatgccttacagttggatctcatggaggcatttccccaactgaagctcctttctctgtgataactccagctgtgttaagttgacacaaaactagccagtacaaggtggggggaggcattttaagaaaaaagaacactgtggacaggagcattaaaaccaggaggtacagaatgtccctactagctggacatagtttatgtctgtaatccttacagtcaggaagctgaagcaggaagatcattacaaagccaagaccagcctggtctacacagtgagctccaagctagccaggactatgtagtaagatcctgtctcaatcccagtactacaaaatgaatggttttggccagctgggcatggtggtacacacacatttaatcccagtgtttgggaggcagaggcagatggacctctgctttcccccagagaaacagcactcccttctgcccagggcatcctagggaatgaatactgttttctgagttagggtaaaattcacaaactgcacagtcaggctaattttgatcgtggggttagaatgcaaatagttaaattacaaaaactaagtatcactaaaaacaacgaatataatccttccgtcgtgttgttagagtgaaattttacttaaatgaacacattgctttaaaaaaaaaatcacttcccaaatgttaatcaagaggaatttccagctatccagtagcagtttgggagtcctgggaaccagctggccctctgtacccatctctccagtccctatcctcctcaggctcctagctgtcttgcacatctgctgtgagcagctggggtatttgaccatgcacagcacgatgtgagcagagccaaagtggcggctcagaatttactctagccacacattcccaacagcccacaaacaccatcattgagctcccagacgagaggcctcacctccctggagggatgactgactggtctggggccacttcctgtctccaggtagacccagctctgggacagcaggctctttgtccagacaagcaaatcatctcgttatagagtaactggagtcgcagactgcatgtttacctggctggcaggtcttggtggggaacacagcggtgggaacctcaattggggacagagggctagaggcttggggcagtctcggtggcatcggtggcatcgttagtcagttagtcagtggctctggcaggatcacagagtttcgctccctcctccctgttcctcatggaagcgcctcctagggagaatgaagtttcctggagcatcagagtgcagacattaaggctttaacatccgaagaccccttctttgctgcctaactatggacactctcaccaatgtgagaggctgggagggaagccatcgtagccctcgtctaacagggaggaaacggaaggagttatgctagagcctctctgcaaggcacaacctcacaggggctccaccacccatgactgcttcacagcagctgccgggccctgggcagcagcatagtggagcctgaaaatgctcacagatcctaatcagggagttggccaagtctcctgactgccagccaacagctgagcttgtgtcccactcaacagagagcaaagtactagtttagcagagcctctcacttcacagacaaatggaagctggagagattggacagtggaccaacactcaccactaacacagggtccagcgagccagaaaccccgacctaagccctgctgcctcaccccgctgcaggtctcaccccttgcagaagtcttcttgtgcttacattttgtcttctactctagccctcctatttgacgacttgaaggcaccatgttccctgatggatgggactcattgccttctaagacctaagattgatttcaaattgtgatcttgtctgggtgggtccaggattcctgtgccctgtctacattgaaagtctgtcttgatgttcatattagtaatcacagaggaagattactacaagctggaagacagtatgacctatgtagagagttctaggaacgtcatcaagaaacggagtggcccttggggacagattcttccattcctacctgggtaaaagccccccccctccaagccatcctaatgggctcctctgtaagctacttagctatgatacaaaatgggaggattttaatttatatcaccttttattcctatcataaaacaatatgttctcatagcagaatatttggaaatttcacacataagacaagtactcaaaactaaccttattaaacactcagaatagtcccttagatttttttccaatggctcaaacacatttttgtttgtttgtttgtttgttttaaattgggatcagtctaggataagggttgttatcatacattttctcatttgataacatattatatttcttcctatcggggtagtctctaaaatgtatttattttctgctaatcctccaaccttgaacataccaactgcttctaatttttcatcattatttgaaatatatatatatatatatatatatatatatataaatttacaatcacatccaggtacttacaatcagattcataaaatgtgggtgagtgtacacaaacacatgcatctttaccaacctctccatatttataacttcctcctacgacagtaaggtacctggctcccatcattcaccattcacatgtgtgcaaacaacctgctaagaagccctcctctatgactgagcagcccacactgccactgtgccctgctttggaacaattttctcatttagcaggggttccttgtcccctttacctcccacacagacagacgccctcctgccttgtctgctgcggacatcctctgctagggccccattcctccatgcccccacccctctgctgggctgccttccctgctcaggcagacaccactcaccttgagaagtagctgaaagacgatgcttagtaaaacacacccatctgtaggaattaaaacaacagtaggcagtttgtacattcacacctgagtgtaaaaggtttggtttttgttttcttcaaaattagtagaggttctattatgtccttaaactgtcacaaattgttctgagaatctgggatttttttcctttttctggcattgggtagctctctgatattatgcatcccctactgaactgtttctttttctgggacacagacacccctgcataaattctctgagttctttgggttttgtttgtttgtttgtttgtttgttttttaaagatttatttatttatttatttatttatttattatatgtaagtactctgtagctgtcttcagacacaccagaagagggcgtcagatctcgttacggatggttgtgagccaccatgtggttgctgggatttgaactccggacctttggaagagcagtcgggtgctcttacccactgagccatctcaccagccccctgtttgtttgttttttaagattctacttttggggggctggagagatggctcagaggttaacaacactggttgctcttccagatgtcctgagttcaaatcccagcaaccacatggtggctcacaaccatccgtaacaagatctgactccctcttctggaatgtctgaagacagctacagtgtacttacatataaccaataaataaatctttaaaaaaaaaaaaaaagattttacttttcagcccctacaactaaggctcagaaacatcaaagaagaggggacgggaagactgtgagacccagaggctcaggacatctgtgccaagataacatcttctatataggccagagaggctgcatcggtgaagtctcaaaaatatagctgcctaataagacctgaaaaatgacaataccagttgtcatgccaagaaagatgggggaaggattgcaagactttacccctagatgagaagctttagattattaatggctgctgagaacgagaaactctaccttctccaggaatgagtcctttgatcattatccaatcccaaggggatagccttaaacacacgagtgtatgatgatgctaaagaggctcgcaaggttgtatttataaatgtatatgtatatgtgagtatatatatagcaataatacttaaagaataagaggcccatgactgtgagagggagtggaaggacaagaaagggggtatggtgtgtttctgtgtgcgtgtgcgcatgtgatgctcagctgagtgtagtgcccacacaggccagaagaggccatcagaccccctggagctggagttacaggtggctgtgagctgcccagtgtgggctaggaactgaaaggggagtcctctgcaagaacatgctgagccatctctccatctctccagcctcagacctgtctttacctgttgtcgcaaaggcgtcttgtgacagaacccaggcatgacacccctaattgccttctatgtattgccaaagacaaagtaaaagacagccagcatcttattatctctatgccatttgtcaagtcagaacctcttccttttccttcccaaggagactggaatctacttgggaatctacttggatgcggcttaagtccctcggcaagatccctctagtggctctgacttccaagtgtcaagggcctagaatgtggtcaaccttatttctgagaacggtcattgttttctcagtagatgtggcagagactgcaaaagagacttcatcatgcgccattacagtgcagaggtctctgctgtctgtgcctaatgctgtctggctgcagagcttagctttcaagccagctgatcacagatgcaagccctaagccaagaaacctggcccctctaaaccttggctccttcacacaattggcatttttttttaaaatgtatttctgggaggctgagataggagaaaaactagaaactgaaaatctagagattggagagttctttgccaacaggagccttgtggaaatgtcaggctgagacgatgaatcagcaagcagaggagagcaagcatggcgggttccctaactgtggaaggaggggagtgtgcagagccaggtccctgacagctcctcctggggcttactcatctctcccctgaatgtgtgaggagcacttcgcacagcggagctgatagcagactggggagaatggatgcggacagaaggcacgtgcatgcaagcctgagaacctgagttcaagtcctacaacccactgtaggtgggaagagagaactgactccatcagtttctcctctgacctccactcatgtctccatgcatgtgctcgcgcatgcgcgcacacactctcacacacacacacacaatgataatacattttatcttcttaaaacaacaaatgccacatctttatgtaccttctctagaaactcaggagcagatgccccctcccgctttcctgctcatttaaacagtctttcctgagccccagactacacatcttctgagagagggacaggagagggtaggggtagggaaagaaaggatagaggcagaaaaaaataaaagaaacaacaataaactagggattggaggagtatgtatctgaaacctgctgtgtgtagatacacttctctctctctctctctctctctctctctcctctctctctctctctctctctctctctctctctctctctctctctctctgtgtgtgtgtgtgtgtgtgtgtgtacactaacctgcacactaacctgcacaaatagaaagccatttgtgagatggcacttccgttgcaaggcagggcatgtgtggggcagcacagctgtccagtgttaagcatatcaccctcacaccatagccacctgggcagagaggcaaggacaggtccccctgctgagtttgcaggagaatcaacttagtgcacagttatctggggtagaggggcattatgtctcccttggggcatttagcttgcctggccgcttagagttcaagctcagctgagtgggctcctctatctagtgtctgaatgcccttcaaaatgtaggacagccccacaccagaactctttagtcttcaaatgtccacagtgctgagcctccctactccagaggccaccctggcttggaaataccgctaagatatgccaaagcctgtttagtatatactctgtcaccactggactggatagggcttcagaaactttggtgctaaggaaagcaaagagaaacctgcccggcttgcctctagccatgcccggtggctctgtcaagcaggaatcgggtactgttatagcccagttcctctcttactcctgatgtgaccttgaaagcatctacatccaccatccaatctgtgaatcagtcctctgattcttccataccttcccagtcatgagtcaagacgacgacaaagctatggcagaagtttcaacccaaaagttggaaaacagtatctgggaacatttcccccccccccccagcagaaaagcaaatttccccaaatgaaggcagtgggagacagaagtttttgccaacacacactgacagcaaatatgactccacaaaaagcaatcggcatagaaatcgctgcctgggtgacagctctcagaacgggagagatcttactgtgcttgttaagagcatctgaacaactccacacgctggagcgtggactccctggtgtcctttgctcgagaagggtcagaggtgacagcaagggaatggctcctttgaatcctgtggcatccgtacccggccagcctgccaggtccccggtcccagcatctcccaggattgctgcagacgagtctctgaagtcagaactgctctcccactgctgaaatatttgagctgcactaggcagatggtcccacgcttatcagcagaagcagaacttcagatggcatcatccgctgacacacaagtgaaaatctgtgccctgagccacagtgggaatgggctgtggagagcacaaagtggctcgtcaccctcaaagacaagggccagcctgggttaaggagaacggtgctcctgagacattatgctgtcttagagggcagaatacataggacccattcctattcctagctgagctcagaaatgatcacatgacctgcactgagctcttgaagactcagtgttcttcactataaaatggatttttaatattacctcagaaaagtatgagtattaaaagggacacatagccgaacatggtggcacacacctttaatcccagcactagggaggcagaggcaggcggatttctgagttcgaagccagcctggtctacaaagtgagttccaggacaaccagggctatacagagaaaccctgtctctaaaaacaaacaaacaaacaacatcaacaacaaacaaaacaaaacaaaaaacaaacaaacaaaaaagggacatgtatgtctaactctgcatagaggaaggcacatggataaataattcaggatgcattccctcttacaagtccttggagtatatcacgaacagtttagtgcagaaagttgggctgaggtaatggagagaaagggaagccaaagtagagaggtctgtggtagaggaggtttgtctgccctgtggcagtacacaggcaaattccttcccaggaattgtgctaggtacaggttctcacacaggaactcagaaacacattaaacctcttttcccctgacctctgcccactttttttccaagaacccaaaataaaaccaagcaagagaattctagatcacctggatctcaagtagccacgcccacagtgatggaccacaggtagccacgcccacagtgaaggaccacaggtagccacgcccacagtgaagagccacccttgctccacacctcttcttttcagagggcttcctctggttaccacagcgtcaaagcagcaatgaccctggaaccagtcagatcaaaggggaagaaaggtggttccaagccattggaaagcaggtgtccactcaaactctttccagagcaggtctgaagggcaggagagcaattgtcttgcaggaagccccattctcagttctccctggggccaggggtgaaggggtggggaccacaggacagaggtttaccccaaagaccttcagagcacagctggttccagcagcaggcgcagacagacagaggataagtcaacagaaccagtgagctctggccagatgtcaaaaacactctcccgttacctgatttccatgtcccaacagagggaaaggcctgcctcctggagaagtttcaggagcaaaatcagagagagagacgggaaacgccactaaggacaaactgcaaggtagaaaaggaaggacacaccgtggggagggattcatgagaagagccagtaggatccaatgagagccaagaaaggggctggccaagaggttcccctggcatggcatgcgggaggggcgaaggggaggaaggaaggaaggaaggaaggaaggaaggaaggaaggaaggaaggaaggaaggaaggaacagaaggatcttctctgctcctcaatccacatttgcagcttcttagagctgagacagtccggatttggggaacagttgtccccaggcgggtagtggaatcctgagcagagtgaccaactagagagaaggctccaccttccttgtttaagtcaacagaacagaggagctcaccaatttacttttcccatctcttatcacaacagagatgcctggccactctggccaaggaccagtcgcccaatctggaagttgttactagtcaccaggtgaatgcagagcagagctcccaggaagctaagaggtcagctggtctccagggaaggggacttctgctagggatcgctctcctcccacagagtgagtgggtgggagaaggtgccaagtgttttgtgactaattggcaccaccaacaaaacaggaactatcacagatggggctggagtttcatttgtggtagataattatttatgcttagagaaaatacagcaacttactgtaaaaataaagctgcctgcattgaagccacaaataggatggctatttctgtgcttggtttgtcgttgcaaggaatcattttcttcagaggtgggaagatttgaggggaaggaggtattgaaagagcaggaacagggccaaccaaccccggggaagagaagtctgtggcccccaactttccttccatagaagttctagacttcactcccgagagataagtcataccttccagagttccttaaacatgcccgttcctcctgtcaaacaacagaaagatgaaaaaaggccttgaagggctcagagaagcaagggagaagaaaagataatacaaaagtagcttaaggaaggattttggctcacagttcaagggtctgatccgtcgtggtggggaaggtaagaggacaggagcttggggcagctggtcacattccatcaacagtcaggaggtggagagcaatgaacgctgccgctcagccggcttcctttttcgcattcagtccggaaccctgacccatggtatgaaggccgctgcccagaggcttccaaactcagtcagtcaccctaagagataatccctgaggtatgccaagaggcttgcctcctaggtgagtcatgttaacaattaacattgactatcacacacggtaacccaggtagccagatggtagattcatagtggtggagtccgtatgtggcagagcggcaaaacccagaagtggatcgacccctgctccctgagttggaatcccctccttctaacttaagccccatgtcttacgttccaaagcctcttagtacctgggtgggggccgggggtggggcggggcggggggggggggggacttgactctcgctgacctagggaagcagtgcacttcagccgtaccctcatatgtatcctcacctggaaccaagctctgcccagtcctagatgttgattgtcgatcacaggaagatagcctcaagcgcttccccaaagctgagggctcccttctgactttgagaatccagagaactggaagagctggtaactagagagacaaaaggaagacgggtcagagccacagaacatgctgacagacagcccagtgtgcactgtcctgctccaccatttggaacagaattgacctcagggatgctagaaatcctatcttccaaacctgactagagtcaaattggctaagcggttctggatctctctgttgtgactaacaggctctcagaacagaaccagccccccatcttcctgattgacaggctctcagggcaggactttcccaccctctgccctctaatcctgcaacagtcttcagatctcagtgaccagatgaaagccaaagataaaaccctgaaaatgaaactctcccaggcccatttgatcccgccagcccagggcaatcttctttcctaaccctgtacagggattggctggatctgtctgtcccaagcaaggattttcatttttttcagagcacatttcttagacatggagtttaaaagagaactgtcccacctccctcatgcatgtgcttggccttccacctagacaggcccacatggtgaggtctggtgagaacactctatgagatggaagatttctagatatgagaagaggataaaaaaaaaaactggtttaggaagatagctgtagcaaggatgtcacagctgcagcctgaacgtggcccagccccaagaaccccctgacatcctctgtctggaaggaggtttttgcccacccagtagaagagcctttcctgagctataaggacaccaagtgacacagaatgggtggtagtcctaagcgaagacagcgtttatgctaagggcctggagaattccccggtgtacacaacagtatacttatttataataataaataaacctttgggccagagcaagcaggaactgagcaagcggggttgaccagagtgagcggagttgacctgaagcgagcaaaggtcctaaactcaattcccaaaaaccacatgaaggatcacaaccatctgtgtgtacacgtacataaaattcagtgtactcgtatatattaaataaataaataaatcttaaaaaaaaaagaatatttattttgggggtggagagacagttcggtggttaggaactgcttttcccaaggacctgatttgatttccagcactcacacagcaactcaccagtatctgttgactctagtcttaagggatccaatgccctcttctggcctcctcttctggtactgcataaatttggtgcacagaaatacatgtaggcaaaacacttaaatgtttaaactttatttttatgtgcatgggcattttgcctgcagggatgtctgtgcaccatacatgtacctgatacctgcagaggccagagttaccgaacctaggtcctcaggaaagtagtgcgtggtcttagcagctgaagcatatctccagccccattgaacaaatattttatgaaagtagttaaacaaatggctagtaagctcatgaacaggtgctcaaaacattaatcatcagaggaatgtaaattacccctaaaagagatactgtctcatacctgctaaaatgtgggtacaaaagcttgcaaaccaaagaatccagaccaaacactggtgaagagggacaatcagaactttagcagctctggtgggaatgcagaaccagttggcaaagctgggcaggaatttcattaaaaagcaaacacacgcggctgcttatgaaccagactctcactgttaggtgtttatccatgagaaagtaaaatctagggttggagaaatggctcagaggttgagagcactcgatgctcctctttaaaaagaaaagagaaaatgtatattcaccaaaatcctcatgtgagactattcataaccatcttatttataaaaaaaaatcagaatctgggggctagagggatggctcagcggttaagagcactgactgctcttccagaggtcctgagttcaattcccagcaaccacatggtggctcacaaccatctgtaatgggatatgatgccctcttctgatatgtctgaagagagctgcagtgtatacatgttcataaaataaataaataaatcctttttaaaacttcagaatctgaaaacagttaagatgcccatcaaaaataagctggatcaacaaattgatatattttcatacaatataaaactattctgaaataaaaagcacagactgccagatacatgcagcagcatagatagccatctaatataaaacattctatcatatagtgatagaaatctgattattactcactggtcatgtcaaactggcttgggaagacaatgtgtcccacatctagggtgggacacagcctgcatgggtatgtgcacttatcaagctaggccaaagggaacaactaagagagtaagctttgcctctatacaaatgtttcttagttcaaagaactcttacagctgagcctgtcattttaaaggtcacatgttcctccttcaacgtctaagaaggtgacttgctactgaactgaaggcactaagtccaagtctgtgctggaacccacgtggaatggcaaactgaaatgccttccttgcaaactccaagagaaataaatttcatgtttatttaataacttcaagtcacatgttaaagtgacaggctgtttccccactcacttccgttttcttctgctctccactgtcctactacactcaaaacatttttaagtagctcatgttacctgatagaaatctttggtgggaaaggataggctaagaaattaattatgctcagagagctgaagctaaataagcaggaatttggacctaacataggctgcagagcaagacttcctccaaaccaaaccaaaccaaaccaaaccaaaccaaaccaaaccaaaccaaaccaagaccttaattgtaagtggaagacttcatgtcagcctacagcatcatagcaccatgatactttctttttatttaatttgatttgatgtgtgtggatattttgcctgcatgtgactgcataccgtgtacatgcctggtgcctttgaaagccagaagagggcatcaggtcccctggaattggagttagaaatggttatgaacttccacgtttatgctaggaatcaagcctgattctctgcagaagcagccagccagggctctaaacagccaagccatctccccagccgcattctgatactttaaccaccggaagctcatgaactttccaaagttagtttgctgttcccttatatttccactagggggtatctaggtcagcaaggattaacatgcttaatctatgacaatctccagccaactaattaaaaacaaaaaaacaaaaaataaaaaaaaacacattcagactaccaataaaaacatgtaaaataaacaccaaaatacatttgccactttcctgtactgtcttgacaaacgttaaaaaataaaattatcagtgctggaaagcgagcagagatgttgcttctacagataccaaataataaaacttcctcgtaagcaagaacacccttccctgggtcctaataaggtgaccatccacagacacagtgttgagcagtatgcaggttagtttttgtcaacctgacacaagctaaagtcattcagaaagtgggaacctcataagaaaatccctccactggggctggagagatggctcagcaatcaagagcactggctgctcttccagaggacctaagttctattcccagcacccacatggcagctctcaactatctgtaattcctgtcctgaggggggcttgacaccctcacacaaacatacatgcaggcaaaacaccaagaaacataaaagatttttttaaaacattaaaaaggaaaatgcctccatcagattgtccaatcagcaagtctgtggggcattgttttgattaatggttgatccagagggccatgataggcaatgccacccctgggcaggtggtgccaggtaatataagaaagcaagctgagcatgttccagggaccaagccagtaagcagcgtgcctgtctggtctgcttcacagcctgctccaggttcctgacttgaggtcctgtccaggcctctctccatgatggaccatgatggggattcgtaagcagaaataaaccctccccactgctgcttttggtcagtatttgtatcacagcgagagaaagcaaactcggacaggtgagctctgaaatgggaataaacattcctctccttgtcctctgcaggtgcctgactggacgcatgcactttgccctccttgccgcttgcctagattttgatcatgtgcttatccaaacatcaagaaaaaaaacgtccagttgtgagaaagagtatttttggagtattgtctgggggcacagagtctgtccacgccagtggctgttctaaatatttccctggattcagccctgcatacttggtcagcattgtttcatagaaatataacttctaaattttcccttgcagatattcatcagctgtacaaagagaaaaggcataaactgctggaagctgtgtccttgggtcatgggcactacttcccacaacacccactggctttgcatggagactctggaccttcagagcgacacccagttttgccacatggatacaggacttgtgataaactaggtagtaggcctggatctgttgctttcccccttgctgtgatgaggaaatccctgagaaagataacttaaggaaggaggggtttgctctagcagctggagtgaggggtggcaggccacatgacgtggcatccactatcaggatgcagagagagatgaatgtgtatattcaccttccctttccacgaggtctaaaaccctagggtgagtcttcctgcctcggtttaccgagtttagaaactcctatgtctccatggtgattctagaccccgtcaagctgacagtattaaccacctcaggggttaactgctagagatcctgagagcacacatttgatctgctttgtaaatacacgatttggttgcctgaaataatttagtcagaggtcaaccctggataccattaaagttgttctcctttt

SEQ ID NO: 265 - DNA, 8693 bp, Mus musculus
cctcagcacgcttggtccccagggagcgctgtttgtttgtttgtttgcttgtttgtttgtctgtttgtttaacggagcgctgcgctgggcatcccggcgaccgacgaggacttcgctgagtcctcggggagatgcaaacgagtccgttctctttctaggagctccaactcgcagcgccaagcgccgaggatgccggacggactcaagatcctaactctaacctgagggactgagcgactgctcgccccaaagtgttcgctctccttcctggaagagccacaaggggttcgaggcgacgccctagggacccttgggaagcgtcacgtcagccgctttccctcatccctcgctgttgggtgtctgtggaacaaactcggtgagttgcgggagtctcgcccctggaatccggggtcgtcctctgaagagtggaacaaacaacttgttcatcaaatcagagggcggctgcgagtccacaaagtctcggtgaagtggaaattgtcagactctctgccatctcctctctcttttcccacgcagatttctccactattccagagcaattaattacttggtgtcaccccaggtccctagggaaagattttattccgtgcatagcggctctggtttgttgtcactgttcatgcttccgtttgccccttctagaagacatgacggattttccgattcgatttttgttacgatttttttccttgaaataggaaattgtatcaaaatatcactgctttcagttgagagggaggtagtgtagtgttatgaagaacacttgggtttagtgacctacaatctcatttcactcctgtcatctgacaggatgacaggttaacaagccattttctgcctctggtactctttgcaatgctctcttgtaaagatgtgtaaccattacctcctgccaacatcacttagttgtatggtttttatcccacacacccaggtcacacaccatttggttgaccagatcaaagcaaatctgaacactcctctctggggatcttaacgctaggatccaaaagaggtcagtgtttctgctagctgataagcctctaacctaccaattgtgtggcacctaacaattgtattttgaactacatggtccctggatctagaacattcccaagtcgtaactacttccatatcccccttttggatttagtcattgaagttagctttccattatttgtaatcgagaggcctaataaatccacagttgaaccagtcctctttcacataggctattccaaaggatcatgacagtgacttcttccactcaacattctgtcatctttatgctaactttaaaaaaggtatctcttccttaaaacatgttaatgtcacctgctagaaaattgttacaaaggattggtattttgacaacagaacatacttcatcaacctattgagatctatccttgtctgtggtgtggattcaagtcagatgctccaatattgccccttttattatgtgaattagtcctccaagtgccatgtaggcccctctctgcacagcagccctggcaactgtctttgaacataggtggtgtgtccttaggatgcagtatctgagattagcgccccatatccagaaacaaagagataggttccacatcttcctcactcagccaacatacattttcccaaatgtccctcagaaagtcagttgcatgggaaactctataaatacatgtttcatgattacttcacttcaaacaaacaaaaaaagaccccacatttcccatcctctactttaccaaaatgaaagccaataagaacttgtaaaatgaggaagtctctttttccctgttgtgagttgaaatacatctccaagtggatacattcccatcctaactcttggtacctatacatgtgaactcatttggaaatattgtggagtcttcacagatgtgattgggttaagatgagaccatactagtgtgaactctccagccagctatctaaggaaagtggtgtgtacttttaattctgagccattcaccacagttcctcttactgcgctgatcatgcctggattcctgtatatctgactgatccgtggcgtggggatctgctttaaaacaagttagttatgctccagaatacacatatacaaaaggattcattggaatgattttggagctgtcatagttgtcacacacagttacactattcaaaataaacacttgaaaatgatgtttgataactcccttctatagttttcaggactgtgatgactattcttcgttgtcaacttgactatatctggaatcacctacaacccagaaatggagaagagcacacctgtgagagattgtctgcttaaagtggatgaatccacttctagtccagacctttgaggtaggaagacacacatttttaatctcaatctcgaggtgggaagacacaagtctttaatccaaatcttaagagatgtcttttgtgaacatatgagccatactttcagctggatgtctgtataaggacgtaaaagaaggaagcttttactctttgtctatctgctcttgccttgctagcacatccattccctcactggtattacaacctacttctggattgcagcatatactgaagaccacctgagacatgcagccttgtgggactgagcaaccactagatttttagactttttattgttggattagctggactacagaggaaggagagagagattgattccataagttctgtgactctaaagaaccctgactaatacagattttggtaccagaagtggttctagagaagcagaagtataaggatgaatcttttaagtatctggaataggcatttcaattcgccggcaccttcagctactgaagtctctccagtcaccccctctcctgggagcttggagagtactgaaggcccatggtatgaactgtattacaaacttaaagagataaatgaatttgattatcctggctcaccaattgtgagcgacaatggattaggtgaccctgtatatgaaacttttgacagtttgggggaaaataaggaaaatgatgctgctggttggttgcttttagcatctctggataaactgataaaggataggaatgagctccgggataaaattaaccaactgcagaatatggtgaaggacaacaaagaacttaatgataaaattgaccatcttcagatgctcataaacaatctaaaggtttctaagtgtgccctggaaaagaatcttctctccagcagccacaaagctcagtttatggaaaaccaaactgaagctctcattattcggttagccgagttacagggaaaattcaagtcccagcctcggaaagtgtcagcaggtaaagtaagagcattaattggtaaagaatgggatcctataacttgggatggagatgtgtgggaggaccctattgaatctgagaactttgaatcttcagattctcaagtgtttatctcacctgaggaagtagtaccctcagccccaccccttgaaatactgcctttttcacctttcactgaggaaattaatcctttgttatctattaaaccagcagtggctatctctaaaggaaatgccaagcaagacaatactgatgtccctgagagcctcaaaatagttgcctttagacctacaaccagacttaaggcaaagcaggctcctagaggggacatagagagtgtggtgcatgaggaagtgtgctatactactaaggagcttaatgagtttactaattcattcaagcagaagtctggggaatatgtgtgggaatggattttaagggtgtgggataatggtggaaggaacataaaactggattcggctaagtttattgacatgggccctctgagtggagattctaggttcaatatggaagctcgcacagttcaaaaaggtgtcaaaagtttgtttgaatggttggctgaagtgtttgtcaaaagatggcctactgagaaggaattggagatgcctgatatcccttggcttagtgttgatgaagggattttaaggctcagggaaattgcaatgctagagtggatatattgtgtaaaacctagtgctcaacaatgggaaggcccagaagacatgcccttcactaatccaataagacgcaaaatggtgagaggggcaccagcacatttgaagagttttgttctctcccttttgcttgtgccaaaccttagggttggagatgctgctactcaattggatgaattaaatgcaatgggcttaattgggccccggggtagcaggagcccagtggcagcactgaattgacaaaagtaaggcgatcataactattgtatgagcagcatagacaacacaatgttcataatggcatgacttgtatggacctttggtactggctcatcagtcatggtgtttccaggcatgaagtggataagaagcctactgaatatttgatctatataagtggaaaaattctcaaacaaatgaaagaaaggctactttgaatcatggcacaaggcaatctcagtcactgaatcaattttcagatgtgagccagtttgcagacccagaacccccttgaataaaggagtaaccaagttcccctgaggaaggaccttaataaaataccttaaagttttactgttaatcattctccagtctttccccagagggagatagggctttttacaaggggaactgtacactggaggaaaggaaacaattagactttccagggtctattggatattggttctgaattgacactgaatctgggagatcccaagtaacactgtaaccctccagttagaggtgggacttctgtaggccaggtaattattggagttttggctgaagtcctactcaaagtaggtccctaaactcatcctgtggttattcccccagttccagagtttttaattgagatacatatatttagaaggcagaattctcacattgattccctgacctgtggagtagagctattatggctggaaaggctaaatggaagcctttagagttgcctctgccaaagaaaatagtgaatcaaaaacagtatcatatccctagaggaactgcagaaattagtgccaccatcaagttcttgaaagatgcaagggtggtggtttctactacatctccatttaactatgctatctgcccagttaagtgacagttgaccatcaaaacctcaatcaagtattaactccaattgcagcttctgtaccagatgtagtgtccttacttgagcaaattaacacatctggtacatggtcttcagctactgatcatgcaaatgcctttttctcagaacctgttcgtaaggactaccagatgcagttccctttcagatggaaggccagcagtatacctttacagttttacctcaaggatatatagactctcctgttctgtgtcataacttagttagaagggaacttgattgtctgactcttccacaaaatatcacattggtgcactatattgacgatattatgctgactggaccaagtgaactggatgtagctactcattggtaacaacagatatgaatcagaagataggaaaaattcaagaactgtctacaacagtgaaatccttaggagtccagtggtgtggggaatgcagagatattccttgtaaggtgaagaataaataattgcagttgaccccaccccccaccaagaaagaagcataatgtttagtgggcctatttggcttctggaagcattacaactctcacatgggtttgttactccaggccatatactaagtgacttggaaagctgttagttttgtgtggggcctgggacaggagaaggctcaacagatccaggctactgtgcaggctgttctaccacttggatgacatgatccagcagacccaatggtacttgaggtgtcagtgacagaacgggaatgctgtttggagctttggcataccaataggtgaatcacagaaaagacctttgagattttggaacaaggctctaccgtcatctgcagacaactattctccctttaaagacagctcttggcctgctattgggcctcagtggaaactgaacatttgacaatgagccagcaagttaccatgcgaccagagctgcccatcatgagctaagtattattggaccaccaaatcataaagtaggacatgcacagcagcaatccattatcaaatggaagtggtatagagctggagagaaagctcagcagttaagagcactgactgctcttccagaggtcctaagttcaattcccagcaactacatggtggctcacaaccatctgcaatgggatctgatgcccatttctgatgtgtctgaagacagctatagtatactcgtatacacaaaacaaataaatcttttttaaaatggaagtggtatatgcatgattgaacctgaccaggtcctgatggcacaagtgagtcacatgaagaagttgcccaaatgcctatgatttctgctcttgttacagtgcagtcttactgccaagcatacacctatagtttcatggggtgttccctacaatcagcgtactgagaaggagacagctagggcctggtttactgatggttgtgcactttatacagtcaccgcccagaagtagacagctggagcattaaaaaccctttttgggacaactctaaaagatgctgacaaagggaattcttcacagtgggcagaacttggccaaatgaatgattgttcactgattcacgtgctgtaaaatggattggctgaatagtcacggacatggaaagatcatgattggaaaattggtgagaaaaacatctgaggaagacatatgtagatgtacagaggatgtgaagatatttgtgtcccaagtaaatgctcttcaaaaggtgacttcagctaaggagttcattaatcaagtagataggatgacctattctggggacagtcaacctctttccctagccattcctgtcattgcccaatgtccacatgaacaaaatggccatggtggcataggtgggggttatgcatgggctcaatgatacagactttcactcatcaagactgacctggctacagctgttctgagtgccaaatctgccatgccaacatcagagaccaacattgaaacccagatatgatgccattacctggggtgatcatccagcaacctggtgggaggctgaccacattggaccatttcctccacggaaaggacagtgctttatctttactggagtaaatagtctggttacagatttgcatttcctgcaccataatgcttctgccaaaaccacaatttatgaacttacagattgccttatccatcatcatagtattccacaaagtattgcttctgaccaaggtactcacttcacagccagagagaagtgtgacagtggacccatgatcatggaatccactggtcttaccatgttctccaccatcctaaagcagctggccagatagaaatatggaatggccttttaaagacacagttacagtgccagttaagtagcagcagcctagagggctgaggtagggttcttcagaagacagtatatactttgagtcagcatccagtgtaaggtacaatttctcccatagctaggatccatgggtccaggaatcaagggctggaaaagggaatattttcacacgccatcacccctaatgaaccctagggaaaaaatgctttctgttcctgcaaccctaagttctttggttccagagggagaagtctcctgccaggagctgcaacaaaaaaaaaaaaaaaaaatccattgaactagaagctcagacttaacccctggcaactttgggcttctagtgcccttaaacctacaggttaacaaaggaatagcagtgttaggaggagtaattgatccagattactatggggatattggattgcttctcccacagaggtacaaaagactatgtctggaatgcaggagattctttaggatgtctcaacgtactattataacatgaattaaagtcaatgggaaactacaacaacctaatccaggcaagatgacaaagggcacagacccttcaggaatgaaggtatgggtcacttctccagggaaagagccaagacctgctgaggtgcttgctgaggatggacaaaatacttaataggtagtagaggatggtagttacaaataccagccaaggtgatgtgaccagttgcagttgcaaaaaaggaaaaaaaaaaaaaaatgccgggtggtggtggcacacgcctttaatcccagcactcgggaggcagaggcagcaggcggatttctgagttcgaggccagcctagtctacagagtaagttccaggatagccaggatgacacacagagaaacactatctggaaagaaaaaagagagagaataacagtaattatcattatttaagtttaagatactaaaaggatgtcccctaaaggacattgccacttagtctaaatttataatttgtttttagttggaccagggttgtacgagttatatcatgttaggtgtaattatgacctggttaaatatataacgcatctgtgattttacatggaatggttatattatgttcaagcattatcatgacctgataattgttttcatttggaaattatgacataagaagctatgattgtgtatcaagttgaaaagaggtggacttgtgatggctattcttggttgtcaacttgactatatctggaataaactacaatccagtaatggagaccac

SEQ ID NO: 266 - DNA, 5157 bp, Mus musculus
atcactgcgccgggatgagccggctgctccacgtcaaatagtgccgtcgcctccccccctccctgcgggagggctcccttagcccccgtcctgcaccccgtgccgcgccctgaatccaggcgaccatcctgtccaccattggcagaagtttggttagccatcgaaacaaatcctgtgccccacccctcttgaaaaattgatttgggagttggggaaatcaggctttcttttttttctttcttgccttttttattattaatatttttgttgttttttttttaagctccagcgctcagaggagtggccccaagcgaggccagactgtgaggacggcggggaacgcagcgacttctccaggggacagcgccaggcgggagcggctggcccaaacccggactcgtagtctaaggtaggtcgcagggtctgagttggtgtcccctcgggaggcggggcctgcaccggacagcctggtgtgctgagagggctcctagggtcgagggatggggaacatcaaatgtaagcaagaaccgctggccccggactcgccaaagggaaccctgacctggggagggggtgtaagggctgtagtttgagtaagtagtcccaaaaagcccaggcctggcagaaatagggcgggggaatgagttgagggggctctcatagccagaatgggagatcttgggtgaaagaggacggtcaggcccgggttgagaccaagagagtgttaagagggtcaacagggctcggaaagatatcttgttcccggccggggtcagtgggcgaaggctgggcctcccaaggcttggagtatgaggggcaggtaagaagtggtgtcctcaagatctaggggtggaggcctggaacggcatgggtacagtcgttctaaggaaatctgtgtgacctctgaaatcggtgccctttcattgtggctaagggacctggccagggttagagactgagcgctggccacccttggcaaagtgggcctcgacagcgggcaacgcaaggccagcggcacgcagctggagactcctgggtgcatccggccagacatccgcgagaaaactagaagacgtcgcatcgggaaacagggtaccttcggccccaccactcccgcgcgggtttcgtcctggaatagcaggagggatggtgcggtcccagggcaggagttaacagcccctgcgagctgctgctgggcggccctggcccctccggctgtggagcagcggcgcgaagccgggaggggatggagggctcggagggcgggtcccctgaccccgctagaggcgagagggcggatcagatttggagcctgagggaggcttggtcagaagtggccccctgtgctgggggggccccccggaggggcccggctttgtggaggattagcggtcaccgccccaccccagtacctgcgtgtgtgtcggtgggtatcggagtgtgtctgtgtgtgtccgcgctcccgcctcgcggaagctattgagaacgtgtgcacccgtattcctgtgcacatacattttgtgtttgtgtgtccttacgtctttccaggcaatgagtgtgtgtgttttcggtacacgtctctcgtgcttctatgtcatgttttttacacgtctttgtgtgtgtcctcgtgaaggtgtagatagtgaagatgtctacgcctttgtatgcgcctcggcccctttagcgaatctggtagatttttctctataagtgtgtctctgagttacctttgtgtttctgtttgccccggagctcctgaattgttctgtgtcgcccaggggtttttgtgtttgtggctttgtgttctgtgtatttctcggcgcctttgtgtatccaggagcatgggtatgtggatgtagagttttcttcacccacccttcgtccttgtttttacccagtgtgaaaaatctaaggccttgagccctgaggttgggcagaggcctgggcctggatctggaccgccttctctgggtatctgggccctggcgcgttactgcgggaagaagccgagcgggtaaaggctggggcgtgcagagccgggaggcaccgaaccgctcgcagaagcagcggcccaaccgggtgcactccgccctctgctggccatagtgtgtctctgcaaccactgctgggcaccgaaagccctggttccaggcccggagcttcgccatctccttcaggctgagtcgaaagaatcttctctgtctcaaaccttaaagacgaacctcggactctaagcaatcgcacagtgtttcacccccatcttcaccctcccatttcccccacgctccctgtgcctgtccatttctaccccattcctctccgtttttctttggctgaatggtggcccctgtggcccggcttcagaggtttccctgatcctctggctggcatctaagaccgggtctggacctttgactgtgtttgctgcgcgttctgcagtgcttgaagccaggtctcagcaccgagggcacacctgtagccccccccccatttgatgcatggctggtgtgttttccaaggctcagagttttgggggcctctccctgcgcagcccggcccactcgggtcaggctgccgaaactgtcggcaactgagtccagagttccctgggtgaacagtggcaccaagattgtctctagtccgattgaggacgatgctccgttcacagatgcctgtttccttctgtccgttctcctctacccgtaggccttctttgtccttacttttcaaccccgaattgactagacccggtcttcacattgccccacataatcgtccatgtgtctccgaggcattcttagggttcttggtctcccatcctttgcctctaaggaagaacaatacgactggacaggagaacaccggcctaggcctagacccacttctctccgcgggcctcaagctcctggcttcgcccgtctcttctgtacaagcggatgcccacccctggctctgagactcacaacgcaggtggcctatctcttccgcgccgtccaacgcgggatgcttgcggcctccgacgtctgctgcagaatccgctcgggactgtttccacctgagaaagagagttgccagcgactgctggaatcgcaagaaacaaaacagggagagatccgggctcttcttatcccagaggcgtgcagctcctgagccctgacttggtctctggctcttctcctttaggaccttgcaacctcactcggtagcgacccatcttgtgagagcgggggagcggtgtgaggggaagggctataccagcgaaaacccaaccgtttggtgcttctgaccagagtccgggagagagaggacccttcctccaggtttagaaccaccggctgcagtgtcagatcccagcaggaggaggaccacagccttggattcatcagcaaggaggctatcagaagcatcgcaccggccttcctgctctgcctcaagaaccgaagccatggaacacctaggctcaccccatgctgcccctggctaatggcatctcaagatctacgaggctctgccgcgcagaatcaaagctgtcccaaaactgtgggccaagtcgggagctgctcctcggggaaactcagtctatcccagaccctcagtgatgaagaacccgaagaccacggaaatggagcaagggcgcgcccaagactcagcagaggtcgatcactagcaatccaactcccgagcatccaggtacccctctgagcattctagctggtcttcaccccacacacgagtcaaagcattggacgaccactttctactacctaaggaagggcgtctgaagtctccctgtgctggtggaagttctccagagaggcgagactagagaggggtttctggggtacttattctccactgggggcttttgaggctgatgagagaggggtgtcagggtttgctggtggctggtgagtgttaggatgcctagagccagaagatgaacatccgcagccagatccctcagccctccaacaacccccactctggccattactctggaccatcaggcatggacttgctccacttgtggggaaatcaggctctctcagatccaaaggctgccggcagctcttaggaaggttcagagaaggccctcccaggactggtggcccagaactgaggtctcctactggctacacaatggttaggaacaggagaagggcaggtgtcaggaagcatccctgtctgtctcagggtctggttaggagacaccagggtaaaagacctgctgcgcctttgtacttcaaggtccctgtctgtgcaatgggcataaaagagacttacagagtctctgagagggtcacatgaaagtgctcgtggtgtggccagctcactgtggggctctagatctactatttgatgaataattgtatgggaggagagctgctacttagacataggagactctcttcctctttctgttcctctgccgcctctagagccagaacgaaaacagacttgtctcaaattcagtcctgtctggtctcttccttccctctgggacaggtggagtccccgagccggctactgtggactggccacctgagacacggccagtgcctgggcacccagcacaaacagctcagccttctcactttgtcatgaaaaccgaggctgagggcagctaacaccgacagtgagagctttgagaggcaatagaatcaagatttttttttaaaagctctttggaaagaaacccgttagagactgtgatgtgtgtactttttttgtatgtttgctttttaccaagcactttcctaagaatctctgcatttcttgccaaaggatggtttcaacaggcatcctgtctttaagaatgagtggctccccagtccagttacaggaaccagaacaaagagagggtgaaggaccgtgtttggagccataaaagcctcattaggaacttaagactaactcacagaatcggacacagattcacaaaagccagggagttcattggtctccaccctgagggtccacggctggggaagggggggtgggtgtgagccagggcgggtgcctctcttatttgatctctatcttaaatccacttcaaaacgctgcggctcagccgaattggaggttggccccttcctgtaattatttggtgtctagtaaagtttttatgagtgtctgtgcaaataaatgcatctgatg

SEQ ID NO: 267 - DNA, 19754 bp, Mus musculus
agagaggccttgctgtgaatggaagacaggagggactctggtacatctgggagtggaaacttgatgcttctgggctgtgatttgccaaggtctcgccaaaggtgagtactctgggggcccgaagagctctcacttggaagggtccagaccccgcccaaatctgagagtctggtggtaatcaaacagcggttaaaactgggatggagtgaaggtcggggaagggctacagcgtaagggttccagaataaatgggtgccagtgcgccttgtagctagcttgtggctcaggctcccgcctagggctgcttcccaacctgctaaggtcatccgagacggctgtgacttctagagccctctccctatgcggacctgcacctccgctccttacataccctcgttcaagtgacgctttggtatcaggaagtgagaaagtattcttctctcagacctttaaaagggaaagtttggcaaggtgggcgctctttggttctactatcccctcgattctaacctaggatccctagattgtacaggatattgttattttccttttataaagaatgactttaacgaaaattcgtatgtagtcaaaaagattattggatcaccatgactgatcagctgctgctgacctaccaataagcgttatttaaatatacacgcacattcgtgcgtgccccctacacgcaaacacactcgggggggggggggacgtctatatgtaatgagtaagacagctcgaagttaccaagaattaagagggaatcaaaaaggcttttaagtgttatgtatgcatcttccatttgtgtgcagattggggtgggggggtgcctgtctgttgcgtgtgttgtcagctggttctagtttctaagcactgagtgttgccaaaggctggagccagcacccaccattcaccttggcaccctagcggcagaacaggactcatttgtttggtgccaagaggtgaggacctggaagagactggggtgtagttaggtcggggggggccccctgccatccattacacctgcggcagatggctcaagtggtagaatggttttgtttgccagaatcaagaagggaggaggagaaaattcagcctcgccctactgaaaagaagtacagtaaagagccagagagatgaaagaagccatcaaaaccaaggatgctgagtcctgggcagttaatgaccttgatacctggttccaatagataacaaggcagaattttatgaatgtattttttgatcaaatgttttacacacacacaacacaacacacacacacacacctccgcgtagatgcacacaggtgttctgggagaacctctccatgggagctgacttaggaagctcttcctcagagcttcattccctcagactgccaactcatacacataaaggctccctccctagacaaccaactatggatttaagcagacttcaaatgtaccagtctccttctcacagagtaatgttttctgatcaatactgccacccttgcatccgtttcttcatgttactcaacaagcagggaatggaataactgtgccttctctggagacagtagaccatgggcatgtgacaaagagcccagtcccaatctagtagttcagtctgttttcatttctttaattctgtactaaagagagagttatatcaagggagaccaaaacacaccaggattctgtctccacccttcacactaatcacaatgaccactcacatctatgtttttatagcaaacattttcatgtttttttatgacatgaattattatgctgacctaattttctgttctaaatcaagcaactttcctttacccagggtataatatgctgacttgttggcactggtttgcatgcaaacaccaaaaaattccaccattttaaagcacacgttccacttttctgtatttttcacatcagggctcaaaaatgtttaaagttataccaaagacagtgaaaccagaatccattctagctatgatttgggggtgacaaataagatacattctaaagtcccacacagagaagggaaaaggaacactgccgctttccaaggtgcttgcaagacctaaaaacccctgtgaactgggtttggttgcctggtgtatgtctgcccagtatagtctaattgttctgcagtcttttccctctccttctctctcctatgaaggcttcatttttcaagaagaaaccttaatactcagcaagatataaggctcattgagaaggaatagagctctgttttattcagtattagcaatgtgagtttactcacacaccacacaccacacagattgctaagtgtctatctcaaggtttgagtgcatatgttacagaacatactcctatccactttcaagaaaattagaacaaaaactgcatttataaaaatgagctgagacttcatgaacagttgggagattttttttaaaaaaataaataaaaagaacatagaaaactatattttaatcatctgtttttagggaaactaagagcttcctgttttatttaaagaaaaatgtaattagcaaacctttgcaattattcaaaatggagacaataatttggctataccaaggcttcttacccacatgggtgagatattttagaccgttgttccactcactattctacagctaagggtattcgataggaaatcctgaccttagattaacaggtgcattcattgttttaaaaactgggatttgttaataagtgacattttaaattgaaacctcaaaggcttcaaatgctccagtgttctacgaggaaggcatctgccctagcatttgaacaggttagttatctgaaccacagtaaggtttcagaggcccctgcctgctcagaacctggcccatgaaaaggaaacatagagagtgggaggggctgctgggtcccctccctcctccactcagtgcccggcccacctgcaccacatctactcagaaaatgaccatttggtgtatgggggaaaaaaaaaaactcataagacaaagtctagaatacacacattgcactcagatatgttatataaagtgcatattctttaacatatctacattgttatagatgctttgtggtgtgtgtttgtgtgtgtgtgttaaaaacatcaccctctctctaagtttgtcctaacatgaggaattaaagaaaagaaaagctgtcaatttctggatgaagtcagtacaataaaggtgcaaatggcatcccaaaggacttaaacaaatgacaggcctatggtgccggacatttgtaaagatgcagtcttcgtttggcgctgaaataggtacggtgatgaagaggactgtaatatagactcaagtaaattaggatttcgctttggctgtggtcaacagtatttgcaggtccccagggttccagaagaaaggatcttcgaatagaggttgtgtgtattgcctgtgttatcaggtcccttctgcggctcccctaggaccatcttgaaactatagctttttctttctttgttcagtaatggctatagaagtccagagtgtcttgaacataaagatcttgaagccacccaagtccagagaatgcaggttctcccaggccagggccgccccgacgacccaagcgaggtgctcaagggccagtaggtgtcgctgtttccctgctggcaggaccctggagcccgacgttggcccctagcaccactcagttttctggcccgggtgatttcctagacgtctttgagctctggggatatggcaattcccttattttgtttctagaacccctgacctaagtcctcctggctgcgaccacagcaacattggtgggcctatggagagagaaaggagagaggaatattggtggggcccaaaggccgccctgctggaataagcggggagcccgcttcacccgctccttcctttctctccccaagcctagggtggcgtcggggctatctggagcaccccggaaaaaaaaaccctaaattaaggaattcacacacggctgtacttcgactttgaaattaaaataaacaaaaggttcaaaatctagcttcgcgggaaccgctcacaaaaagagttttaatatccttatctcaaaagacaaggaaagagggaggaagagaacgagggagggaagggggagagagggagggagggagaaagagagagggaaggaggaagaaagagagagggaaggaggaaggagagagagagagagagagagagagagagagagagagagagagagagagagagagagagagagagagaacgtgctaggcctggactttgagttacctacggtcttacctacagggctgtatgcagaatgtcgggtgattgcgttgtcctccctttgctctgagaaaagcttgaactacactagacgtcccgctgtccaccccaaaccgttatttactaagtattaatcttcactagatagggttacctcatctttggaatctgtactgaaattctggatattgaaaattctgttcctttctctggcgtcctgcggccccctgtctttggctcagtatgcggcgtaagcgattattaatcagaggcgttctttttgtgtctggggggggggggcatttggcttgaagattccatgacacgcacttacattggttgcatcctgtagatgtctggggattttattgatatcaggatttctttgcatagggaattcacttctctgttaaaaggtggcaagggaagagggcaggagccaccctaaattcacggtcttgagcaatcgcaagaggtagtgtggaaatagaagtagttgtccatttaacttgactctaagataatgccttcaatcaagaggttgctatgtgatttaaaaagaaaagaagaagaagacatactgctgtggttttgtgtaaaactaaaacatttgtagagaggaaaaccctaacaaatataaaactagcagacaggaaaaaaaaattccacttagtcccaagtatgtttgaataattttgttctggtgtcaagactgaggccttaccatttcaggacccgcagcgcaagaggctgcgtagtcactgagagcctgaaatttagcaagagttcgtaaatattttcattaaatgccctttgcatttgccctttcataaaatcggctcctttctttaaagtcttatgccttttacacaattctaaaaaaatcatttcttatcgaagcagcagattcatctctggggttgggggtaggacggacacgtttctaattggaggttgtgaagttcaatgagatggtatttttagcttgagatgctcagattcatatatttttatattgtaccaatctcatccgatttccgtttcactcaactctttcattttctgctttcttgcttctgtcttccttccttcctctatagcgcctctcccactttccctcgcttcttctgtttctcgctgttttctctctcccgctcctttcttgtataatttattgtctgtttttatcagtgaagttaatacgaaaatagcaagggggaggcccagcaccttaatctggccctcttccctgcgcgcattagggactttagggaggtgtccgtagctaccaggttatagaccagcgcggtggccctatgtgcagagaacgctgctggtggaggaattggggtccgcctagggttgcggggcttattcaaataccgcccgctgctgctgtgattcgcagggactcggcctccatatggtaatgcggggcgggggatgggggtgggtggagggaggcacagagcggaggggaggggaggatggggttgaaggcgggagggaggggggctctgacaccgcgcgctctgctgctgtgctgggacagagcacccggacccgcggcagcggcggcagcggcgctccccaccctccaccgcagcactcatcgagccaggaaaccaccaagccacgggccctcggggtaagccacagtgtgcacaccacagcgatggtgactccaatgagggagattagaaacagaaaagattacagagagatcagagataagaggtgtacctctctctgtcccttgtcacacagcgcgcgtgcacatgcatttgtacaaacatgcatgctcatacagcaatacgttccacattctttgctacttccatctaaatacatgcaccgacactctatgccctgcagcgtggccagtgtgtttgtcctgatcctgcataaaaggggacaggtacgtgccagaacacaggcaagaataaacagccacgcacaattgaattgcagccaaactcagacattcagcctgctgaattaatccattcggccaggtttcccccaccccaaccggaattctgtaaccagttgaggaattctgcaattattcacaaaatgtgctgaaatttcacctcaagaaacgtaatcttgctatatatggcaaggtaagggtgaacctgaagggtggatgtgtttccattttttaatgttttacgcatagccatctgaccactttttattgggtgacatatcatatgagcactttcgtgtaggcttggaaaaactatagccagaggtaaggctggaaaatgccataagaattaagggtgctgaaaatggatgctagagagtccaaaaggagagatggcatacagctgtaggttgagatgggaggaaatatatgtgaatatttatacacaaaagccgttggggagggctgagtcttgcctcgagtatctgtgcaggtaagtcattcataagaaaactaattacctgtgcatggactcagacttgtttcatcgaaagagctgcatgtgtgcacattttctgttctttgtggttatgcaattatggattgtcttttttacaagatagctttagggaatgttaatatgtaatttaaatatacatatattcaatagtccttgtgctgaatattgccaagaaggaaaaactatatcctataaacacgattactattgcttgaaatccagctcaaggcctgtatattttaaggcacatagcctgctttaatatagttagctgttttgtctgtgtggtttcacttcaaagtctggaattaaggatgctttgcagtcaagataatgtgcttccatctatatagagacaaaataaaactcagtacattttgagtgctgcagacatgatacaacatacagcatggttgaaaaatgtcctccttgcagatggctctccattgctgtctctacacatttttaaatagatttttgttttgcaagaaacgttagaaagcaatagctagtgaataccgcattccctcggttaatgagcacaattctttagtaatcgttggaatcccttcactcacacatactttctcaaataaattggctccaacctgtgtttatacttatatgaagttaatcagacaatcaaactttgagcctcaaaacagtaggcattatagtcaatggaggggtatgtaaagaaagacaaaaaggaatgtgtttcttttatggtcaaactaggatgttcccccagttggcgttggatacataacacaaatgcatatttgtaatcttaagtaaatagaaggtaggcaactgtgtggataatctagctagaaatagcaaacattagccaaaaaaaaaaaaaagacagaaaataaaaagtcagaacggacaacagagacagatagacataataaaacaggaagaaaaaagggagggggaggggaatcaacaaaactgtagaaccagaaaatttcaaggaatttttaaaaatgcaaatatatttacatatgcatcagtattaaaaataatacacgctgcacccaaggggagttggagcaggaggagcaggaaaggtgatggtattggtggtggtggtggtggtggaggaggaggaggaggaggaggaggaggaggaggaggaggaggaaagaatggaggcgccgcggagccctgattatgcatgggctggagctgcctcttctaacctgttctcggagcagggcagcccgcggtcctcagccgcccacagaacaggagccgaaacaaccgtttccgaaggctacagcgtttatttttctcttttggggaattttggcggttgtttcaggggctagccaactggcccctttaattaaaagcttcaataaaaggcgatcgctccaggaatgcaccggcttctcttcgtgcaggatttgcatatttttttaatgccctaatttccttgatgtatgtaaatgtagccggacgtagagggagacagggagctgacgtcaatggacgtgacctcgcagctaaaccttgaacgtgaagccgggatgggggaaaacacggagcggcagccggtggagcccgaaagcatgtgtggctgtattttcggtggccgagccccagccggagctgccaagggctcccctagcagccccaggggaggacaagccgctgccccgtggcagttgccagccttcccaccacattcgcagactctggttctgctccttcagccccactaaatacaggttctttttttctctcccggggagggttggggagaaagaaagaaaatagaaaagaaaagaaacaaacacacacctaaaacaacaaaccgaaaacaacagataacaaaatcaacgaatcccaagcgtttcagaacaacgcttgggtcgcttgtccagtaaaaagattgacaataggacattattcttttttttttttttttcttgtctccacaagaagaggagagggagcaaacagacaccagcaaagcattcctgtaacacgatgtgctacacaagttcccagtagcgacaggtaaattgcccaaccaaatggcgagggcttctctttttggtacctgtttacctatgaacaaattatgtgtatcagcttcattaacagcagtgccaggggcgcaaaattttactgtagtgggagtgacgtgtgtgtgtgtgtgtgtgtgtgtgtgtgtgtgtgtgtgtgtgtgtgtgtgtgttatgtgtgtgtgtgtgttggagggtgcttagattggtcagcacagagggaggcgacttgagactgcggccagtctttacgtggccaagtctggggacttctccagccgagacagccgggctgaggctcgagcttccctctttgaagagataaacctgaaaaggcttcccttgaatggctaggcccttccgatcgcattgtccgaggaagggggcttgaggtgggagccatccccttggctgcggcttgccttaggggcctggtgttttcttctaagggctcagccgcctgggcgtgcggggagcggcgctgggagactcggcggggaggcctccgggctccggactccctgctccccgcgtgcccgctctcctgtgcccgcgcaccgggcgggggccgctggcacctcccagagccgagccgcccccgcctgcccttgccactggctcccagccgcgagggtttggtcctcgggcgcctcggccttagaaggacgaaaccgcccgccgcctaggaaggggcgctggaggccgcggtgcccgcgtccctaggcggccgcggctgctcccacctcgcagtcgcagctttgttttcctgacctgcaggcggcgacggggccggacgcctaggaggggagtgtgtgcgggtgcccgcgcgcgcgcgcgccgtgcgtgtgcgcggaggccgggggcgcgcgcggcgggcggggaccctccggccaaggacaggctgggctggctgtcctccggctgcacttggcgggaaagccggggctcggcggcggggccgcgcgcccgccgctctcaggacggcctcccttctcctccctgggcctcatttacatactgggggtcgtcgaatattttacagagcgccaccccctcctcggcctgggtcgcacacgcgcgcaggctacaactacagccccgggctcctccagctccgggcgcgcaaacaggcccgagggaacagccagccctcctcgggacagattcctgcaccgccgccccctccccctccgcgcccgcacccctgacagcctcctgctggtgttgcaggatacccaccttctctcaaagcccccaccttcctctacacacttcggcccctcctcccacatcttagcctttttggcacacacacacacacacacacacacacacacacacacacgagatttttcttcctgctcaacctttatcatgcgtgtcttgaaccttttgaataaaactggagtttagagaagaaaaatccttaaaatgtattccttgtctttagcgaaacacattaacaatcagaagggggaggggacttgaaccaaaggacctttctttaaaaaaaaaaagtctgcaagtcaaaaggtcattctctaagtttgtaaataatattgcaaagagaagccttaaagaaaggaaagaagggaggaaggaaggacgggaggaaggaaggaaggaaggaaggaaggcaggcaggcaggtaggcaggcaggcaggcaagcccacaagttaataaaatggagcactggacaaacaaggcagggaattcttattttaaaaaatatttttaagaaacctagagcagaaaagctggtgtaagaggggggaaaaaaggtagaaaaggcaaaaataagtttccaaagaaatgtgttctttgcatcctacaattgaaaaaaatgtagccattgcccttcttcagacgagccatttctaatttgttccgtctgtcaggaggggactatgagaggtttgggtgcaaattcattatctctggcaaggcagagcgtagtgtggggactgaaaaagaccgtggccatggatgaacaatagggcttcagttcatcactaacaaaagcagtggggaaattggttgagtttcagagcacgtcctcctcggcagagggggctggactagaccttggacagcccccccaaaaacttgccgagcctcacacaccacttcactctgcactccgaggctcagggagcaagtgtttggagtgggggggaaagttggctttttttccccctccttggtctttagcgcccttttctctccctcagaagagaagagcgacataaactattttagacgcaatcaaggaagaatcgcccatcatgtggaattgagcggcagttttaaatgtactaagagaagactggtctcgaaaaaaaaaaaaaaaaacatttttttccccttctttttttggagacgcctaaaggagcctgtttgtgtgctgtgtggccacgttctgctgtgactggatcttgtcttctgcctggctcctcgatttccgtccggctggatttggggacaacactgcctggcgcagacagatcaagtgagtatcttggcggcatgaaggctgcatgcttccccggttacgccaggcccgcagctcccgtggtttgtccggcacccacacaagggcctggcgagggccgctccgagggccagtccggggctttgcttcagctaattgattgtatgtctccaataccaaacctgttgaactcgtgagttgtccgagccaggactgttaattatcctttgggcagacccctaattttagaaaggtgccaggaaaattcgcacagggaaaagaaaaaggacgtaaattaatagtattggtggagagactttcttctcttagatgccgtgctaagtgaaattgggttttgcgtttttgaattctgtattctcattttgaatgtgctgtttttgaatagcccccaaagtttcagttacctggcactgaagtcacggtggaaaacttacgtaaaatagctcgttgcatctggtagattctcctccccccacacccttttttcttccactttttgggttttggaggtgagagactgctttatagggttactccaagtttagctttaaccgagatgcgaccttcgtggttagttattgggacttggagctattccatttcagatgcctctggaatcggagcgaagcgagttctcttgcttaagagccaaccaactgaaggcaagatctctttcggtggttaggaactatctgcagaaaatcctgagcaaagagtacctagcccccccccccccgcccccattaggatctgccgcttttttctcttgcaaatgtgcaggcggtgtttgaatagaatactgtctggaggggtcagggcaattcagtggaattgatcagaagttagaccccaggccctgtcatgtcacggccacggccgtggggtgggggtgggggttaaagctgtggctgtcttgggtccacaactatggagtcagatcgttttctctctctcctggcgcccacacctgcccaccacccttcatctccaccttggcaccagtaacgagggcgctgttaggaacacgccacagtagtcagcataattgaaccggtgaatactttcattttgcaaaacaacagctccactcctccagtccaaaataatagtaagcatcagaaaatcatttttaaaacacgcaacctattttcgggagtatgtaagatgtcctaatattgtatcgtggggtgtgggggaagggcttaaaaatccaccactttacagcaatcaggttttacattattcattgatttactgaaggaaagagccaatcaggagccatagatatgaatgcacatttcactgtgctggagccttacagtaaactatttgcatctttctcatggattagacatttatcctgggattcccattgtttgaaaggccaagaaattcagtctcttaaacatttagaaaacaagactttgttccagacttaaaatccttgcatggtggggctctctcttctcttttgtatgggaggttacaaggttcaaatccctaatgtttcttaagtctctcttctttccaagctaaaaataaaaggagaaagaaaaattaatttcccaaacccctctagatcctgcatattttgcattcccattatcatgcatgtctccatttaaatgcaaattagcatatttaaccctgtaggtgctaaggcccaagatagacagtactggtgttttatataatctattggcattaaaaaaaaaaaaacacagtaatagtgaccctttaaattaagtcatattcctatataatgatatatatatatacatatatatatatactgtgatcatttgttttattgtctgtttttcagatgacacttcaaagaagcataaaatgaacagactattcaaacaaaggtaatttacatttttttatttgataaaacctgactgatgtacaaaacgaaaatagaatattgtttactggaaaacaggtctacaatctctcacacatcttctcttgcaacagatagaattccagaaacatctaagttcctctgtgtacagttatttctcctgtaggagcctttgtatggatgtaatacacacatatatgtatatgcatagagcatgacataaataaaacctgcaatagcctataagaaagaagctcctatttagaggaaagggtaagatacttttattataatgaaagccagttcacttcatcacttggaccatggacactaatgtaaataaaatggcttaaaaaataagacaatagtagtattgactgtagactacaatttgcacatttgtaattcttataaatgaaatatttaaaatgatttggtgttgggccagttccttatgcattctgcattcatgtgtataggattcaaagacgttccaaatattgatcataaaccaagtgtatatgaattaattaaatagcatatttctggcccaaatatgaggaaaaccataactttttactgtaaatcaggagagattgttttatccccaaataaactaggatgtttcaagtcatgtttcagcaatttggagacctacaaactatctgcaagcaagcacaacaaccatactctaatctactagatagtagtgagaatttagtgcttgaattcaggctgcttgaattcagtatatccttctctatgctgattttcaagtagatattctgtagctcagctagataatcttttaaaagcaaaaaaaaaattaagtttaaagtgtagttgctaagagctgctcttcacaggtgacatcgctaggagtctttgaagatatgtaattgtaacgtattgtggggtatatataatacatacaataaaccattttataaaccttggcaatcttataaataagggggcactcgatgttaaatcttagtatatttaatttcttctgtgtgcctgtgaggttgatagagagttaaaatatttaattgactacattgctaatgaacagactacccataatcctgatcttggctcatttcactcattggagttcccatgatgaataccaagcgtggagaccggccttgtagtaagttggcatgactagtgttgccctaagaatgtggtatttattacagcatcttattcagattctagtgggagaagcgttcagatatgcagtgtgttaactcattgtagatattgtttctaaaaacacattttattgttaggtatgggaatagagtcataataactttcaaattcagaaaatatgtgaataaataacaccctcccaacacatagatatatatatgtagctagcacacctagatacatgtgaagaaaagagattctataagaccatttttgatttcttgggctttggcttacacagttgactatatctgatcacgtgcttattttatgtaatacaagccaaatcattaattactctgctgctagttcttggaaagcaaggccacggtgctctttaatcttccaagctgcaaagctcattaggatttttacatgatgtcagaagtggcatgcgcttcactgagttgtttatgctgtgaccatatggtttaggaatgaacaaaaactctatgaacatgcctttaggattggattgtagtgtccgtgtgtattttatttctgacttctcgttcataatttgaagagaaatatagacgaactctttccacatcttagtcttttctcaatagccagttacagaatgcttaccataaaagtaaacaaattaatataaggacaaattggcatctctgttactaagctgtaagccatatcttaattggtgtgatatgtttaaactcttcattggagatgtttcctatcattaaaacacaaaccaaacaaacaaacaaaaaaaacttgtcagtctcttctttacagagtttagattttagggctctgtatgtgattaaataaccaggttcttatttatgtgttaaatgaataaattagtgaattactgagaaaaattttattccaaaaaaattaataaatccaaaagtattttagccactggggaaaatagacacattatggaattgagagcattgtgaggcacaggtgatgtgtgcaatgtacatttagaattactaattctcctttagcatgtaacttaaagaaaagcaacattactaaaaaataattagtaatttgaacaataatccataatgtttacccacagagaacatgcttcttatgtagattaccatgaatattttgttgagagggatttgaatgttagatattagatgtgctagacagattatctattataaaggatgagaaagaaaaggattctttgaagtgattttaaagtcacactttaaaaactcctaagacaatgaatgaagctaattaattaatgaaatgaccttctgcttctcgatagaaggatatgagtgggtggggccagggaggtgtggtagcttccctccctccccatccaggtgttggatctacatgttcaggagacaagacttttattttaattttataagcaagtctagtgcattattgtccagtgtgaaatttatgttaaaacagtagacaaaggctcagcatttttgctacagcagagttgtgtacaacattgaaactattgctgcaatgtttacctgtgcagcatgctaacccccacacacactctatatgcaaagcatttttaaaaaagaagccccactgtttagatcgtgcagttcgaacttacagaacaaatatgctgccctatcgccacggtacacagatagaaaacatgactgagctgtaaagccattaaaaacataacaccaaagcaaattgtcattgtaaccatcgactcactgcgtaaaaacagagctgattcccagccccagaaagcgaggccctgctttaagcaatagtaaagtgccttccatctgcctgcctatgcaatctgccagaagagaaatgcaggcaaagaagttccccagacctgaaatgcttttatctatccttagagagagattttctccattctttggatattagagcgatctacactagcgccaaggaggtaaaaggccgcgggttgcttttcaaggagcagtccgtagtgctagtggatgaaatgttgattgagaatatagggactgctgcaaagctgctgctgccgtcgccgccaccgctgccgccgtcgccgccgccgtcgcctgtgctactcctggcagcaggcgtggggcagttgggtgaccactgatgcatatcaataaccatgtacttgagatttctcatgacatcatcattaccttggtctcccgcagtctcaaacctttgaccttgccgggctggtccacaatttggcggtgaaagcccctccaatgatggcccttttctccttctttcagaccggggcagcagtacgccagcaagagggcatgctctgcccgcctagaagtcctaagaaatcgaggatctcccttaaaacattcacatacaagatatgtgcaatcaagctgcctgcacttggtaaaaaagatcatgatgcctaacccaatgatccggagcagatctttgaatcagctgtcacttctatagaatgggatttcccccttcttcctctttaaccagcgttggaaactgccgatggctttatacatctcagtagaggaaggctaaagaatcttccgtgagaatgaagcaatttacaatgcaaatagaggcctgtgaagagaaggacactgctgctcacccccaacagcttgctgcaccttagtctctggtcttaatttctgatactcatagatgaattgttggctaacgatactggagattacttgctggaaggggaaaagtttggaataaactctgaatgcaacagatctcatttggatgttctagccgcacacactaagacagaaaccaggtcatgtttacatgaaaggagaagcttaaacgcggcaagtaccccggaggactacgcttccctaaagccaaagaggatcgagatctggagttcagccagaggaaggcagccttgtgagggaagcgagttgttatctttggttatctagctgtatgagtgtattggtcttcataaagctagataaccgaaagtaaaaactccttcaaggtcaccgaggaacgttccggaaagaaagactgcaaccaagagacagtaaaaaccagaaaggtcaggaatgcttattgaatctaactttttttatcttatgattgaaagtgggatgcaagaaaattaagtgacacgcatattgaaatctaaaggggccaggctttgaggggcttgtacaactggagaggagaattgtgtagtgttttttacgggtgacgatgcatgtattttctatattgttcattttgaagcaaacgtttacatatgaggttttttttttctttttttttcttagaaagctgttatagtgatgtctggtacctcgcttaaaaatgatttcataattatgtagatttgggctgttcctatctgaggcccctcccccaagtttgaagcttgtgcctggaaactttctatgtatttgggtgtgtacatcaaattctgtgaagttagactttcagtaaagcttatactggaaggttaataatttatatctaccgaagacttagagctagcagggaaaaggggtgggggcaaaggctgatttttattcttctattcaaaatacaaggacagatgcttctctgttccaagagggtttccttgaggaagctactgaagcagaaagacatgatggagacgagatcgcctcccctcttgtcaaagtgttaaaaaaatgttctgtcttactctgcgcctagcattggaaatgaaagtgacatttacgccacaacccacgtgtgcgcctcctctctttttgtttaaggatgatcaggtctatccaggaaacagctctggcatcccaaactgaaataattaggacgtatatagacctgacaaaaatggaaagggggtggggaatctgagggtctgtcttgcctaattgattccgctaaacggaaagcaggagatgtgaacggcaggacgctccgattcccacgctcgggggcaagtggtaaagcctggccggcagcctatgacagacagccctgttggggggtaggggtatgaaaaaaacatcaagcacacacacaccatactcatctccatcgcttaagaaagtaaaggcatttcccacccacagccatctgcagcctcccaaatggcaacaccaactggttggtagctgctatgtactgtctctgttcatttttaaacctctgtttaatctggccatgattaaatttggatttctcctttggttgaaattttcaccatttaaggaaaacaagtggaaagggtgccaagagtgccccagaactgcatgcccttctcagagaagtcctcagtatgtggttagggccttgtgaccacctttggcttttgttttggctgtgttatattttaaagtcatgtctcatagcattcattattatgacttacttcatcgggttgtttacttccttgtgtgacacacaggaacttggcctacttatgctaatctacattctggaaataaagctataaagtcatcagtctgtagaaagttgattacaatcacaatatgttagagaacttgttttgttttagaattgtcctagcggatgagctttttttttcccttttccccctcctcttccttttcttcctcctcttccctcttcatctaaaagtcactagtcccagcataaactttgaggctttggagaaaccactgtagtccttttttgaagttccttgcatcctgttacattttatcaggcaaacatttgtataggcatttgcacataaatacaagcattgcaatgagaaaaaaaattccaaaattgcttcttttctttcatatggcctaaattactgacactcccaaatgcataagttttcttcagggacagtacatttttctttatagcttcaacttcttgtaagattgacaccagagaaacctgtaaagccactggtagtttcatttagaaaagccaagagactttaataacacaacttctcagtttggccgctgtacacgtgccaaagtttgactgctgtagaggcagtcgagaagacccttgcttatttaccttggaagcactgtttgtgcaaacaagctttcattgttaagtgcctgtattcctttcatttgcttcatgtccaggggtgctatttacctagaaccattgtctactacaattaacatttacattacaaagtgtgtgcttttctttctcaaggaggttcaattaaggcaataagatgtttgctggggaaacctattgtttactcaaagctctcaatggagtcacattactgaagtttttgcctacatcttgggtcgtttatgtaaatatgttaactataacatctaaggaaaataaacaatattaaaattatgtgtttgccattgtcatatccaacttgctttgtatcatactaatgttacataacttatcgatcaataaaaatacatttcaatgtta

SEQ ID NO: 268 - DNA, 33532 bp, Mus musculus
ttaatataacactctcttttattaaatgtggttttataaatgctctccccagccagggcacctttgccgtgctggaggctggaacttggcaaaatagtcttcccactgttacatctattgatacacattttttttttttgaaaatgagtctcggaccctcggaaaataggctgtttctgattattactgtgagagggaaggggcacaggagggcatcttttttcctctgataaattaaaaagactgtaacgggtgctttctgtaacctgtaaaagggcagagccatctgtgactcatttagcagcttcttaccgaagatttatttgattaattcgggcagaagagagagaatatggattttcccttccacgaaaggcacagacaccctcacacatgcacacacgcacccacccatgggcagatatctcaggaatgaaaaatgactaatcgtgttattggaactggtgagtgcagagcctctgtggtaagagagcaagccgctgccctgctgatgggagggcccgtttctgaacaatccacaggcccaggctggtgcccccgagtactcagagtgaagaacgctgggatgctgggctgttttgaggaagtaggatcacttagtgccaggtactccccaaacccctaggacagggacatcacagggtctcaaggacctctcaagcgagaaactagataagcctcttagtcactgacagaggcactatacctgcccagtctgccttcgcttgaaattctctttgcttttcctattcttccaaccactgtgctacatcccaggtctttcttgacacttttttttttagtgcaaatgtgtgtatgcacaggtatgttcacatgttggtgtatgtatctgtgcacatgtagaggccagagatcaacttctggtatccttcctcgggtgcttgcctccttgtttttgaaatagagtctcttacttagtgttgaactcgccgatttgactaggcaagctggccagcatactccagggatctgtttgtctttgtctcctcggcactgggattcatgctaccacatgctaccacacctgacattttttatgtgagttttaaggctccaacataggttcttgtgcttacacaacaagtgccttattggtttatgaaagcctttgtttttgtttttattaaagacagagtttactttctcaacccttcatgatctatctaggcagatgaaggcaatagcatgtgtttgtctcatggtgaatagcttgatgtgatcgctttacccatgttagctgctttattctgtgagattcagttctatgttgactagcctttcatagtgacttctcatctctaggatagctagcctcctctagcctgggctgtctccaatttacatgtcacagactcactcttacatgcctctaggtacatacagtccactgtaggccactgtcactggtggatggaaacggcttcaaaatagattctcagagaagacaaggaaaagaacaaaggtaagagaaattataagattgcaggatgtctaagcccaagagacctttggagagtactgtccagagtggccgtgtgtgaggagatggggtaccctgctcctttgcacagtgcagacatggctaattgatcccagatcaaaatctacttagcacaaccttctagacagccttaactaatgaatcaaagtcagcatgtgagtgtcttctaactgaatgtttcactctggagaggggtaaataggtcaagaattccctctataatccccttcttctggttccctaggctgcttctcagctcaagatgggtctagtggggcaggaagggagtagttcttcagctctattgaatgcctgattaactgaaaataacctttccgtaaaacaaacaaaccttgatccagggctctggccccaggaactgagggtgggtctgaaacatggcatattttgatggtaggctatcatagtttgatattaagggtatttcctttcttttcccttccttccttccttccttccttccttccttccttccttccttccttccttccttccttccttccttccttccttccttccttccttttgtagctgtcttcagacacaccagacgaaggaatcagatctcagtacagctggttgtgagccaccatgtggttgctgggatttgaattcaggacctctggaagagcagtcaatgctcttgaccactaagccatctctccagccccttaaggacattttcaattccctgtttagtgagtctgtttgttgagtctaagagaaaagttagagtctagaacttgcctttcagctcctggattggttgccccagctgctcctctctgtttctgctgcttttttgtgtatagatttatgcaggtgtagtacttcaggctccatctgactttttgttgttgtttgagatatggcttctcattggcctggaacttggaaactttctgtggagtgagcccagagattggcctacctctgccttcccagggctagaattacaagtgtgtgtgagctctggagattcattgctaggcatttacttacttagatctctccttagttcctatttctgaggagtcctggaaagattcttcagtcctgttaatattctggatttccacctcatatcaacaaaagtagaaaagtttactaacaaaattttattaaagtccaccacagcttcttgataaaagcaaaaaacaagcaaacaaacaaaaacaaaaaaccaaaaaaacaacccagcactgctagggacccgaggaatgaagcatttatgggcctcaaatcacattccttaacaggtttctgttaatcacacatcatttgttgagtaaagacattctgtatttcaagagaattgttttctgaaacatcattcctaatgtggcttatccatacagtgaaatgttatttacccagtaatgtatggatacattctacaatgtttatgagattggaagagggcagacacaaaaagtcatatgtgtgcttttgtttacatggaatgtatagaataggaaattccataaagataaaaagaaaaaaaaaagattagtggttgctttgggttgatggagggagcagagggaaatgatcattatggggcactgactttcccttaaggtgatgggcacgttcatgggttggctgtggtgaaggttgcatgcatccatgtatgttaaccactgactttcaccttgtgttattttttttttcattactgagggaaaacacctggcaacacaaggaaggaagactggtttgcttggctcacagtttgaaggaatacaatctgtcacatggctcacagtttgaagggatacaatctgttacatggctcacagtttgaagggatacaggctattgtgtggctctcagtttggagggacacagtctgtcacatcagaaaatatatggggaggaatgaggccactgctcacatattcagacaacagagacgaacgatggctcaggcagcttcctccttcttccttttcatccagtctaggacactagtttatggaatggtgccacccatattcggagcacaccttccatacccagttaaacctctctggaacatcctcacagacacacccagaagtatgtctcctaaagaatacaaatccagttaagctgacaattgaaggtttttacacaaactttaaatgcataactgatacaatatgtggatatctcagtgcagctattttatgaagtggttccctatctttgaagcaagtacaactatagtaataagggaccatggcaccatgggaacagaagagtgcttgtcccacccagaggcagtcttgtgagaaacacacacacacacacacacacacaataagtgaaccgaacttagactcagattccctctgggtagattagaaaggacttcctctatcaaaaggttgttgggagaagaaaagagataaggcctatgtagcatttagagcatggcgtgtcacaggccctggagacgatctgattggaaatgaaaagagtcgctggaggttactcctgaagctgtaacgttcgcagctcacctccattggatcagcttaggtcctgtgtgacgatgaaaacatatttgcacttctccgaagacgcctttattcacacctcccacggggctgtgaacatatttatgtcaaataataacaccattattctctttaaataacctgaagtgttttcagtggctgctggcaggagaactaaagtttccctgattccagtaaacctcccatagttgcttttagagattattatgtccatgtttgcaggacattgggcagaatgaagggctgaccctgcatctgactctgtcagtcactcatcaatggtacaacttaaggagattatcttttaggacttccttcttgtcagctatgaaacaagaaggtggtgatggtggtggtgggaggcatctctgaagagcctccaagcaaaggaccttagcttatgacaactacttatcaccagccaagtgaaccagactggacattttgttgttgttgttgttggtggtggtggtggtgttgtagttgttttccaaggcaagagtttctatgtatagccctggccatcctggaactcactctgtagaccaggctggccttgaactcagaaatctgcctgcctctgcctcccaagtgctgggtctaaaggcgtgtgccaccactgcctagctagactggacattttgaaggatatctcctacacattggacctgctgcttctgttccaaggattgtggataagaagctggcagcacactggctagagagacagcttgccatttgtgccctacacttattgatcctctacgtgggactgggtctccaacatctctcttactccagattcacctgtgctgatggacgagtcctggcttggaaacagtgcttatggagacatgttcaagttagtaagggatcgttaggatatcccttctcagcatagggaaatctggaaacagagacacagggagaaaaacaccatgagaaaacgaaggcagagcttagacctgtgttgtcataagccaaggagcaacaccaactgccagaagctaggagagaggtttgcaccagtatccttcaggggtctccagaaggaaccagtgttagccttctacccaaggagtaccatccaggtctttaggattgctgaagattgtggcatgcgttgtgatggtttgtatgtgctcagcccagggaatggcactattagaagttgtggccctgttggggtaggtgtgtcactgtgggtttgggctttaagaccctcatcctagctgcctggaagccaatattctcctagcagctctcagatgaagatgtagaactctcagctcctcctgcaccatgcctgcctggatgctgccatgctcccaccttgatgatactggactgaacctctgaacctgtaagccagtcccaattaaatatcatcctttataagagttgccttggtcatgatgtctgttcatagcagcaaaaccctaactaagacatgcatattggaatagtgatgagtgtgggcactctaaacgaggatacttgttccacctggtaccctcgtcctttgtgatgccctgaaatgaaaccagctggacaggatggcatctctcactctcttgtgatgactatggatgcccaaatgacagtctagcaacacaacttggatttctgtaatagagaaccagagcatactaacagtgcttattctttagacagctcttgaaatacatgtgtgtgtgtgtgtgtgtgtgtgtgtgtgtgtgtgtgtgtgtgtgtgtgtgtgtgtgtgtacgtgcgtgcaatgtaactgaacacagtctctggaagaggagaccccttatttctagtatacctttagatacaacctctgccaagacttgagactggtactggggcagttatgtgctagacagaagaagtccacactcactgctggtgacagtatataggaacacaagatggaacacacaatggaacttcttccattgataatagaacttagcaactaggagcaatttatgtgtcctgcaatagggattcctgtcttagactggccaggttagtgctctgcaggaacatagatcagcccatctttctttaggaccacaggagggggggctgaagcaatgcaccccatcttgcatttctcagtgtatgttgctgtctgtgtactttggatggaatcttgagctccctagagagtgctttagttagggctgcatcctgcttctcaggatgtgttcctgccccacgattttattgacttgggtaggaatataaagcatcttcactgagcatgtctaaagaattttggaagacctacaatgagagcagtaatatgttcagggccacatatcgcaccatgcaggatccacgtaccatccaggacatagagtagcaatcccagagactgtggctgtggtctgaatcccaagaagctacaaagcagcagtggcctgggtgagggagggtacatactcacagaatccttcccaatctttgtattcccagccctggggtggggagaatcatggcaggcctgtgggcccaggacactgccatgcaatccaggttggagtatcctagaccttcaaagaggcctgtccatccacacagccaagtaacgatatggaagcaggctcagcagaccctgcccacttctgttccttgttggagccacccgcctacaccccctactgcctttgatcttcatcccatttggcttggcccagattggaggtctcctgctgcgttgccccaggatgggtccccagctcacaaggtttcactccctggctctatcacagctcagatctgacctcctgcctgcttctctgtggcagcaggagccctctgaggtccccgggagggaacaaaggagaaaggtaactttggactgaacggaggagggttttgtacaataggaaatctatgtaggtgtgttctgctggtcagtgaaaacctcctccgtggctttctgagtcacgcaatgatggagccactgcagacagtgggcaggaattcaggattgggtaggagtctgctcactttccagctatagctgtttcctgccaaagagggcacagctaaacctgtggacctcttggtgcctcagtttgcccattttaaagatggcagcagtaagaacagctttgccattggattgtcagagggcctatgacaacacatgtgtaagagctccctgctctgtgagtttgacctgagctggggctgttttggaagctgctttggaagatcgccagcatccgtctagatgcgcagctgcagtgggtctgggaagctctttcctgctttctgcaccacaggtctctacctccccttttttacattcatctttccttcttcccctggcccccagcccagtttagctctgatgatctccgaggaaccgctgcttaccccagtttcctgtccatgacattcccagtccacagtctctctctgccccgggctttctctgttcccttccttcaattttaagaccctctgtaatctgacccatgtctgaagtcttagcttcccgaaaactcgggaattctgagcccaagttcaaatgtgagctgtactgctgtggcatttaaaattttcctatttataaaagacaaacaaaaccagactgtacctgccttacctgccaaggatgcttgaggtcccgatgagcaggtgagtggtagatggttgtaagctgtacaacaacttgttagttttgggccacactgtggcttcctttcttcagtgtttggtttatatctttcattcttcttgagggcctcatcaccctgaggtaccattgtccatatcagtaattccattcagagctgggcacatactgagtgctaacaagctgcctcattggctctcctggaattagtaaatacatgtcgtgatgtatcccacctctcaggtacggcttcccgggtctgctttcaagccccaatctcactggagctgttctgtatcccatgtaccataaacccagccaacaggtgctgaggagcccttagccaaagaatgggaggagtagatggatgaatggcctcatactacaggtgtgaggggacaggcagtgtcctctgaggtctctttaaagatgggagataccaggttctctctctctctctctcttaatctgtgtgtgtgtgacaatatcttatgtagcccagtttagcctaaaactcaaaatttctatgtaaccaaacatgaccttgaactcatgatcatcttgtaactacctcctgagttctgagattacagacacacaccaccacagcaggtttatgcaagtgttgcgtgctggggaaagaatccaggacccagggctttgtggatgctaaacaatctatcaactgagctatatgcctggttcctgggcatccattttcaatatcatggcccatattacaaacagaatagctttagagtgcctagaggagaggggtttccgtacaaaaatggagaaggcagctagggaggggccttatctgggtcccgtcatgtgcagaccaaatgtttactttaaaaaaaatgtgtattcagtacattaaggatggaaaggaggttagtatgctctctgcagctagggtagagcctagagaccgtggagggtccatgcagcttggcgctcctcctggagcctcagaaagtgccttccctgagtgggatgtgggggttgggatcccacaggagcagggtctctgacagggatcaagtgccacacaggtatacatggtggggtgctgggaacaaaaggcagtgggacatttgtggtccaatagctccctccttggacacagtgagggctatttcctcagcaattctaagggcatctgtgtatcctggtacgagctcctctttacggtccccaactcctattcccaggccacacattcctgcagctgtgctgaattcaaagtattttaaggcctgatggagttttatcataatggcactgcttttctttttctttgtttctttttcttccttttttcttttccttcctccctccctccctccctccctccctccctccctccctccctccctccctccctccctccctccctccctccctccctccctctctctctctctctctctttctttctttctttctttctttctttctttctttctttctttctttctttccttctttcttccttgtatctctttgaaacagatgtcagctaaagctcccagcccagatcaagggcaggttcaaggctttgagatggatgtgaatgtccctttaacattgccccatataattcccgaatatacctcaagtcattaccctgtttttataagagattctgagccgtatgctcgggaactaattaggcatacaacccaagccctcggatcaggtggcactctgttgaaatatcttaacctttcatgattatcttaatttagagaaaattcaaaacacattcagaagtcttagaaaatgaagtaagtaggaatttactggctagctactcttcttgatgtcaagattcttctttgcaagctcagcccaagtcttctggaagtcctcaggagtctcttacagcttgctgggatgtgatcagggaccgggcctgactttcccttccttcctcagtggcttctcttggcttgtgccaagccatgcccaactcccagatccaccatcatccatccatgggccaggaggaagattaagagtgggcgatgcacttgggaatttaacctccttttctgataaggcataaaataaggtggtaaataaccctgaagtttgtgttgtttggaaagattcacagcctggactcactgacctggcttcccattggccacagaggaggatagatatgagacctctcctttttctggattccaggtttattctggagcaatctgattaggctgaggttcttgggtcatttgcttccgtgtggtgtgtctccaaagcatatcagatgggattactacaagttctttgagctgctttctggctccatctttccagtgcctctactcaaagtcaggaccattctgtgaatgcggtcagtgctttaacaagttcctgacacagaggcttggctcatgcctgtgcttgagccagctggcttgggccagctctcaaaagccactcctgactgatgttcttttgataattaaacttttagaaaaaggtttccagacaaagtgcctggtcaaatttaaatttttgataagtatgcatacatatttttataaccccaagtgtattctaagtaccaaacaggacatggatatgccaaataattgttggctacaatccaaaattccaggttaactgggaatcttgtcttttacctattagatcttgcagacaaacttcaggatacaatttaatggagacagtaattttggaggttgccatcatggagcaaaattggttcagacccttcactggtgatacccttcttagacctcaacacaattccaagaagtagggccaggaagtgacctgaaactcagagatgtcaagtgactcccccaaggttgcctccctgcattgtactgccagcccagctttgctggacttcaaagcctggaccccttcgatgctaccccagtgccaagctgatggttatctttcctgagttctcattttcctagcttgatttggctcctctcaacttcttccccattttttccacaaatgttcaaggagagattcactcctgtcagatcaatgtcaccgccataatgaaaaccaccacccaaacccacggaggacgaggtctgtgggaccctaatgagaatggttccgattatgtagaaagcaacctcgtggttattctaaagttacaagtaaatataaaacatttagaaatacttggcctggctttttttttttttcaagtacagatgtctgactctctgccagtttgttattaaaaacgctatggtggttgggtacaaagattgctatagaaataaaagctgatgctctcagaacacttgctttgactttgcagagaggctggtgctgatgaggtcagagcagatggtggctaagaaaggctctcatcggggaccccaatacttatagctcacggtggctctttattgtcccccaaaccccaaattgtgttgggccacttccagcctcagctgctgtggttcttcccctccatctccagggcatcttccgaatcaccctgcatttacacttgccagacccttgtctaggggctctgtcccctgttataggtctggctggaacccttccttctccaccttctgtggtgcatacttcttccttctgccagccatcactgctgtcatgcagctctgcttgaatcttttatttcccgtaagtctctgacaccctcttcttcacttcatgtcttcccaccagaaagtgaactcttcaaaggtgaagtctccaacattgtatccatcaacctgattccctctagaaggtgaactctaggaaggtggagcccccaacattgtatctgtctgcctggtctcctaacaccagggcatcgtcgagtagatacaagttgctcaataaatatttgtttaacaaacaaataagccatcagagcacctgatgtcctgcactcctcagaaaagtaacaacctctgcgaactgcacctctcattgagaagcccttaagcaggggactccttatttctatgaaatttcctcggactgtgctctgaaccacagcaggggacacacattgcaactgcactcccctagtgtaagggggtgggggtgggggtggggcaagcataaaacagaagattcagggttttcaagcaccaacatggctctgacagttttcccattgcaggtatgtgtgttgaaaagacatggagggagacactgctgaccagttttgcaccttagatcatctggggttcttgtgggctttgttcttttgattcccacttgtgcctctttgtgcagctgcctgccattggtcctcaggattttcagactctttaaggacagacactggtctcatttctgggttcccaacatgcagtcctttttgttgatgttgttgacaaggccacacaaactcagaacctcaagtcttttgatggttattggatcaggcattctctctctgtgtctgtgtctgtgtctgtgtctgtctctctctgtgtgtgtgcatgagagagagagagacagagagagaaacagagagagagagagagagagagagagagagagagagagagagagagagagacaagtgccactgtgaaggacaaaggactgcttgaaggaatgggttctctcttccatcatgtaggttccgaggatgaatttggatcacaatgcttggtagcaagcactcttacccattgagccatttctctggcctcaccttgtattttgaggtatggtgtctctttggaccttgagaagtaaactcaagggtggctagttagcaggacccaggtatcagacttgggctctctatatgggttctgggtatgagtgcaggtcttcatacttacaagacaagcactttactgatggaacatcctcctaggtccgagggtaggcatctaatctggtgtcttcaggaacacaccattctacacactcagggaaagaaaaaaacaaaaacagccttgccctgcttcattcagatatttccctgttgagtggacgagaacccaagacaatgaaattgcaagactttctgtgcacacatctttccttcccaacttgcctgagtgttttattctaaaactcagtccaaagaaaattcctctaaaatttcaattgctaacactgaacacatgagttggagaaccagagattggagtggaaacaaagatctggttttgccaggtaaatgttgtcacatataagaacttgaattaccatttatctcagcttggtcataatcaacgcttgcctctcactcagggtccaaagccacttggaaaaggtggcaacaagttccagagcactgcgcacacacacacctaaagccaagagtcttttatttctgcactatctagagaacttggaaatgctctgcaggcttgaacaggaagcctgagaaatgagtatcactgaagccacaggctagatgtaaacactcctcttgtgtacagagcctggacccattacttggagacacacacaccttttgagtttctatatcaacggcacatgaggtggtgagatagaactgctgtcaatctttctaaggctaccatctcaaatgtggccttggttagcctggggactactgtcatattttcaacaactgatggctgtcagggatagagctcataaaaaagcttccccaaacttatggaggacagcagcgggaggaaacactccatcactggcaagtgacactaatgtattctattagatttgcttatcatgttaaagagcatattaaaaggaaatgtttggaaacgggatgccaggctgtgggatgatggatggagaattcctaatttggaaaaaatgtgctaagacaatatgattgatgtgagtgacctactttattttataagaaagtatgagttgcctcgggcccactggtacacatatttggaaaaagttgtgtttttttccacattaagtttttattaacattttcaaaagagcaaaaacaccatagaaggatgtaagtctcaacttgtcaatgcagatgtgtctgtagtcgcttcctcactgggagcatttctcagtcagtgaggcgtgcttgttgccaagagaacacctgacaagagaaatatgacacccctttccctgatgaaatggacaaggaaggggcgttatttatttatttatttgtctgtttatttatttatttattttccttaaagctcagacggatcttctggtacttatacatagctatcctggagtgatttacattttcctgggggctcagacaccttttgctgcaagccaagattgagactaagttaaccattttagctcaaccttaggatctatcccttcatgaaacagtcctgaggttgagaagttagggctctggagtttatttcaggccatggatggcaagaacatagttgatggcagatagaaaccctgctactggaagaaatcagaatctaatggggaaaaaaaatccacattaaaaagtagaggtgggctggtagtggtggcgcatgcctttaatcccagcacttgggaggcagaggcaggcggatttctgagttcgaggtcagcctggtctacagagtgagttccaggacagctagggctacacagagaaaccctgtctcaaaaaaccaaaaaaaaaaagtagaggtggaagaagaaatgcttccagttcttaagggctatttgtcaatttgtcataaatgcccaagattgctggatgccttacgttccagaaatctcacttttagaaacttcttgtaaagcaatcatttatgaagagagacaaatgttcactatgtaattattgacaatgttaaaagatggaccaatctaaatgtcggatatcagggaattgcctaaataaacataggtgcttaatacagagttcatgaaaaaataatattaagaataaagcagagaaagatttataatatgcaaagtgggagatgtgggtgacaaaatattgtgtgtattatgttgctctttgaaaactatgtatgttgcacatgtataacctaaccctaacccatatgtatatctatatatatattttttctctgtctttgcctcttggtttttccagacagggtttctctgtgtagccctggctgtcctggagctcactctgtagaccaggctaggcttcaacttggagacctgcctaggactcttgagtgctgggattaaaggcatgctctgtcactgcctggctaaaattccctttttaactgaaatcaaatacatgtttgagggaggtcatccagattttcagggggtgtttctgaagcacgggatttttcgggattttacaggttgcacttcctttctcctgcgtgtttcatttcctacacaagatacactttagtaacaaatgaaggcactattaagagaaacatgtgagagttagggatgattaactcataagcagcacttggagaattcacacagggtccctggatacaagctagttttttttttcttatattaggatgaacaacttagaaatatagaatggaaaaccattctacttactagaacaaaacaaaagcataagacaccatcaggactgaaaagatgactctttcatgcctcaaatatccaagacccggtcagaaccgaagaatgaatgtatcaaaatctaaatgtttctggttgggatgcttgaccatggtaaaggctacaacctttccccaaattattttatacaatttacacaatcgtagtatagtttaaaattaaagtaactggcagattgattctaaaaattatctcagagaatagatacgtaagaacagacaaaaaattaaaaaaaaaaaagaaaaacgaggtgaaattgttctagttgatttttaaaagtatgttacaaagtgaaacaacataaaatgtaacgtaggataaaatccagtaggccaatactataaaatataacacctagaatgaggcagaggttgtttcctacaacagaaaaaggttagctggtaccagcatggtgttggaataactgtttacttgtttgaagaaaaaaagtattttttgcttcatgacaccttcacagaaaaaaaaaattcaagttcattaaaggtgaacatattggttaagaatataaaatgtgcagaggagggctaagggataaaatatatccagaacccaagactgagggtagaagaaagacagacctcagactccacagcaggaaaacacttttgcttgtgagacaatctaggggaaattcagcctttgtgacaatgttaggagaagagtctccttatataagaaccatttttattttaattttgaaacagggtctcactgtgtagctctggctgatctggaatttactgtgtagaccaggctggtctcaagctcacagagatccacttgcctcccaagtgctgggattatagctgtgtactatcattcctggccatataaaatgtttcttggtttacatttatgtctctttgccactgtggtgtgtgtgtgtgcctgccacatgtatggaggttcctccagagacctgaagctggattgcaagtggagtgatcagcctatgaagttgtgagtataggaacctgagctgagatcttctggaaacatcaagcactcttagtcactgaactatctccctacccccatataaagcacctttaaaactaagaaaaagaccacatgggctggcaagatgtctcaacagggcaatgtactttctgcctagtctggctgcttgagttcaatccctgggactcacatggtaaagtgtaataactcatgtttctactatcagtcaatcaatcagtaaattaaaactgcaatttgaatgtttagaataaaaagaccatcaggagccaagacccagagtttatttccagtatcacaaaaacacaaagcaaaacaaaaatcgaaacaaaacaaaggccatcaattccaaggaagggttggaaagacggaagagagcttcctataaaggagatagagagcagcgctaagcatggcagtgatcgaacaaaaccagaatagaacatttatgttcactatagctccaatttctaccgactgtgtgtgtgtgtgtgtgtggtctgtttgcctaatgaatatacatagttgtcaacagtagcaggatgggagagttaacttcagtctgacttctggttcttccgccatattttttttctgatcatataaacattttgctgttgctattgttgagaatgggtctcatgtagtccaggctggtttcaacctcaccatgcaagtcaaggatgaccttgaactaccaatcttcctgcctctacctcctaaatgctggcttacaggcgttcacctctatgaccagcttgtctgatgctaagaatctaatccggggctttatgaatgccaggcaagaactctaccaaccacactgcatctccagccccttgtatattgtttttataataaaaacattacacacatgataaaaggagagtgacttctcagaagagaagagaagacccagagctgggtctcctgatgctcaggttcctgggctccaccaagcatctattcttcctactgagacatccacggggccacagtataatccactccacttaaggaggcccaggcccctgacagcagcactgttcctggaattcctcacatacctcactgttggtcctcaggtggaaataggaagacatatctctcccaaataaaaacgccattcacttatgttccaacgtgtcccatacttgacttttctgaaaataactttagttatctttggtatttccctccgagagaaatgcagtcacccttgcaattgctattattcccattttgtagaaagggaaactgagtatttggagagggatgatttttgcttggtcacatggttgaaggtaaaaatcatttggaacggcttctacacctgccacaactgcatttcttctggataaacacacccttcagcccacagatgcaagctgcttttatctgagattgaccaaaaaccactgtggagtctcttgacacactctggagtgacttccagctctgaatcctcactcagtgctgtttgtgggtctccttgacatttggagatatgcctggccaggccaattctctggtggcccacaaaaggcacaggtctaaagatgggacaccagaaggtactgtcctcctaagatacttattctccacatactggttcataagttggaggtttctttggttcccacctatgtccccacaatctactaaggactttgcacacagaaagtactcatatgacagtttggcggttggacggattggccagagagacttggtgtcttatctctagccctctcagagcttatgctgacctgagagcatttctgttcccacatgagtctcccttttcccttttgcaatatatgtgtgatgtagtctttagggacatgaagctgtctggcaaggtgaggagacactgcgggtatgtgtgtcagaggtcaaatgtgatagataacattaatcttcaacttgatgaagtatagaatgatctacgaggcaaatttctgagcatatcttcaagggagggtgaatggctgaactgttgtaggaagacctactctaactctggtttgcatccttctatggggtccaggactgaagagaaggtaatggctggctgagtgtcagtgttcatccctgtctgcttccttattgcccctgtgccttccctgtgatgatggactgcactctggtctgtgaatcggaataaatctctttccctttgaggatcgtttgccaaacattttttcatagccatgagaatggaaacaagtgtgtagcaagatccagagcagactgtaggggagtgtagcggagcacatccacacttctgttttaggtctgccttcctgtcagcccgtggcagatgcccaggaatgaatgtatggatggtgacatggtgacatccttccatagttttccaaagtcgaaatcagaagtgtaggactagaaatgactttataggtctcactatccaattctctctctctctctctctctctctctctctctgtctctctctctctctcagaatctcaaaagcagcaacagcttgcccaaggttgaagagaccatgcattaacacaagttgtatgagctgacttgaagacattggccaaagctaagaacgcctgacttggtatgagttaagagccaggggcaaccccagggagaaccagccctcatcctagaaccttcacattgactcttccagctcagtcacctctggaaaaggcttgatgctcttataaatgaagtcatatctatcacaaagatccttgaggctacttagctgagaaataattacatgtatctcagaactgggagaacaagggttcccatccagcaatccatgatgctctttaaaaaaaagggtttcgctataaactgcaggtggggtggagagaggcaagattttcaagccaggaggccatgttctgattcctccttttatgtcttggcaccgtctcatctatatgtctatatcactgtgtagacacattaaagcgacattaaaggagattaaaagaggaatgacagcataatcatactgcagtaactaaactggtcacatgcctgcacctccttgcttaactgcataggcagggcacagatgtgttctcgttgtcagcaattaaacaatcgggaagtacatggagtcaccagggaaagcgcccagttcacagcgggctctccaggtcccctttctggtcctacaacagctactcagttgccagcttagcgcaaacctctccagaaagtttctccaagtttccatcaaggtctgcgtgtgcaactggacatgcaggcacacagacaaatggcgtttgtttcagcattaacagaatcacattgtgagtttcaaccttcctgatgctgaggccctttaatacagttcctcatgttggggtgactccctgccccctgataaaattattttcactgccacttcataacgtaattttgctatggttatgtgagatgtaatgtagccatttgtgttttccacttgtcttaggtgacccctgaggaagggtcaggcaaccccaaaaggggtcttgacccacaggttgagaactgctgttctagaacttgattcccccccccccccgccttccttgatgagtcatggatatcttcccccacgatccttcagaaagctacctctgctttctgtagtcagaagcacttttcctcaaggcgaacctcctactaataaacataaaagttgtttttttctttttcaatcttagaaacagtactacatcatcttgagcttctggcttctctcagaaccagttctttatggagtcagccagctgccctactgcagagcatcatgaagagatttctcctattacatccccagtgcccagaatggtgcctcatgtgacatttttttatgcaggaagtatttgctgaatacataattggccgtaggagaaagatctagttgcaaattatttttacagtttttgtcaaaggcctacactttacaagggcatttttgacttccttcatattcagtcctcagaactacctcatgaggtcaagacttcctgatgaactgtggcctaaagtcagggtttgggaggcaaaggtcaaagtaagtatttatactatgattgtgtgtgtgtgtgtgtgtgtgtgtgtgtgtgtgtgtgtgtgtgtgtttgtatgtgtatataagtaacagcgcccgagttgagatccgaggacaaatttgggtattggcttttgccttgcttgaagcaggtttcttcccctgttttccactacattgcatattccaagctatctgacttgtgagcttctggtggtttttcctgtgtctacatcccatgttgtggtaggtaggctgggattagagaaagctacccctgcattcagctactggctgttccaaggattcaaactcaggccgttaggtttgtgtagcaagggcttttatgggataagccatctccctggtcccagccctaatttttacacatgcaaaagcaaggaagggtgaacacacacacatacacacatacacacatacacacatacacacacacacacacacacacacacacacacaagtgcttttgaaggagctcaggatatataaatgtgatagtctatgcctcatgcctagataactcaataaataattgatcacgtctgtcctttgcctaacatgtcctttccacgtgcctagggtcagtcatctacacacttgccaagttttacagtctctgaaatatcttccttgttttccttagagaacctcctgatggtctggccttccttcaccccccaggactttcttggggacaccacaggaagcatatgcttgctttgtatcattcaaatgtaatagccgcagctttcttctgagcattttcatttggacactgattctattacgttacagtaagctctcctgttccccggctagctcttgagagccagcgccagcactgggatggactaaatttgttaattgcaagccaactgcaaatgtccttgtaaatggtacatgctccattggcggagtgcaagcaacctaaaatttgtataaatatatgatttttaagtgatcccatgcttctgtgtttctgagggcccaaggcctcttaatctaccctgcactaagacagagccccagccacactgccggctccaccctttatggctctcaggaggaacgggctttttttttttctttcttcccaagaggcaggtttatgtttttgcctttgcctcttctcaaccagacccacctcaagtcactcttcaggcagacttcctgtggctttttttttccttttatatttctccccctttccctttgaagtggcaacttcccctcacgttacctttccaaacaatgcagaaaataagaacaaccaacacaccccagcagtgatggaaacaaaaactgtaacactcctggagagcactgacagaaggtgatatctcccacctgtgagactgcactggacttactgtgcaccaggtgggttctctcgatcagacagagtgctcctcaatggtgctgccatgggactgtttgttcttgaattccaaatgccagccaatgccggccacaggcagacacatttgggtgggggcagtggaggaatgttgctttaattttcttcatagcttctagtacttgctcagtacactcatgctcctattaaacttaaaattctgtattttataaggaggtatttaatggagctgatgtggattattaaccacttcatataatttgtttttataaaggacaacatttgtgaatgccaggtactgattagaaagaaagtgtctggagtccaaagctaagcccttctgtcttccttttttgcttgacttggactctgcagagaagtgcaatgtgggtggagagttttggggggaaacactacaagtgatggagtctggcaactgatggggactccccctttgaagaatgtggtctggctgcttaccctctctgaaactgaaaagggtgggcagcttgtcagagctcagcatctgatgggttaacagcaatcttccagtgtgttcctttcctttagtatttatgtaagattgttttattttgccaaggtataaagatctgcactaaaacactataaagtcttaagtgtgatgagttttggcaaccgcgtgcctccattgccatcccggagagatcagttagaaagcatgtccagctctctggaacctcccttcctgttccatagcatcatcaggttttcctgggtcaaagcttcctgtgagcagtacgtcctttccctcttatcccctagaacaatagcaaaatgtgtagacataatctaatttcttttctaaaatgtcaaaagttaacaaccccaaatgtagggtgatggcttctgggtagggggatttcaaggaccactaatgatccctttattctgtcttctttaatataaaactatacatcgagttttataataacaaagaaaataaagcttccagggccacggttctgtggagcagtgagcaatgaatacaccagcccgtggtcagatagctctctgattatttccctgttggcattcttggttttgactttgaacatgaaacaatctgaccaaaagattctacctatctcaagctctttacttgggaaaaaaaatacatgttttaaaacttggttgctcatttgagttttagtggtgtgtgtcagccaaatggcagcaaagaactgtgtacagttgtacgacaaacatcagtttgtctctgaagattatctggcgacagctgagggagaatttctgctcctctgttcttctgtttccgaaacacaggggtgtgcccacgaagaagggcagagacagaggcataaatacttcacaacacacgaagaagaaaaagcagctttgtgatttctcggcagaatgggaagcccaactccattggctaaaaggtcccatatgccttaactgagaggtttgacttaggctgcagggtgatgccaggtctctgtgtagacagacagtgggcaagcctagaacctcactttgtatgtcttcacttctctaaaatgggatgatggctagtgggaaaggtgatagatgtggcatattcaattcacagactagcagcttactggctcttctggacccagaataagtgctctggtgaggacttgggactcttactctgtatcttggaatcactgacttttgggggaggggcatgaattttaatcaggtgggtggtctttctctactccatctttataggcttttgctttcactaacaaaacatccatgtaaattagaggtgaggagaaaagggaaaagctattggagttataaagagctggacagaaattccaactcactgatttataactgtgttgcgacctgagaccagcacaaacaccagagcctcagttttccatgtggaaaatgggagtagcctccaagggctttgacgattgctccagttcatttccgtgtgtgttttctgtttagcacagcagctgagataagagccatcattgataggaatgaattgtctcctctgagatgccctggcaaggaggagaaatgaaactgactctcccctatctttcagcacacctgcgcagatgccttgtaaaccagggtcataggggctcagaacaaggggctttgatgcttacacaattagagtggagttttccaccatgctggacatggacaagatggatcacctggactgagaaaatgggccagatatgcctgaggccatctgggggagagctgcagccacatggttggcactctacagtactcctcatctggaaggcatgttcagatgctcaagagcagccaggcccagggaagtaggggctgactgttttgtttttagcaacaagcggtcacaatgccctccctttctccggtcattttagcacatacatagatagaggcttctttaagatctccttcatgtctacagaaacctttgcccaagtctccaaggcaggctcagggcctctctaattcctgagtttttgctagacaagggagctgaagccaactggtctggggtttagccaacttcattgtttcctgttacaaaatgtttacaataggtaaccattttctagagggtgtacttttaagaaaaaacaaatctggtagcacagacccttccacccattggttctttggtgaaggtcttcatctactttttataccccaatttcccttcccaatacctagggttctaaactgctgcttttttttttttgtctgtttatactataatgttgggacctttctcacgctcaatgtctcatcagcagggcctaactacccctcccgttacccagttgaatccttttgctggttctgatcttttaaatccttatttatttttcaggccctgcccttgcaaagagggtgctgctgaagtgggagatgggaggtgggggtagggtgacttggtgtccagcccgtggtattagtcttcaatccatacaaaagcaggctgaagttggaaagctttggagtcattttgcaatgagcattaacaacattgccagattggggtctagaggactgtgggactgcagtggaacccagaacccccacagattctcccacagcttggagcccatggcttgttgcctggagcccagaatctgaggtgagcccctcctctgttctcccagatgcatcagcggagcacatacttcactcttctaagtaatttttaattcatgacataattttgtggaatagccatccttagaaacaaaccagttcctatagtctcctcgagtagaggaggctaccccagggaaggaatatttgggagaccagagggacctggttgttccttattgccagatccgcttcctggaaatataattcgatccaaaggtatcttatagcgggtttcaaagaggtttcaattaagacttcgtaaagttagataaaaacaccaaatacacgcttacagggagattaaaaggagattatagggagttaaagattaaatatataccattgttctggtatatatttgcacacacacacaaatacataaagcatgcaaatacgtaccagaacaatgtatagtgcatataatttatataataactattaattaatgtgactataaattaacataagatgtcataaattaaacacttggtgaaaatcaatacatattatgtagtaaacagtatctaatgcaaacaaaataagttgtagatccggtgtgtgaaacacaattaccacttctgaaatacacaagatgtgttgaagttttttgtttgtagccgtgagaggcagctaccctggtgtacgtccctctgtgcatgctgcaccccaacctgtcacctagcctagcccccagagcccaccctgccttcaatgtggataaaaaaaccaacctcccccatcccctgatcagattcttgttggaaaaaccttagtgcagttcttcttacaaggatccgaatctaacttggggggaggggagggcacacatttcataaatgacccgggagggcacactcaacatggtcactgtaagcccgtttggtccctagagcgtaatgctagagttctttttcaaacacgaaaagcagtttaacttgctgtttaccaacgaaggcatttacagccaatttaaactttgaaatgaatcttcatttgcaaggtctgaacgctggagaggcccttcagcgcgatggttgggaaggcagtttcaagattgatgacgggttgaaaaagattcaaagcaaaacaaaacgcacaggaaacaaaaattgtattaaggacgctttcaggagttaagcggtttattgctgcataatagcagtataatgctgcatgcatttactcttcccaggaagaggaaagtagaaaaatacttccacggaaagttacccgaaaggcccccttttgaaagaaggaaacaccatctgatgaagcctgcgaattactaaagactgcgaattacttttctccggagtcacccaggtctggaacctggacatcagttgaaagctgggtggtgcgttaagcaaaacctcttttctgttttcgatgggaacaccagctcgcctgagctggtgtagggcagggagatcatggtacgcagcctggttatggagaccgaggctcaacgcgctgcggacagcgaccggcagcgccccggcagggagagcgaggagcgtttatttgcaatcactttaactcttggtggctggttctcttccagcgccctgtggcgggcggagtgttagacaagccccgtagtctgtagctctcacctcagagtcaatattatctcagatgggcacaatagactggaatgaaaagctaatattgaaccaatgtggtccctgctcgcgccgccgcgatgccaccctttgttgcgcagccccgggcgcagagctgctgtcggcccagctaagctgagggctgtggcggtcggggccttctttggcgctgggggcgggtgtgtgtattcactgtgggctagagagaccctggcgggttgcagctgctgcagcaccctgggagactcctcagcaccctcgccctggccaactctcttccaacttccaggggtcggttgtgaagaccagctcctagtgggaggagagctgcaccgagcttctctgcgctgtgacaaccgggtgttgcaaacaggaaagccaggcctagtaagttcagcttgtgtgtgccagggcccctgaccgatgtgagtatgccactgccacggggcatgggcaactggggcaccacagctaaaatcataagcactagaacgaagcataaggctacctgtttcaaagtctagagctgttggtaaggtgtagatactggagggagtgttttctgggtgtgaatattcctcttggggcatcatagaatctcccagatttgctatcccaacacagttggcaaaagtaaagagctaagaaagccccaaccactttcctttctgccttgttgcatccggatgttcttttgcccactagaggatgtttcaagacccctttgaatctctaacgggaaagacacgggggagccacacagataaaagggcttcctcctgagctctgagaaagctctcactcacatccttgactcctaactcccaggctttgctagctcagggttgggaatgtggctttcaggacagttggtgcaaaccatcaagcgctaggattacaagaagcaagatgcatgaataggccctgtggcttgggtcagtttgggtgacccatctgagggtggggactctttgctgaccttttgtgttggctggagtgtgatctctggaggctgggtgagaagtagcttgggctgtccagggttcctcatgatctaatcactgcaaagtggcacagtgtacaacttctctgaccttcagccttctcacctggaaaatgggcatcttaccattcgccacactttgaaaagttcgctgactcgtgggtgtgaaaggacctgcttaaagccaagttccacacaggacaggagctaatagtgtttcccaagtcttcctggcatcctccccagctttcaaggagagtccaaaagaaaaagcctggcatttctctttttcctcagatggctttaccccttcctttctaggtccagttctttaccctagaaaagtatggaattccagaaaggagaggcgactgctcagaatagcattctagagggcattctgttgtctattacatctagcaatcctttattttccaggtggagatccattctcctctgtggggttctggtcaaaagcagttggggacaaagctactagagagcccaggaaagtgcctgaaaacccccctccatcccctccacatcctggacctatgtgtgtcttggaagggcagctttgggatgactggagggggtggggacagagctatttcatttccttctggaaagtcacctgggcaagcctgtccatggtccctggctcctgcatccttgtgtgtgagaacatctgttttccctgccttgtttagccataatctcttatttgaaggcagctgatggagaaagaaacgatgacatccctccccctttgattatttctttgctttcaatgatgaatcaccagagctgtgtgtgctgaggattgacgagattcaatgatggcattaaagccctatgcccctggtgtgtctcccagagtagtgtggcattctggactgaaacgttggcttccagaaatccagaaactcacaggcaatgcatctttcctgcaagtcactcggcgcagcagaagccatgatccgggagagatgctctctccagagttcgtaccaccccctaagtctgtcctttgagcagtaaggctgacagtaatgctcaagccctcttcataccatccaggcttccatcaattctatgcggattctactgcttcacctcaagagaagagctcggttgctccgtgaaagatgaagtccgtgagtgtctggtggcaggacatgtcaccatagccccaacgctgccccttagtcttgtggatttgcatttagtgagatactcttcacctgcacaataatcaaggacccacccccgttcttccccgtcgcaagggggcatacatctaggagagctgaacctggcaacccaagttcttcccgaccccattcagtcagggtcactacaagtccattcctttaagtcacagtgattaagcaacgatatccgggtacttagtcatggagctgtgttcgccttgcgcagtaactagctatctcccttgcctagatagtccccgtcaccacgtccttgttagagtgtatcctatccattcctccttgctccctttagaagaaagcctggctcccagagaaggggaaattccagtgagggtgaattgagttgaagccgatggggacaggtgggaagcaaggtcaagtcccatgaacctcctcagaggttctcctctggttcagactgagattggtggcagtggtctgcaaccccttgcactctcagggagctcagagggcatcgcgccttctcgaatccctcgccactaggcgccgctgcacacacgcggatcgcggccctgggcatccctgcctactccgcgagagaactctggggacaacgccagaaagggatttaccgtgataattttaaaaaatgtttttaaggtcttaattctcttttttcgttttcccacagccgctgtagctttcagaggccggggagactgggatcacaattacagagttggagaaacttcgcagccagagctagagtgggccttctcaggacatctgacacaagcctgagggccactggtggtatacagtgaggttcactactctgggacactacagggtccaaacaccagcctagcaatgacgaaaatgtacagaacactaaaaatgagctaagctcacccaacctcaacaacttctaacacatttattcagacatttgtgatacacatctagttgtcccaggaagttctatccgttagagttgcttgatgctatccacccacccaagatagctctggggcctagcaaccccacaagcagagttgagggcactgcttctctgtaaacagaggctttgcaggatactcaaagcccatggttatcacagatcctcagagatcactaccctttgatacctgtagagattcaagaatccagcacctcctacgggaagcacagaggaacacggcaggcaggggtgaggttactgtggatgcctttttacagcattattgttcggtctgtgatgccctggctggaggcacataataacagcaacatccacgagaggagctggcttttattaaggttccatatgtgctagacactgtctgaacagtttgctttgccaatctcttgcaacaatcccaaatgctatttattgtattattgtttattcccatttggaggaagaggaaaaagaatcaaagaggatagcttagcttgcccaaggtcacacagtaaagctaccaatgtactgggggtggggtagttttattaggtataactacaaatagtaaaattcacacttcgtactgtacagctttgaaaacggggtctgtaattacctttactccactaaataactgtttgatcatacggccatacagaaactcaatggccactgctcctgtctgctttctagactgtacgggctgcatttttacatatgacaaaatgaggtcaggagagactgaggtgttgacgctggtctttcagtaagagacaaatgcattattagaacattcacatgtgtcttctagtcctctgcaaaaaccatggtgcccaatcccccagtgacttggagtgcacactgggcaaagagaatcagcccagctgtgtgtacaggtacttaaccaaacagtggcttcttgggtccttaaggaacctaggactagaattctgctaggccatctatgagctctgggtctcaagctggacttgaatgcccggagccctggtgcgcctctgctggtcagtgtggttaataagttactctctagttaattcctctacacgctgaggagaccagattcttccggggcacctctgggctgggagcatgaattagcatagattatttggcatctatggcttctgcacccagcctgactcaccggaaacccgcttttcttcttcagtggaggttgagcgagaaggggcagagcctccttgggttcatgtacttgactgccaaatgctcctgctgctcttgagcactggctacctgcagggcacccagagaccacctcgggtcggcaatctaatggtagaagggaactttgcaagaggctggtggcttgctgaggatcatgaaactggtgatatgcccctgcctcatgcaagagactggaggcccttgtctgaagctaggtgctcattccctcaagacatttccccagtacaccctggtacagagaggtgagggatcaagtaagtcccaccaacatatgggagtttcaatcaaatcttccaaacaggtctggattccttgccgctcaaagtcaatggctgtgatacccacagccaagcgtactaatgctaatgatgctaatgctgggggaggtatttggttctgagtgaagagtttagtggtcctaatttgtagtcacagcattgcagacccattcaagacaagactcaccttctcaccctcctccagagtatctgcagtgtgaccaagtggaagcgtttgtttctagcgtttgtttctagaagccctagctcctctgaatcttgcttgactaggcatggcccaagacttccgcccttctttgggctccagtcttcagaggcacagcctctatttccacaacccagatgaaactagggagagatttctcagctatatttggggtctggttcaggaatgaggagaatgtggcctcaaatgcatacccttttttatagggctgaatctaatgcccataatctctgaacttgcccccaaaaagggacaaagaaagaaggccatctagaatagaaggtgaaatgatctgaagtctaaggcaagggcagatttataccacgaggagagcaaagctgaggtggaaacacttttctcaactcccattctacctaggggctcccttgagcttctgccttctcacatgaacgctatacaagaaacgcacacaacctgaacagcagtagaggaaaaacaaaacaacaacaaaaaaatcaaaacaaaaaaaaaaccccaagaaaccaaacaggagacctctccttattattattattgccgggactacctggagcgtcctaagacccagacccttggtggaatcaggtggctttcatagtccctctagaggacttcacgtctgtcttctccagatctgcttctcccgggtctcaggcaacctagccaccaagcacagatattttatccctcttaggataaatggcttcgacctgggagtaacagatttaaaggacgccagaaaaaaattatcattaattgtaaaatacctgctggtacttcactttagaagaatgtaattggcaaagggtgtgtgtgtggggggggggaggcggctgatgaatagataatagatctttaaccaccaataaacagagagcagcgccagcaggctggggggatgtgatcataattatgcctcagcgtgagccaatggggacgagagaagtcggccctaaaatcatcccaaaaccgaaggcaagctcgaaaatgcggacagggcctaggaccggagacacaatcctaagtgccaggttgcgaaacctggatttgtagagcaacccagccctgggacaacagatgtcagaataaaaataggtacagtaataatagcaataatgggaacagtgtcaacgccactaaggacaatggaacgataacacagtcataacttcagcttctgacctaggacccaagactcctttcccaaataaccccacatttcccagaaagagctgttttggggacagaagtgaccaccctccagaaaggataagcagaaactcttgggtgcaagctggaagtccactgccacggtacaggcgcagctggcccctcaggtttgaacttaaaaaaacgaaccagccgggtcaaagactgcaaacgcgtggaccctggaacctcgaagctacgcttggttggaggggtgggaggaccccccccctcgagcgcctaggaaacctcgggagttttgctgggggtggggattggtaggagtgaagcgggttagcccttgcccggaaccagtccccgcccgcttaccctcgccgggcgcccgaagccatctcagtgacccgggcgcgggcctccaggggacaaccgcagcggagcttagggtgtgaagaaatctgcgtgtccgtccgtgattcagtcccatcagctccagcgccgcaggcttaggatccaggggtccgcagcaaaggcagcgcagccccgagactctgcagggacccgggtgccccggtgggagtggtgtgggtgcagtaggaggcggtggctgagggggaggaggagggggaaagaggaggaggaggaagaggaggaggagaggaacgaggaagaggaggagaagagggaagcggaggaggcgaaggaggaggagagaagccgcagcgggcgccgcaggagcgagggagctagcccggagcgcagggcgaagacaccaagaggtcggcggccgggcgggcggctggaggcacagccggggcagtagcgccgactccgttccattctgggcccggatccaggcctccgggttcccaggcgttcgcctccctctgacgcactttaaagagtc

SEQ ID NO: 269 - DNA, 35276 bp, Mus musculus
agagctcttcctccctgtgacagggactcgcctgcctcccagagcctcccggagcacaggtaagccctgtatgacccctgacctgccctttctacagtctaaccactcttatagctgggcaagctgctgtcgggaaggctgaattaagtagagcagagggtggacacctgtagattcctgggaatcttttccctgggaaggaaataacaggttgactatatttgccttggttcagtcttcaacaacaaaattcgtctggggggaaaaaaatcagctttatatgcctcattcctaactgtgggaggtcttttggaaatacattaacccaactgtggaaagactcgggtcgcaaccttgcctttcaggatgatggacaatctatgtatgtgacaatagatcaccgtccagagatctctctgggtcttctgcggtttaactaacatggcactcctcaggcagagtgggaatttcagggagctgccacggctgaggctgcttcgatcttttttgcccctggatcagttagatgggccctaaacgctacaatctcttccaatgtcaagtctggacattcctgctatcaagatgcttaggaggaaggtaggaaaagttgtcaggatagagaaccagcaccgcaagacacctacacacagagatgtgtgaatgaaaaggcaaggggaacaggaggtgtagagaaaggattgctgggagcagtgtaagaggctggcaggtggtggtgaggaagagaaaagccactttggagtatctttgcataagcctgtagtcagagcaaggggaagctggagcaaagggcctgtctccctggccttcactgaacttgctgagagaacaaagcaagcacaggggtggcttgggttaattataccactgcacccaaggcctcttctgcaccctctctccctttctctcttgctccttccttgagccttattttcttccttccttttcttctccctccattcattttaattcccttttgtctgaagcagagtcgcactttgtagcccccgcttcacagcctcctgggtcagccttagaattattggcatatactaccatagtagctcaggcttcactttaaagaaaacaagaggtgaggatttcttagtctctctctctctctctctctctctctctctctctctctctctctcactctctctctctcactctagctggttttgttttgtcttgaagttttactccatagttcagactacttggaactcaatctatagttcaggctgtccttgaatttgcagaaatcttcctgccttcacatcccaagttctgggctaagaggtgacccatacctattttaccagttatgatataaatatattcccagtcaccctatagcttctagtgagaaattccttcccaggtacataccttgcagagaactgagatcaagaagatggataggaggacaagtgtgtctgtccttcactacatgtctgagggagagagagtaggggcgtgcacatacacagactgagtgagccaggcagggagagaagcagagggaagtgacagaaagacatggaaggctagtaaggggatatagaccaaacctatttatctggaagctctccagataaggcagtaggggcattcagtatgggggagtcataccttgatgctttcacattattataccctttgacttgaaaattattgctaacaaaactatttatctcaggtactagtgttgctttagaatacaaacggaacgtgagaaaaacatcaaattgcaaaatcacttatggtaacacatgaattttacctgttttattttagtttaatgcgatttctctggttaaagacattggagaaaattgggggatatagttcagtggtagaactatatcctagaacacatgcgggcctagattcaaccagcaattctcctcccaaatgacaaagaagatgtaaaaaccgtatagcctcaaagaaaatgagctatgactcaccctcaaaatttattgctttctacagctgtttgaggtggcctcatcttttgattactgtatcttgtttacatggggagagagagggtgactggttacatctgagtctatgaatggaactcttgacatggatcaaggaaaagcaaggacatgaatgcagagaagacaagttcccatcgggaagttttcataggagcggtaagtggtcataattcatccaggaggaagcgtctcccaagtcctcgaggccaacgactgtcatccatgttgagcaagcctgcagttgccctctgttagtctaaagtagaacctgtaatgttacccagcctcagctggtgaaaaaaaaaaaacgagttcaggggtggtttaaaatgtcctggaactcccactgggtaatcgtgtgagagtagcagaagtctcttgtgtccctgcctgtgtttttaggcttaagttctggaattctttcttttttttttttttttctctggaattctttctgcacctgtaaaaactacctcaaatgcagcttctcctctggtactttgaccacacagatcatctctggcactgcattgtggtggatcttcctgcacaccacagaagcagttctgcagtaaacaccagctggggttctaatttaacttggttctggcatttaccatctcttgaagatgagagtcagaacctacaagctgaggactgtctctaagactgtcactgcctccattgccaactgcaaactctgggtggttttacttgtgattctgagcttctagctaagtaagaatcaaggttcccatactgtcccctcagatttccactaattttctgcaatggctcataaaagtgaaaatatgcacagtagatacggcataggggaaggggcatgggtgagcaaacatcccaccccaccccttccaagtaaatctttatgttcaactattcaaaaactccaaacttggtgcttttgagtttttgtggtggctttattacataataagattgaatcacggggtactggtggtcagctaacccatcagacctatcttgaagctattcagaagctgccggtcctcagtctcttcttaacacactatttttgccaagattccaagcagtttctgatttgtacaccaggaaggccaatgatgtatttcacagcaccacagcatggagttgtacattgttccttttcagtaagttagccagcttcctttcctaaatcagaagcaaggctggaggtgggagggccattcctaagcagaagggacagtaaatacaaagcctgggacaagagttcccagccaggattccttccctagaattgtttgatcaggggtggaggtggtggtaggttgcttggctctcaggaacactggtgattaacgacctatggccttcccttcttgcctagagcctgtctgccattcacgaattcatcttccaattgaattaggcatgcaacaatatctgaggtcactttgacagacttttggttgtgatatttttgtttgtcattctttggttcacctctgctaataactggtgccttcaatgcctggagtctgttgttccgtgttattgtctttcccacctcctgggaccttcaaatggtctctgtaccccttacaataatcctgcttctgacttgggtgagaattaaaacgtgtgtttcttcattctttcctcctgacctctgataccagctcatcatcactataataggaagaagcacaaatggaaccataccccgaatactgtcatcaaaggaggtcctaggtgctcatgcattggcatgtagacaaggtcagaaagctgaaaatgggctgtgatgggattggaaagaaattggaggattttgagatcagaaagaaattgtcctgaaatgtgaggaaacagaagcataaaagaaaaaatttgaagtttttatttccccttttgtgaactatacacactttcattaattctatagaatttctaaagccagagtctcagaggggttgtataagtgtaaaaccatgtttatggtggagcctcaaaagaaactgaagatccctttagagaggttattctaaacaattgcaagtggcattctttattaagcaatgcgggatgtggcacctctcgagctataaatctgtcctagcctctcttgacttttccagaagtcctaagtcctctcaaaggcaacgctgggctaggaatcagacagaaaaggccaagaggctctcggtagattggttgatgtgtttttcactgagacgtttacgacgactgagggcgtattctgcttcctctccaggacattcctacctttttgagtgtttcacttttcttggtttgtggcagccacaggctcatctgtatagatgctatatccctctccacccttcccagattgttccgctgtgttctccaatacgcttcttttatctttgcctgatgggattttgtttgcacattttggattctatggtaaaaaacaaactgccattccatactcttctgccacagcagtcaaaatggaagccttctgtgacattaaaaagcccatgctttgctcggcacaagcagcacacagtctactctgcactgggcaccagctggtgttctcaaatccagctcaatcctgatgctttccttgtgcagacatggtccaactccaagtgattttactacacacctactctcaattcataacaagtgatatttttgattgttgactgtgagtaatgttaacctactcctgaacagagaagattaaatttggtgttaattatggttgcagtatgggaaaatacaaaatcaagataccttgaaaatgtactacgaagtatagtgtttatttaactccaaatagatcaccttttaggtgtgatagcctgtgctgacagaagagaagatttcatataagaaagcatgggggggaatgagccatggtagaaaggcaaggattacctgtttaaggaaacttgtttgactctgtgtgtgtgggagggagagggtatgtgggggtatttgcgtgtatgtggtagcattctgagtgtggtgtaaaaggcacaagggctgcagcctagttcaagtgtacacctgtgtgagatgtgtgacccaccatggtctctgtggcattctttagaggtgtggccctgttgaagaaagtgtgtcactgtgggtatggatttttttccaattttttattaggtattttctttttttttttttttttttacatttttaaatctttttattggaaatagattttttaaatttattacatattttcctcaattacatttccaatgctatcccaaaagtcccccataccctcccccccccccactttcctacccacccattcccatttttttggccctggcgtccccctgtactggggcatataaagtttgtgtgcccaatgggcctctctttccagtgatggctgactaggccatcttttgatacatatgtagctagagtcaagagctcctgggtactggttagttcataatgttgtttcatctatagggttgcaggtccctttagctccttgggtaatttctctagttcctccattgggagccctgtgatccatccaatagctgactgagaagggtgtatgtggagttccttgatccacttagatttgaccttagtacaaggagataggaatggatcaattcgtattcttctacatgataaccgccagttgtgccagcaccattttttctttatatacatttcaaatgctatcccgaaagttccccatatgcacccaccccccggctctcctacccaccccacttcttgtccctggtgttcccctgtactggggtatataaactttacaagaacaagaggcctctcttcccaatgatggccaactaggccatcttctgctacatatgcagctacagacaagagctctgggggtacagtttagtttatattgttgttccacctatagggttgcagttccctttagctccttgggtactttctctagctcctccattgggggtcctgtgttccatctgatagctgactgtgagcatccacttctgtgtttgctaggcaccagcatagcctcacaagagacagctatatcagggtccttttagcaaaatcttatatatattggatattagtcccctatctgatttaggattggtaaagatcctttcccaatctgttggtggcctttttgtcttattgacagtgtcttttgccttacagaagctttgcaattttatgaggtcccatttgtcgattctcaatcttacagcacaagcaattgctcttctattcagaaatttcccccctgtgcccatgtcttcgaggcttttcccgactttctcctctataagtttcagtgtctctggttttatgtagagttccatgatccacttagacttgaccttagtacaaggagataaaaatggatcaattcgcattcttctacatgataaccagcagttgtgccagcaccatttgttgaaaatgctgtcttttttccactggatggttttagctcccttgtcaaagatcaagtgaccacaggggtgtaggttcatttctgggtcttcaattctattccattggtttacctgtctgttgctataccagtaccatgcagtttttaatcacagttgctctgtagtacagctttagatcaggcatggtgattccaccagaggttctagtttttgctaccctaggttttttgttattccagatgaatttgcaaattgccctttctaatttgttgaagaattgagttggaattttgatggggactgcattgaatctgtagattgcttttggcaagatagccatttttactatattgatcctgccaatccatgagcatgggagatctttccatcttctgagatcttctttaatttctttcttcagagacttgaagttcttatcatacagatctttcacttccttagttagagtcacagcaaggtattttatattatttgtcactattgtgaaggttgttgtttccctaatttctttctcagcctgtttatcctttgtgtagagaaaggccattgacttgtttgagttaattttatatccagctacttcactgaagctatttatcaggtttagatgttctctggtggaatatttagggttacttatacatactatcatatcatctgcaaatagtgataatttgacttcttactttccaatttgtatccccttggtctccttttattttctaattgatctggctaagacttcaagtactatgttgaataggtagggagaaagtggacagccttgtctagtccctgattttagtgggattgcttccaacttctcaccatttactttgatgttggatactggttttctatagattacttttattatgtttaggtatgggccttgaattcctgatctttccaagactttgatcatgaataggtgttggattttgtcaaatgctttctcagcatctaacgagatgatcatgtggtttttgtcttttagtttgtttatatagtggataacgttgatggatttccgtatattaaaccatccctgcatccttggaatgaagcctacttggtcaggatggatgattgttttgatgtgttcttggattcggttagcgagagttttattgagtatatttgcatcgatattcataagggaaattggtctgacgttctctatctttgttgggtctttgtgtggtttaggtatcagagtaattgtggcttcatagaatgaattgggtagagtaccttctgattctattttgaatagtttgagaagaactggaattagatctttgaaagtctgatagaactctgcactaaacccatctggtgctgggctttttttcgttgagagactattaatgactgcttctatttctttaggggatataagactctttaggtcattaatctgatcctgatttaactttggtacctggtatctgtctagaaaattgttcatttcatccaggttttccggttttgttgagtatagccttttgtagaaggatctgatggtgttttggatttcttcaggatctgttgttatatctcccttttcatttctgattttgttaattaggatgctgtccctgtgccctctagtgagtctggctagggtttatctatcttgttgattttctcaaagaaccagctcctggtttggttgattctttgaatagttctttttgtttccacttggttgatttcacccctgagtttgatctacttctctttctttaggtatgggaagttttcctctataattttgttgaagatatttgctggccctttaagttgaaaatcttcattctcatctactcctattatctgtaggtttggtcttctcattatgtcctgaatttcctggatgttttgagttaggatctttttgcattttgcattttctttgattgttatatctatgttccctgtggaatcttctgcacctgagattctctcttccatctcttgcattctgttgctgatgctcacatctatgcttcctgatttctttcctagggtttctatctcccaagttgtctccctttgggttttctttattgtttctacttccatttttagatcctggatggttttggtcaattccatcacctgttttgtattgttttcctgtaactatctaaggcatttttgtgtttcctcttcaaaggcttctagctgtttacctgtgttttcctgtatttccttcttaatgtcctccatcatcatcataagaagtgactttagatccacgtcttgcttttctggtgtgatggtgtatccaggacttgttatggtgggaaagtttggttctgatgatgccaagtaaccttggtttttgttgcttctgttcttttttttttttttttaaatatttatttatttatttatttattatatgtaagtacactgtagctgtcttcagacacaccagaagagggcgtcagatcttattacagatggttgtgagccaccatgtggttgctgggaattgaactcgggacctttggaagagcagtcagtgctcttaacctctgagccatctctccagcccgttgcttctgttcttatgcttgcctcctgccatatgattatctcaagtatttgctcccctcaatatatctgtttgatgcctctcattcctataatcctagttgattcaggactcctcagagtccagctttctctgttatcctttgcttgtgggctcctgtgaacctgagattctgggtgtgtcaaagttcttggcagtcaagttcctctgagaccctgaaatactggtgtgaccaagctccttttatcctgagatcttgttgtcaaagatcctgggtgtattacagtgcctggaagtgatgtctcctttgaggagcgtagagctgtctggtcagtggtcgtaagatcacgtggagagtcctctagggactgtgggggtgtccactaactccgctgccaaagtgacccagttttggtgcctaccggaagggcatgggtatgaattttaagatcttcctcctagctttttccttcctagctcctagacagtcttctcctgtctccttttggatgaagatgtagaactctcaactcctccagccccacatttgcctgaatgctgcagtgcacctgccttgatgataatggacttaacctctaaatgtgtaagccagcctgaattaaatgtccttataagagctgccttggtcatggtgtctgttcataacagtaaaaccctaagacagctttctagttccacttccagtgctcagaacaagtgctaactccagtctgattttctcaataaactgctaaaaagtgatttaatttgctagaccaacaaacagaactcaggaatacactgtacctacctttgtttgtttatcataaaaaatggattaaaaaaaaatcaaggctggggaaagtcactgacttccatgccctgtgagtgcaagtaaccctccactgctctccatgtgcccaggtctctgcaagccctaaaaatctcaccatcttgaagggtttgtggaggttttattgaatcactggtgtagggttgattgaatcactggtctttggtggtcaactgaaccactagccctcctcccttccctgagaccagccctttatcgtcccttcttgcttctggagaccatttccaatcctgaagcactctgaaggcttctagtccttattcaagtcatgccaaagacagggtcatcttggagattcctaggattgtgcatcagggagcagggttgaggagttagtatgtattttccagtatcatatccttcttcctttatttctctctatgttcaaaaaataactaaacatgtctcataattatatttattaaaaaatctcaaaaaaattctagaaatattggatattgctggtactttcacaataatggaattctcttttatataatccacattcttttattataaatctgtaaggtgtctctctgcccaattagacagtcatactacagtaactggtgatgaacaattacttctgagtgaaatgatgaaaatattttttgctactttgcatgttaccaaggtagaaggtgtagtttgtttttgtttaaggcagagttttgcaatatagtccagggtaaacttaagctccagtcctcctgcttcagcctccggagtgccaagattactggcatgtgccaccctgactagttatgtgggttctttcttaaagcatttttattaaacatgacagaggttcctagcctgatgctttgctgtacacttacatagaaaatgattactataatcaaacaagcatgcccatcccctttggttttaccatgtgttaatattttatttgtagaatagcttatagctatttggttcactgaaaacatttagtgtgggaagaggtcaaggtggaaagggtacatatgattttgctccactttcttatttggcaggcactacaaccagatgtttgctgtctgttgggcccagtagccagatgctctgatcataaacactcattatgagcagccagagctcacttacatgaatggatttctccccattcacagtggttttggcagtaacagttatctgcttgaaagacccatttatctcattacaaagtagagaaattccatgcaggaagttgatagaatcacccagtgttgtttctttctccccagaacattactttttagtcagaaattacctagggaagttaagggttttcaaattcctttaaatgttttattatatttatctacttatgtgtgcatgcatgtgcatgagtgtgcatttggtggagcacacatctggaactcaaagaataacttgtggcagtcagttctatcatgttggccccagtgattgaacttaggtcattaggcttggcagcaaatacctttacctacttagtcatcttcatagccctaaaattccattttaatcatacagtttcttctttgtttttcatttttatggctgtaagaaaactctcaaatgtataggtgcaaatttaagatcattgctgatgttaggagacaggtaggtaggtgatgtttccctcctatctgtgtgggaacttgaagcacaatagctctgactttatctttactgttaattttgaagtgtttggatacctatggccacccaaagtttgaaagtattacacggaagctggtgatgtatctcagtggtaaaagcactgactgctgctattagagagggcacatgattgattctcaacgtccacatggtgattcataactgtctgcaactccagtcccaggtgatccaatggcctcttaaggcatcggagggcacacattttatgcacatgatatacagatatacatctagggaaaacacccatatatatatatatatatatatatatatatatatatatatatatatatacaataactcaatgaaaacgtaaaaagaaagcattaaatggaaaattacaaggcatccaatggagagggctcagtgggtgcaagcatgaggaggaactcagttcaaatccccataatccatataaagtcaggtgctgtaatgtgcatttctaattctgtttatagatagagatagcctgccccattgtcacctagtattcatttctgaaggcaatgctgtgttttgtgttgtggtacagttggcaccagaggcccaaacaacctatgcaactacctgacaccacacagaagctcaggaatgcctcagaaccctactggtgctggtcctgggagaactgtgtaaagtgtggcactgttttgtggagaccttaggacagtccctaatttttagggaaactgatcctgtatgtcactattgtttactgttctcttttcactggttaataggctgcttcatgtggaaggagaaaggtgcttgttctagagcttctaggactcattgagggaaatgtgaagaaagacaagagctacttgaaaaagtttgaattacttacaaaaatccatggaggtttagaagcatctgggaagaatcaacagaagtagaaagttggaggcaaatggagtgacactgagagaatgtatcttagggttttactactataaacagacaccatgaccaaggcaactcttataagaagatttaattggggtgggcttacaggttcagaggttcagagattcagtctgttatcatcaaggagggagcatggcagctttcaggcagacatggagatgaaggagctgagagttcttcttcttggttctgaaggcaaacaggagaagactggcatccagggtttcaaagcccattcctacagtgacacaattcctccaacaaggccacacttcctaatagtgcctaatgcctgggtccaaccctattcaaaccaccacagagggctccacattgaaacaggatgatatattatttctagagaaacaactagaagatgtctgaatattctggaaaaaaaaaaacagattgatggctggtatgtagaaaaggatattgtcactagtagacaagttgaaactctcagattacaagcagctgaagccaaaataatgctcggggtagttcaaatcaaagaaaaatgacccaaaagatcaatatgtattactgtgaatgagaattaccaacttcaagaaagccagaaaaagcttctagaggaagctgaagtatgggaagagtaggtgaccagagtagatagaaaacacactaagaatccaaacaatgtgcagaaaagctgtcacaatttggaaaagtgaccaacaatcattccatgtttgctggccagttaagaagactgggacaccattgttgaagacagtgtggctgatggtggcaaagtggattcaaatgcagtgagccacaaaatggttctcagtttaatgctgaaggaaactcaaaaggaacaaattcatgtaactcagtgaggtgctcctttaaagacacccctctccaaagaaaagatggctagtttcatgtaggaatctaaagtaactagggcaaagtgataaccttacagagcacagtaaaaccttacagagagaagaggcacttttatagcagacatgcacagacagtgagggccagggacttcactagaaatataaagtacaatctaaagtgtttccagacacaaaacaaaatcccacaggcaattaagagaaaaaaataccagaaaagaagagaaactttacaaagcactcaaccacaaagcatcaaacagctgaagtgctggagagccacagaagatgaagccaccaacttgaggaactggaaagaaccatttgttcttttcaagaacaggtgacatcaagaaagaaaaaaaaaaaaacaccactgttagttagcagcttgagtgttaaaatcctcattgttctaagaaaagaaaatgctcacaatagacaaaagtcaactgaaagtgtgtctaaatttgaatttttacggaaatccttaagcacttgatattctaaatacagggagtatcagagtagtatctgaacgtggcccctcatcctgcatgtagccctgcactgtgggacagtgcattcatttgaagctagagcttttctctgtctagctttgctactgggaaggagagaaaggtagatggacaaacagcacatgctctacactacctgattagcaaccaaggagactccacctgtgatgggctggctcaccatcagacaacacctgctgaccctacatccccattacctccatgggaacaaggccaggctgtgatgaacccttcctcagactaaccacatccctaaaacaaagcatcgctaaagacaaagcacattttagcctcactttgacagaagcttttctaggcttcctgtggataatggcacaggccggtgttttcagaagtagaatcctgccccagtcataccaaaagtgaccttggtaatcacgtgttcctgatctctctctctctctctctctctctctctctctctctctctctctccctctctccctccctccctccctccctctctctctctctctctctctctctctctctccccctccctccctccctccctccttccctctctcctgaatcaagcatctggccctggccttgttcatccaactcagctcttcatccaatccctggtctacagtttctagtagatccaagaatgcttttgatgacaaggagtcctccttttcctccccatcttcaaggaaatatgtaagaagcttctataaatggcttcctaacaaaggatgtccctgtaccaccacagtgtagaatggaatttgtcgtcactgaaagggttcctcctggccttccctaggaccaatttttcctttcccacatctgaaagtagaagtaacttccttgtagtataaattccaccttcaaatgaaactaaaatgaagcctgacagtatttgatctctcttcagaagtagtttgacccctctctcatgttcagtgaagaaatgcagtcagaggtggctatactcttggtcatggtcaggctaatggaattacaattactatgatggtgatttataagtaaacatgattaaatataaattttagaagtagtatattttattctagatggcataaacattatgtttaattatctaaggcacttatatacacaataagtatgtgtggcttgactttcaaaggatgtatatttatgccatgaaacgcactgcacttattatgttgtacacaaatataaattaactctatactcatttaaactttagttgatttttttcaaaagacaagtctagaaaataaaaacaaaacgcaattaaacctttctctttttaaaatttacttacaatccatccattgccccctctcctggtcctccattccatagttcctcatcccatttatcctcccctcccccaccatgactctgagaggatactccccaaccaccaggcctccccactccctggggcctcaaatctctaaatgactgggcacttcttctcccactgaatccagatcaggctttgctatatatggccttggatcagttggtgtatgctgtctggttggtggctcaatgtctgggagctcccaggggtccaggttagttgagactgctggtcttcttatggagtccctctccccttcacttccttcagtcctttacctcaaccataggaatccctgacttcagtccaatggttggatataagtatctgtgtccaagtcagcttctggttggcctctcagaggacagccatgataggctcctgtctgtcagcacattatagcatcagttacaatgttaggccttggtgtctccccatgaggtggatccccagttgggccagtcactagactgcctttccctcagtctcttctccatttttgtccctgcagttccttttgataagaatacttctaggtcagaaaattggactttgggttggccttgtcttgaggccctgtctatctattggaggtcgactcttcaaataccctatctccactgttgggaatttcatttaaagtcactaccacagagtcctgagagtctcttacctcccaggtctctggtactttctagagggcctccctacctcccaccttctgaggctgcttatttccatttactctgctggctctttgggtttcttgcctgtctgctccatccatgtacctaatcctgtttcccctttccactctccttaccttctcccacacaaattacttcctctctctgcctcatgtgattattttcttcctcctaataagtgggattgaagcattctcactggtctttctgcttgttaaagttcttaaattctatgggttgtatcctaggtattctgtattgttttggctaatgtccacttattagtgagtacataccatgtatgttttttgggtctgggttgtctcactcaggatgatattttctagttccatccatttgcctgcaaaactcataatgcccttattcttaattcctgagtagtattctattgtgtaaatatatcacgttttctatattcattcttccattgtgggatatcttggttgtttccagcttctcactattacaaataaggcctctatgaacatcgtggagcatgtgcccctgtggcatggtggggcatcttttgggtatatgttcaagaatggtatagctgggtcttcaggtaggtctatttacaattttctgaggaactgtcagattgatttccagagtagttgtatcagctttcaataccatcaggaatagaggagtattcctctttttccacatcctcaacaacatcctcaggtgctttcacctgagattttgatcttagccattctgattggtgtgagatggaatctcagggtcattttgctttgcattttcctgatgactaaggactttgaatgcttttttaagtgcaggccattcaagattccactgatgagaatgcattctttagctctgtaccccatttttaaattgggttatttggtcctttggaggttagcttcttgagttcctttatatgttttggatattaaccttctatcagatgtggggttagtgaagatttttccattctgtggttgctgatttgtcctattggctgtgtcttttgctttacagaagcttttcatgttcatgaggtcccatttatcaattgttgatcttagagcctgagtcattggagttctgtttaggaaatttctccctatgccaatgagtttggggctctttcccactttttcttctattcaattaagactatcttgtttctgcttctaacgcatggaataatttgaggtgtgttggtattagctcttctctgaaggtctagtagaattctgcattaaagccatttggtcctgggatttttgtgatttggaaagtttttactaacttcttccatttccttaggatataggggactgtttaggtagtttgcctgctcttaatttaactttggtatgtgaaatctgtctaaaaagccatccatttcctctagatttttgagttttattgagtaaagccttttgtagtagaatctgatgattttttttttttttaatttcctgttggtgatgcttgtaactgtatctcctgtctctttcctaggtttttcatttccagggttgtgtccattttgggggggtgcgctgggagggaaaatggatgtggagaggaaggtgaggggaacctgatttggtattgggtgagggaaaaggactgaagcccttgagagccagcagaaagaatgtaaacaggcaacctcaggaaataggagcttaggggataccccagaatgcaccagagaccttggaggtgagagacttttaggactcaaagggagggacctttggtgaaacacctgacagtagagagagggaacttacagagcccatttccagaagagggcaggacatcgaatgagggatggggttgccatcccacagtcacatctcttgttggggccggccagcagctcacaagtccgggttcgagtctggaaggcattttggaactgaaagaaaagagagagcctaggccggttgagaaataatggaaccaagacaactagtctgctcaaggttcacatgtttaatggcggacaagctttataaaggagaggtgaaagcccgttcctccaattcatctttggagcctggaaccagctgcaggtgatgatgtgcaggatatggcatggtctccggaatagatcaggggggcctctcagcaggtagcagcatcttgaagaggaacagacagtggcagaaaaatagagtgatctagggaggaaggctccaccctagataatcttcttagtggcagcaaggtcaagttctggctcagcctgcttcaggcttgtgggaggctacaatctctgacccataattgtccctgtctgaaagaattacaaggatggaaatggagaggagcctgaggaaaagaaggtccagcaataggcccaaagtaggatccagctcaagaagaggtcccaaggcctgacactattactgagactgtggagcactcacaaaaagggatctatcatgactgccctctgaaggaaccaacaaacagccgagagaatcaaatgtagatatttgcacccaactaatggacagaagcaactgacccctgttattgaattaaggaaggccgaaaggctgaggagaagggcaaacctgtaggaggacccgcagtctcgattaatctggacgctctagatctctcaaacactggaccaccaaacagacagcatacaccagctaatattagccccccaacacacatacagtagaggactgtatttattcagagatgatgcacctagccctcaagagactggaggccccagggagtttggaggtcaggtggggtggggggtagggtcatccacgtggagatgggatagggttgggaggaagtatgggatgtggagcagttggagggtggatggggggtggggaatggaatatggagtgtaaaaaataaattaaaaataaataaaaaaatttaaaaaagaatcttaaaagaatcaaaatgtaaatttttatattaaaatcagtcgcatctactttaaatctcaaaaatgcaaatttactcatcagcaattcctattaaatcatatcaggaagctaagggcaaaatgggtataaaaaaatcaatcatcaatgagagtcaagtcagtttcttccctgaccataaaaggtccctagtttaactaataagagtgtgcctttctgaactttaaattcttccctaaaagttgctacatcaaagccagtagcaaaaaacatctcaatctagcttcactaataattttatttttccaactgttttctaaggttagtggtcactgctgacaatctacatctctaagttcttctctagggtgatgattgaatttttaatctgttccagcagcaatgcctaaaagagatcaatcattattattgtgtgtggcagtcatactgcccagtgaggggctgggagccccgttaaagttttcaatacaattcttagatcaagagggacatgaaggcagcaagcagagcagaacttcataacagcctgaagtcctcaggacacatggtcctcagagttgcacacacatccattgtggcagtggtgactagtgagccaaattccatgagttctaaagccctttgtcattcttcctacatggccctcagcaaaccagtaaacacaaactttagcttcttggacattgtgttgttttaattccttttctatcaccataaaacacataaacaaacaaacaccatgactaagaaatcataaaagaaagtgtttacagtatcagaaggtgagtctataccctattgccatacatcttaaaaatatattctatctaccaccccagtgaaactttagaagtaatttaagcacagaacatattaaagtcaggtcactccttaacaccacatgttttgttttgtttttttccaaacataaacagtgtactttattaaaaataaaactgtaacacaataacttagtaatgacaaaaatcaagtaacataagaagatacggacaaaacgaatgaagaggcattgcttcagctcacactagtgatctcctttaaacaagaaaggctgctagtctagtggttctggccccacctgtacaattcagggataaagaatcagtgcaaaaaaaatccaaaataaaacaaaaacctatgtgtaaagccaccttcaaataattgaatgagatctctctaggaccagggctcgagcagagatggttaaagtgctatcagtgttgagaactacaggtctaaagtaatatacactatataaaaaatgtcctcaaaacaaaatcagtaagctgaccagatatttctttcacctcagaaaaaggcaggaggggcaggcgtctgaatcctactgttctctatccattgtttggctatattcattgcctgtactgttttaataaacaggaaatagtgaaaggtaaaacacgctacccaaatggaagttctcactagtttaagtttccactcttttaaaacaaggttagctttcagaaacaatctcacattttaattttgcatagatactcaagtctcctatttgttcaaccaagggcacccaataagatgtactagcgagtatttatgagcatcagctgtataaatgtattcattccgtgtaccacaaataagctttgtggtgcaaagggacatttgacagaacaagtgtagcagacctgagggcttcctctgaaactgccaaaacctccttttccaagataagcatcttcaaagtcaagagcgtgaacaaaacttttcattaaaaatgcatacacgggaggagtcagtgttgctgagattaccaaaatgctttggagtttttaactgaatctaagaaagtccaaagtagatttgagactgtaaagacagaagctgcagcaagggggatccagtgccaatgcatcaacaaaaaagacaaccagagttagtggaagggaatcttcctgtctttgtgtttcccacggagctaatattttatgcagatgatcagtcaacacataaacaagtgttgactctgtacaatccctatgagtttgctttaaagttcaaagttttgtgtacgactccaaataagtatgttgtcgttgatgctgctggtgcagtgaagccacagagctgtgtggatattgtgattcgtcatagagatgtttgattctgtcactatggtgtgatagacaaattccgcctccaggtttctgaacaaagccagaggaaggccttgggaaggaaagaggttattgccacccttctcccgtctgctaaagaacaacagaaggaagaggagaagagaataaaggaacacttaaccgagagtgtgttttttgagtagtcatgtcaaccagaaaacagagccgtctcttcaggacctagtttgctaactgtcttcctgggtgtgggatgtattgcggccctgatgctgcttactctaggggatatggaatcgctggtgcctctctacctccacttaagtgtgaatcaaaaactagtggctgcttatatcttaggtcttatcacaatggctatacttagaacatgaacaaggattgaaactgacttctgaagcaaatttatcttaaaatatgaatgtggactgccttttatctctttcactccattaacacactacaaattattgaatgatttcaaataactgcaaaggtataatatatattttcaattagtctataattttatttgaaggactgtagcacttaatgttacagacaacaaagatacttctgagtgacacctaggaaattatttgagaacattctttttaaatctatacctgttgtgcaaataacttcaacgttattgttcatcttttttattttgaactcactttgataagggtcatgggtccttcaaagttttagatctaaatgaacaattgaccagcttgaaaatataaaatggcatttattgccgagacgcaagcaccaacattactatgtaagtcacagatttcctcatcattacaaggagctgctgtggtgtttctgaggggaaacagtcagtgtgtgaggggttgaaaacataaggtacttactgagcgatcatgcttaccccggactcttcaaagaagacaagatgtattgaaatgagcttgtgagctacacaacagactgtggttcagacaacaggcacctcacacaagtagattggtttttctgtttctaaagaaaggtaggcattttttaaattaattggtccatcctggctttacttctggttaatctttgatgtattaaggagaaaatcactttttgggtttctcccaggtcccttgcctgcctgagtgtaagtgacttgccctggttaggaatgtcagatgacaattcgtttctgaggacatgaatttttttcattcaaactcttaagccaagtagagaaagccctagatgcccgtgtctattttgtattggccactgggatgttttttaagtttttatttattcaaataaatttaccaaaaaaaaagccccctcagcacaacgacttccatttcttgatagtgttctgtggcgtctcacatctgtgtgtttaactgttgtcacagcagctggtctttctcctcttaggatttgtatctgaaagcacaatgcatcgagtctcttgaaaatcgaattctcttttagctctttttatggaataaactttatgcactgctaatgtagcattctcaaggaatatatgtacacacaaatgtatgcctgaagttgattttttttttttttggcagaaaacaatactctgcttgtagaagcgttttgtctagcatttcataaatcattgtttacccatttgtggagcagcaatcattcggtggatcatgtctgtacattgtgtaatgattgaaaggcacactgaactcataaagaaaacatgtttgtgaaaaaaaaatgcaaacacgaagtattctgcctgcagctgtcccacaccctcggcagctctccactctccattaggagattcagcagtcattagttatttatcccaaaaccctttctcagttttcaggtttgaaaaaaggatcacgtcaagtatggaaaaaaaaaaaacaaaacaaaaaaacaaaaaaacttttcctttaggtcgcctcaaattcagtgaattccatttcttcagacgcttcagtcaggactccatgtcagtctcaactccttcattcttgtcctcaagtgtttctgtcaggctgtttgcactcccatcttcaagagctgccagatcttgaagaggtggcagagggttcctccaatactggaatgtattatactgccaaaactcttcaggctggcagtgcaccctgtgggctacctgcgggctatcgcgctttctatgctgtcgccgccgcccgggcccggggttcctcctactcgccaggaggtggctctccgggctcgcggctacagccctgcagctactgtctgtcgtccccaccgccgcgtcgcttgctccgccatggtccccgcgtccccctggcgcttgaggggccgagccatcctagacggcgagacccagagcagcggctcctcggggatgtcgctgagcaggaacggcttccaaggcacgcggaacgtgagcgcctcagccgcacgccgcttggccatgggccagggacgagggtcgcgcgggcggcggccgagggcggaaggcgaagggcgaagggcagcgcggagctcggccctccagagagcggacgggacgttgcgggggggggggggggggggagccgccgcccacatgcttctttatgtcagcctagaagtcatagaaacaacatatctcagtagtaaggtccatccaaaattcagtactatttacaattaaaggaacaaggctttcctcttaacaaaactgactccagggttaggacagacatagggcaggtagttacactggatgaacctagaggctacaggagagccagaaaatagaacgtagtatacaaaaatggcaaaacacttacaatgtcaaaaatgtcaaaaaacaaaattgcccaaactggatcccttttatttcatcaagagaataaagaaagcagtgttagaatgtaagccaatgtaaaaataaacatctatgggtccacactggtatgactagatgaccgcctgggggagacatgtaccatgcagcattctaaattgttcatatatgcacgttcaggagaagaatagaatacagttacagccttctagagaagggcaagcagaaactctaccatggaagcacacaagataaatgctacctacaccagataaaaaatgttaatatcagcaaacataattatgctgatgtgtacttgatcaggttaaaatgatacctatgagatatttcttaaacccttaattccagtctacccataagaaaagcacaaatcaaaaggacattctactaaaattttcaccaggattacataaaactgttgaagttacctaatatcagcatggaatatatcagactgtgctatcagcaatcagagatctcagggggatgggctatgactatcacaagttgaaggctagcctagcatgtatagtgacttccagatcagctgagtgtcctgtctcaaaatagtaacaacaaaaagaaagatggaaaaaacatcagaattagaagacacaaggagacatgatgattgtaatgtgaggccatagggtggaaagaggacactgagtaagaagcaagcccacctgaaaattcagagaatatggacctctctgggtgactaggtatccgtatgagttcactaagtacaataaattgatgcatagttatcaaaggaggtgtgtggggtagagtttttgggaataccaaacagtataaactctctggaatctgctcaataataaaaaaaaagttattttaaatatatagccgtcttggactggagaaatgactcagtggttaataaaactggcttctttcccacgagacctggactagattcccagcaccagcattgctgatctcaactatctataactctagtcccaggggatctggcattctcttctggcctccttgggcatcagacatgcatgcagtgcatagacatgcatgtaggcaaaacacccttacacataaaaatgactaataaaaatatagcactcttacggctgagagaaggataaggtgttctgtatgaggtggagagagaaatggagcaaatataatcgacatgcatgtgtatgaattgtatatgaatttgccaaagaaagacaaaaatgaaattaaacactctcttaaaacttatagaaatcttaaatttctgattctcatggtattaggaactctgcctctgtaaggatagttgtgaggataaagggatttctcaaataattatttttattttcgaaagcttttagaaaactagtacaaccattgtggccaaaacacactgaaatagtataagtgatgtagaacaagttctatattatgtaaatgtttggaactgtcaatggtaaaacagtaacagtgaacatggaacacatcctatttagaagatctttcattgggggaactttgcaggtagctagatcttcacagcacatagtagccgacttgtccaatgctggtctctttctcaaagccttgtaatagactcttgcatcataaaattcagtttgtttagtgagctcagatttccatatgaattgaactgtatattctccccaaatatgttctggccctttgcctcaggtaacatgactctactaggaagtagtgtaactctgtgtgtagctagttaaagtgaggtcagagtatgaaagagaggagccttggttcagcttcacaggaatccttacaagttgatggtcacaggaagctccagagatagcggagagtgccatatgcagacaaaagtaagactcaagtgccaccccagaatgccaggagctctaggaaccacagaagctgaaaacagactggaaagagcattctcttgagcccttcacagagagttgcccaactgacaccctgatctcagacttattaagctttcagaattattagacagtaagtttctggtaatgtttggcatccaatttctgaaattttgttgtggtagctctgggaaactaaaacagtacagaatctccttagtatctatagaggcttggttccaaaatactctgtggttgccatgagccgcagaagctcaggtctttcatgtaacctgatgtaatattttaatataacttacacatgtcccttgaatgcttgaacttattctagattacttataacattgaatatcaatgaaatactatataaatagtattactaaacattgtttagggaataatgaccagtgaaaggtctgcgcacagttcctccagacacatttttcctcaaatattcagtatacagtggctaagtctcaagatgcaagaaccacagatgtacaactctgactggactcttgtcatttgttaatggatatgcacctattttctctatatttagggtctgagaaagtggccacaactactctactagtcctatgtagatcctaagcagacatggacactgcatacaacatgggaactgctctaagcaaaccagaaaccactggaaatcagtctgctgttgtacttacaaaaagcttccaggtgttcccactggtcagtgagacatgtagtaagaggttttgggtagtaagaaacagtccatttgatatcattttcttatcacatatgtaatttgaaaactatgtaaatagtatcaaataatttttattatttctctgttaaatcagtatttctgctgtatgcatgtgattgttccggtgtgtatacagatgtgtatacatgtataaatcagaggaagacatttctatcattctctgccttattttcttgagatggcatcgttttctattggatattttctttatttacatttcaaattttttcccctttctaggtctccccttcagaaaccccctatcccatccccctccccctgcctctatgagggtgatcccccacctaccccccacccactcccatcttcctgccctggaattcccctacactggagcattgatcaccctcaagcctaagggtctctcttcccactgatgtagaaaaggccatcttctgccacatatgcacctccatggtactgcaagccccctcaactccttcaatcccttgtcaaactcctcgagatagcatatttgaatcagaagtttggctttttggttagattggccagccagccagtgagtactcatggtttgtctattcattcccttcagtgatcgggttataggttggaacatcaacaatactcattttctttgggaactggagatttgaacttaggttttaatgcttgcacagtaaatgttctgacccattcagctccaaacaacttgtttgtgatgatttccaaaatgctggtgctcactgtcacacagaagcaatgcttggatccctgaatgctgccttctttcccttctcacactcgtgctctgagcttacacactgctaggaaaggtagcttttctacaagaagggttctcacacattcctcacctcctaggatataaagaactatctcgtaccctgggactccatcaacattgctcaggcttcatgaactctgattcatctagaggggacaaatgtgcccttcatgcctcattcagagcacatgtggtttataaagaactcaaaacatcatatgtctaaatgtacaacacatagggccagtgagagggcggagtgagaaaggatgcttgctgtcaaacctggtggtctaaattggatatttgggacccacatgctagatggagagaaccaagccctgcaatttgtcttctgaccacatacatcctatgttacataggccatcaaacacaaaataaataagtgcaaatccagggggttggcgttgtttcttttgttttgcaagaaaaagtaaatatacaactgacaacagaccccaaggcttaaatattcatgaaatttgttttcttctctattacatgtatgtgtgtgctgctagaggattttataaactgccttttggatgacgtgttttagtgagtagcagtgaggtctgaagtgaagcctcttctttaggttgtgtttcattccaagctaaagtcatataagcaggtcaatctcatgaatgacctcaagagaatctcagctttgcttcccctggctgctgttctggagaaagaattatagcgagaacaagataggttaggaggctgttatctagtcacagtcacagaagtatgatatctgggtcagtagacaatagaaatgcaagaacctagatgaatatttggagagggagtatgcaaactcactcatagtgcgatggagtggagagagaaaagtgcagttaagatgaactttttgatgtaggccattgtcttagcttgggtcttattgctgtgatgagatactgtgaccatgtcaactcttagaaaggaaaacatttaattgggggtgacttgcaattcagaggtttagttcattataatccttgtgggaagcatggtggcaccaagacatggtactgaagaggaagctgagagttctacagttaaatcaacaggcatcaggaagagcaagtcaaccattgaacctggcttgagcttctgagaccttaaatgccctagtgacacacttcctccaacaatgccataccacttcagcaattccacacttttgaataatgccacaccttgtgggctcattgggggccattggcattcaaaacacaagatatgcaagggataaagaatgctgctattcactcaggctgggaaacagggttggaggagctgtttcctccagaaacagccagaaagtccagcaatcagctgtatctctacattagtgagtgatctataaggttcccctggggagctgtagagcaagcaggaagttctgctagagctctagagccctggaaagttattagaactaaagcaagagatttgagatcagctatgcaccctacatggatctatgtgtttagtgctatatttatgtttttatagtggaaatctatcctagaaattacaaagtctttttttttcttttcagaaatattcccaagagacttgacattgaaagacaaattcataaagcatttcacaggtgagtgcatgctttattagtgactcagttaccaaaaaaaaaaaaaagactatataaaatccagtctatgacaatgaagctatggagattaatgtcgagaagacgcttgcagatcaactgtgtttcagtcaactgctattaacttgtatgaaccagaactcaataagcaacagaatataaaggatattttagaagaaaatagaaaggatgatttattgagaatcatatgactttgggattcattgccataaagagactccatgacaaaggcaactcttataaaggaaaatatttaattggggctggcttacagtttcacagggtcagttcattattagcatcatggtgggaaacatggcagaacaggaagacacagtgctggatgagctaagagttctgtataggcagcagaaggagactgtgtgacacactggacacactgagtgtagcttgagcacaggaggccttaaatcctgcccccacagaggctcacttcctttagcaagaccacacctactctatctaacactgccacttccttatctgcactgtctctgtcatgttactcagtagcatcatttgatggttctatgatgtgagacactgagaatgagaatgagaatgaggagtgaacttagatcaaagtgcactgcctcccactgagtttgggtgaagggaggaattctcaggccagttctttaaaggacaagaaggatggaaactacagttccatgatctccatgcacagagtgcaagcaatttgtttggaagacatgcctctgtttataataagcattctttcccattttccagggcctgtcacattttcagctgaatgtagcaaacacttccatcgactttatcacaatacccgggattgctcgacgccagcttgtaagttgtctgggcagactttagaaaaaaaagttatccaacaagaaatgcatataattttacatttcaacagtctttgggtgggacataatagactaaacattggatgagatgctatttataacctttcagtgcacaaggttagatgtactgttgaaactattaggaatgaaagatcatattctggttggaaatatttccaaatctaaaaacagccagatatttctaaagaccagaatgtttgtcaggactgaaaccattcatcattattcaaattccttggtataaataaagtactttttcacataaatgaaaaaaaagcaagctgtctatgaagtacaagtcaacatcttttcctaagttattttgagataaatgttgtttatatcatgtcatttgtacagtgtgtgctggatttttgtgaatgatgatagcctgttgagcaatgagctcttttgaatacttaagttactggagttaataataattccaaacatagcactaaaaggctatgttcaaaacttccacttatgatagtatactgttagctgagtcacctgtttcaaattcctttctaaatctaaaagttcttttcaatgagtaacttttgagcattgtgtttgttatcagctagatgatctttcagagtactgaactttacttaggatgttgagttagatttatatatatatatatatatatattttttttttttattaaacttacatttaatgactaggggaaaaaaaaaaaaaaaccacactagtcttgttccagtttgcttctctgttgctatgatagaactcttccccaagagtgattggggaaaaaagatttatttcagcttacactttaacatcacagtctgggagccaaggtaggaacttcaaagccagaactgaagcataggccatggaggaatgttgcttactggcttgttccacatggctttcttttatatcccagaagcacctttccaagggtggcaccacccccagtggcctgggccctcccacatcagtcattaaccaagaaatttccccacagatgtacctacagggttatctaatggaggcaattcctcaagtaagtttcctcttcccagttgactctagtctgtaccatgttgacaaaatgaaacaaaacaaacaaacaaacatacatacatacatacatacatacatacatacaaaacccaactcaattaaccaggcaaaacctcaatgcaaagacagtggatgacaacacagtttggtggagaaagggcagtttggggagttaaactctcagctgctatgagataagtcacattggaagctgtttgctcatctttaaagcaaaggcgtcaaatttccaaatgttttcccaggaatgagtaacaaaacccattgttaagcttctaatatgccaggtgctttaaaaactatggttgtcacatgaatcaatgacaataacattatttcttttgaattcatagcaattaattatatgtattattacatttaaatggttttcctagattataaaagatgtgctagattgctgacaagattagctgtgagtccactatgctcccagacctaggaaacttgtgctgtgagtattaatctgtctgtctgtctgtctgtctgtctgtctgtctattcattcatttatttatttttattattccaacagttaacctgttcctcatttcctttccttccactcactttctcctctctatggtgatggagatcagatgcagggtctgcacacaggaggcaagtgttttctctaccactgatctgtaccagcagccccatgagtctctattaagagaatgttgcctgtaaccccaaattcagaattctggcactcaagagactagatcaggagagtctgagggtaacctgctttactttattagtgaggccatgtctcaaacaacaacaaaaacaaaaacagcaacaaaacctcaaacaaacaaaaaaaccagaaaattttgaagagtccaagaagctggggagctatccttagcataaacttactaaatggatttttttaccctagttcaaactttatctaaatgtgctgttttagtgagttaattttaaatgtcttctaagcagttacattaaggaatataaatagtttttctcaaagccttaccagtccttagtggtcaaaaagacttcaatagttttcagtctcattagtatcatacaggagcattccacagatacacaggtgaacaactattaacaggtttatcttaaatggtcaaattcataatggagaaaatagtaggctttaaaactttaatttacatagtacacactaaaaaaaaaaccataaaggatattggcaagataggaaaacaattaggtggtcatggcggtgtatgctgtaattccagcactggagaaatagactcaagaatggacaatatagcaaaagcccatctcaaaaacaaacaaaagtcataattataaatacagggaagttgaagtgacaaaattatcatatactttagcccattacatggcaaagtgaaatgataaattcaaagttgtatgctggattaattattctaggtacccaaggaaagaaagtatttatttgtaaaattgtaacagctcaatagaaatggtaattgtcacgctctccagtcaagtcagtgtaacaggctgaggcttgaaagctgctcatgaagcaaaagagtttcacagaaactcgttcttggagtctggcgttctctctaacccatacattaattttctattcctgcgttagtctagtgtatggatctacgtgctctcttttaagattatgttattataagtgccttttaagattgaattctgacatagctaaagtcagtgttccaacagtcctagaatgtccttgagcaagaccttgggcttggaattcagttctgcccctggtattacactatcaccttgagtaaaagttaggtcgctgcccttcagtggcaggtaattatgtttaattatttatttatttttatgtcagttgatgctttgcctgaatgcatgtttgtgtgaggtgccagattctctggaaccggaattacagacagttgctgccatgtaggtgccgggaactaaacctgagtcttctggggtaacagccagtgttcttaatcactgagccgtctctccaaccctgataaattataattgtagtttataaatgtagattctacacaaaacaccgaaagagtctaatgtttttgctacctgattgtttctaatctgagttcttttccagtgtggtacaaagtcaattgggtgggggtgggaggtctgctctcagtaccatggataattcgctacaaggcacttggttcttcaggtcaagatggtggggagtggcagttctgagtaccagtattctagaaatattcccaagcaccttgcattggcctgtgtaattcagcctatcacagatttttgcacacctcacagacttctgaggtgctgaaactttcctgtgttgaaaacagtgaagtgtataattccacacataatactaaagtgctatcacacataattaaaatagtgattgtatgtgatgaatcagttgaagctgtcttgtcccattgttgctattcttattattttaaagcagccattgcaaattagaaacataagcactgtgaattctgaatattcacagccacaaaatttttccttgtgtaaggtgaagcaattgtgctaactcatttcagtatccactgataaattatatgaatggattgcttctaagctgctgcaacccttttgaattttcaaaacataaatacataaaatacattcaactattgaaattacttaaatgaattcatatttttccctttattggtttttaacgtattttacattaaacgtatgaagttcctagattaatataataattgggcttgttcctctcctaacattgtatgattatttaaaacatgggccttgggatgtagtttaaaggtagatcatgtacttgtgtttgcatcaggttctgatattagatcctgctaaaaaaaatcaagatggaaacagttttgaagtttggtggtttcttttgtaatattctgtgtaaatgcctgtttcagattactatatatccaagatttcatttacttttatcttatgtgtatgtgtttttgcccatgtgtgtgcctggatctggagttgtaagctgtcatgtggtttgaactaaatttcctggaagagcatccagtatgtgtcgcttttgagtcagccctgtttcagattatttattaagtggttataatcgcaagtttaatacgttttagaagcatttttctgtgttacatgttttctgtcattaggaagattataattttccttctgtataaaattccctcctctgcgtctgcatactagcctgcttcctcagcatatttcaagaaagataatctaaaggtgggcatggtggctcacgcctttaatcccagcacttgggaggcagaggcaggcagatttctgagttcgaggccagcctggtctacagagtgagttccaggacagccagggctatacagagaaaccctgtctcgaaaaacaaaacaaaacaaaaaaaaaccaaacaaacaaaaaactaaaaatgaaagaaagaaaggaagaaagaaagataatataaaatgtaactgtaaccattaaaagtgttaaaatattttgtattttgaaaaccagtttcttactatttttcttctcttttccacttcagacatttcataagaagcaaatataatttgaagaaaaagtgcctggaatcatatttaatataaaaaatggacatgtttagttttgtatgaacttgcatgaagtaacttctcaggagaaacctatgagtggctacaggaagaggacgcttccctggcttacgttatggacacaaaaagttagagtattttttaagatcacatattgtaaatagaatatttaaaactgtgccttatttttgctaggaatattatttttatatggttaatattgtatggtaaatatttaattatgttaattgtatctcagtagtagtgaaaaaataactattgcatataattttagtgatgtgtttgtcagatattgtgttcagttttttaattcttatttaatatttaaaagcttttattaataattttctgtccttatttgcattaatttgaactgtgaattttattaaaacagg

SEQ ID NO: 270 - DNA, 33132 bp, Mus musculus
catttctttcttattttcccggcgtcttaattatcaccagcgggatggacaggaagaaaagtctggaagacacatttaggtgagcaacacccatttagccatgtccaagactttcctgtgactgggggagacaccagtggcatggaaattaaatccagggtcatcggaagatttgtttaagggaacatctctagtaaattctcccataaattctttacccctgccttttttatattggaattactggttggcattagcaggaaggaaataattgagttctactgggtttctctccccctctgggagacagacttgacaacagtcaaatatgcagaaggcaagcaattagcagaggaagggggctgggggggggcaatctagaccggactgtccatttattgtagctgctgaattattcacattcttacttctgggctgaggcagtgtggtttggatgcggtagaaaggaaattgggaaggaggcacaagactctctagacctcattctgcagtgcactgtgtccagacctcattcttcaatttgcccccgtgtcagcagacaattctcttcttggagggtctctgatgtgtttataaaaagataaagaaaaggagtgatatgttctataggcgtgtggtgaggtatgagggaaggggatgtctcagggggtccatgccaaggcatccctttccctccagggaccagccacacgatggtatagtatagaatagtttattcagggcatggggaggggagttaagagggtagtaggggcagagaaaggcagagagagtagagaagtagaggccgaccatgagcacgtggagagaggggggaagggaatggggaaggataaggggacagagcagaaacaagaagagaagagcaagagagaaataagagagggaggagggggcaagcagccccttttatagtaggtcaggccgacctggctattgccaggtaactgtggggtgaagcatacctggctgttgccaggtaactgtgggggtggagtttagacagaatgcttaacagtctctttttattattattatacattttgttgagctataaatgtttgttcatcttttgggatatagtccatagattttgggattcagtccatagatacaatatatgcactggagacagcaagctcttctagcaaatggaaccatggaggagtgtgaaaggtggaacgttcacattttatcatagagtctgagaaccaacagttacatttcagagctacagaaagcccagtaattcttcctactgtgatttcgtgcttagtacacttctccccatacccttcccatcctagaactcgctctgtagatcgggctggcctccaactcagagatctgcctgcctctgcttccccagttctgggattaaaggcatgggccaccactggcctgcctgatttagttcatttttaaggtctgaatattttactatacattttcttctaatggacaccttggttaattccatattttgagagtggaactatctgtttgatacagtaattaattttggttaaatacgttggagttattttctgattgggaatggggggttgttaacaagctttgttttacatcacatccaactgaagaggttttaatacacatctttgtaaatctggtccaagaatgagaagattgcggcagactggttgcttcaatcccttcgtggcattagctgcgaggactaactcgaatgatcacctctcatgtctcataaaaccaatatttcaatcttatataaaaacaatatctacttgttattgactctggaacagtaaaatgatacaaggctttcaaaatatccagtgttctgcccgcttgtataatgaaccgtagcagatgattcacagaatacagtggtgtgtatatgggtggttttgatacaagatagaatcttcgtaagtgtttgctaaataataattttcttttaaagagtaaagtttcctttgttgttataaaactcaagttctctattatcccgggtattactgacccaagaaatctaatgcttatttgggagatctacttaaattttatgcccaatttctgtcatattaatacttttatatcgtgaggctcacaataattaagaaaaacaattgaaagctagcactcccattagagtgggtgagccgagaggaagggactgagtctctttagccagatcctgccgcgtgacgacggctctcctagatccatccacggttcctctgaaagtcactaggtacgactgatttcgaaacacacacacacacacacacacacacacacacacacacacacacacaaagcagaattacattttctgtgttgttggtcaggctgaaaacagagcacgtaactttgcgagaatcagggcaatcgcaaatgaacttccgttccccattggcttcctgcggctgtgaaggatctctagccgagccgcccgcatgtgcttcttacggggctttcagtgagagaagcccgagggtagcgccagggagaaagccgccaggcaatctcggaggtagcctcctagaaagatcgcggcgaggggaggagccccgattgtcctggagaacagcgcggccccatccgggaagtggccgcccgcggggggcggctcctggtgcccgcgccaaggcgcacagcgggaacgcgcggagcccagcacggcctccccggggcctccggagccctgcggctcgcccggggcgaggcagctcctccccgcagactctgcttccgccagatcggtggccgcccgtgtcccggtagcaccgcgcccaggggccccaagagtctcggccgcgcccaggggctctcggatccgggcgccgccccggtctttctgtcccccggggatgcgcatcgtgggtacctgcagccgcccgggaacctagacccggccagtccgggaaagcggagccagccgagctcccgaaggtcccagtggactcgggcgtctgctggcatccgcacagtgcaggcgcctaggcgacgagcgcgtgcggggtttctcagttgtccccccgcagagcctcctccggcgtccccctacctacgcaaacacagtcggggctgccagctgattctacctcttccccgccctcccttcttccgctcacctccgtccatctctctcatatcttcttgccaaaagctccaaggcaaagatggacatgagcgaacaagttaggatacggccgagcgcgtgtgcgctgggaggagggtggtaatgaagtgggagaaaataatgaaaacgaaattagaaacacccgagagtgtaaccccacgcgcgcgcgatgctctcagccgccagcagtctcggctgtgtccaagtggaggcaaattttaaatattcaattctaggacagaatccacacagcacaggcgccagtggagccccgggcttgagctcaggatttagtgcttttccatgagatacatctttatttgcattacaggcaccagagggataacacctacttgtggacgcctctggggacagattctcggggcgggtggcctttgtcacctctgcagcaggtcaggggactctgctgaaggtgcaatggggaaggcagcggcttgagacctgggggaaacaccctgtgctctaacgaacgtgctggtcgctacggaaggcatgcgctgtcccctaagccctggccagatgactgaacagggggcggaaaccgtaaatcgaaccttctgggtctctcgcccctcccccaccaagcagtgtcactttcgtctccccaagctcacatcttatcatctctttagaacaaccgcgctagaacgaggcagtgggagcttgctggctatataaaacaggttttccgagaatttccaccaccccaccaccacctcgactgcttggtggtggaacctttttttttttttcctttccagaggccttttccagcgagcgaggcggggtagggctattgtttgcgtggccgatagggggcagcagttgcactgcgatgtgtccactggccgtgggaagccggcctaattggacttttgggtgagcaggctggatctgcggcctctcgggctacagcctcagctgcgtggtcttgggctgagacccggagcacctgaagatgtttgttccctgtggaaggccatctgtgaaactgagcgcgcagcactcattcagatgaatgcagatgttatcattagtgaaatattcagccatcacgcgaatttatccagaatctatcagagtttctaatcttaaaataagagccatgcctgggtggcggtgggatctgttaaattctgttgaatttcgaacgtgctcgctccctcactagttgggaatcaccgatccggatcccttagagtggctggatcgctgttggtgaggattctggggtaaactgggaagacctcgggctgattgtggctacccgagctctggagcctggagctgagcagctcggatctgttcagacccagagagattgcaaaggaatctgaaaatctgcccgccttgccaagctgggcactgtgttcagaacagtggaaggggaattacctatctcttgcaaattcacatttccatcaaacaagcacatttttttccctaaattaaaaatacatttacagacagtaatttttaagcagtctagtgtaaaaaaaaataggggccggttattacaatcatgtctaggtagttttttaaaacgtgatgaattattcaaatcaaacaatatgtaacagcaacaaggttgtgcctgccctctacaaacatcatgcacaattaaaaactccaattaatgcctaatagacctctggcaggcagggcaggattacagcctgcagttgtagaatttatcaaagcatgactgagatgtttttattttattatgaagagcaagaaaacatacaaaaaaataatacttttagtgtaaattttccaaacagcattctttttagaaagagaactgtaactgcagaggaccggaaggtcttccagagcacatttcaacatcacaaatctcatttatagactcaccattcctagtaactgacactaccttattaaaaattgtagtaaatattcatatttgagagggatgaaaaagagttatactagccttgtggtccaggttgcagaggggcaattgatctaaattggattaaaaatactaggccaggcctatagctgctcaaccagggctagggcactacttgaacttgtgaaccatgattgctctgtgtctggaggcaaacccggataagtgctgacacactgaggctgtgggtaggcatcttattctgtttttagatggccaaaaagccgtgccaaagaccaattgcaaacatctctttaaagaaagttttgtcacacattggcagtgataggaaaaatcaaatgatctcatgggtttgaagcagagtatcactttttagaacacttttgtcctttgctcaatcctctgccagaccaactggacttggaaggtatctgtgactccagtgtgtgcagtccacatatccattatatgttaagaaaactggatttctgaggttcataagatggctcagtggttacaagagcttgctgctcctccagaggacctcattatggttcccagtatccacctgggtagctcataattacccagaactcacccagctccaggggaatctgatacctctggcttccttaggcaacagctctttttttttaatgtgagtagacggttgctgtcttcagacacaccagtagagggcattgaatcccactacagatggttgtgagccaccatgtgtttggtgggaattgaactcatgactactcatggcctctggaagagcagtcagtgcctttttgtttgtttgtttgtttgtttgtttttgtgtagccctggctatcctggaactcactgtatagatcaggctggcttcgaactcagaaagccacctgcctctgcctctgcctctgcctcccaagtgctgggattaaagacgtgcaccaccactgcctagccagtcagtgctcttaatcactaaaccatctctccaggcccacttaccagctattgttaatcccatcaggtgagaataagacccaggcatcacctcttaagtgcacacatctacactcacatgcagataccctccccttcccttcacacaggcaaacacacacacacacacacacacacacacacacacacacacacacacacacacacccctaaggataataaaaataatctttacttaaaaaaaggaaaattgaggttctgaggttcttatgaagcaattagtcacccagcccctgtctgatccagcaacatagtgtgcttacaaagggacacagatcctggactcttttgctgtctggcgcctaagcagaagttagcatacttgtaaataatcacaactcgagtatactaaagccaaaaccagtgttttaaaggcaaggagaaaccagaattttacaagaacagaggtttccccacttctgtgttgcagaggtttatggaggtgacagcagattaaaaaatccatcatttggtgtaaaaatccaaaagactgaaagagaaatagcttgattcctccacttgttaatgaaaattccatcattttgctttgcctcagaatgtgtagactaagctctataagcaatctgaaataggaaacgaaacacaagacttaacatatttcatgggctgaagagatggctcagaggctaagagcaccgactgctcttccaaaggtcctgagttcaaatcccagcaaccacatggtggctcacaaccatctgtaatgggatctgatgccctcttctggtgtgtctgagacagctatagtgtacttacatataacaataaataaatctaaaaataaacatatttcacatgctcgtcaatatcttatatatcagcttgtacgaggttggttttctttttcttttctttcttttttttttttgtttgtttttgacaactgtaaacgtgaaaatgagaccttgggcactcagagcctgagttaggatctgatgtgactctcgtctgttgccactccatcgaaggcctgattttgagggagtcttggtacattaggagcttttagattatatctccaaaagtatggtacattgtcctctaaagaacactagtgtatgttgtttgtgtttaaatgatcgacagcagggctagagagatgcccagagggtcaggcacttgctgggcaagactgcctgcctgagattgacttccagagcccacttaaaggtgcaaggagagaattgactacacaaagttgtcctctgacttcctcagatatgatgtaacatggactactcccaacattttacttggtgacacatgttcacacacatgcataaatatacatacacacatatacatatatgtatatgtgtgtgtgcatttgagtgtgtgtgtttgtgtgcatgtatgtattaaattatcaacacctttcatttgaggtcataaaggtgaagaaaggttgtcttagggttttattactgtgaaaagacaccatgaccacagcatcaaggcaaacattgaattgaggctggctcacagttcagaggtggcagaaagcgtggtggcacacaggcagacatggtgctgggtaggtagctgagagttctgcatctgaattggcagtcagcaggaagagagaagagagactaggccaggattgagcgttggaaacctcaaagctcaacctcagtgacacatttcctccaacgaggccacacctactgcactaaagccacacctcccaataatgccactctctatagctatggaggtcaagttgactcaaaccaccttaaaaggtatgttggagatcatgcagtagtggattttaattccccagacttcctcttttttttttccattcagtggttctcaaatattttttcttgagacccacagagcctttgtataagtagattaaagctttcagtgtttactttattaggagttagaaacatagggctagagggctggctcagtggttaagagcattggctgctcttccagaggaactgggtttgattcccagcacaaacatggagcctcaccactggctataataactccagttccaaggaatccaaccctctctgaggccaccaggtgtacaggtagtgtgcagatgcacatgcaggtcagacacctatgcacataagacaaaaataaaatctcttaaaaaaagaaattagaattagagaaatatatgaaatatttgttaattattaatgatcagccattatgtattaatatattttaaattaaatataaccatatctcccccaaattgataaagatgtctttatatttgcaagtttccttaataataattaatattgtaacaatagctacattctcagctgggcatggcggtgcatggccttaatcccagcactggggaagcagaggcaggcagatgtctacgagtttaaggccagactggtctaccaagagagtttcagaacagctaggggtattacacagataaaccaaccaaccaaccaaccaaccaaccaaccaaccaaacaaacaaacaaaccaaaacaataacgacactcatctttgtttccactatttgtgtatcttgatatgtgctatagagatatggagaaagtctggcttcactgattagatagagatatatatatatatacatacatattatctatctatctatctatctatcgcctatttctatctatatatcaataatctatttctccatctattctatcatgtatctatctaatcatagctatctatctatcttatatctataactatccagcaatcatctatctatccatttacctatatatcatccatctatcggtgtgtctgcctgtctgtctatcatctatctatatatttctatctatcttatctatctatctatctatctatctatctatctatctatctatctaatctatctatggacagattttaaaagtgatgcatatttaagtggttctttcagataactgaggctattttttgacactaccccaaatccttcagttggaaattaaaactgtaatgtagattttaagtccatgtcaacaagtgtttccttttcttttatattgaaatctaactgtgtataaaatggctctttggcccatgaatcttttatagcaacacccattggccatttggagttattgatttactgaattatgtagatcttgcaaatattgtccacttttctggatgtgaccgaaagtgttgctttcagcaccattttcattacattttctccaaggtttgcttgcttgcttgtttttagtagcactggtggctaatgcaagggcctgagtgcatgcgaggcaaggactttaccaccaagctatgtcaccagctttatcactctcttttacaaattttacttatttatgcattggccaagtttccctctgtagatcaggctagccctgagctcatggcaatcttcgttctcaagccttacaggttatgagattacaatcatgagcaatcaggcctagatcatcaggacagactttacacaccaggatacatattttccagtgtttttgttttgcatatacatcaaaaatttaacattgttaaaataccgttagctgttttccttgaagtgacaatcttgttttgtttatttctgagagaaaaccccatgcaggtagtcaaagctgagtgactatagtgtgtctgtcagtccatcattctttcaaataaaaatagtattcaataagaaaattggttagttcaaaccgatgctaaatgtgcacatctgtgagcaacagaagcgcttcatgtagcccctctcccaactttatcccacagaatattaaaaagacatatcctagacagttagactataataaaatcaacactttcagtgtttgaggcatcacttcgttgagcaaagctggctttcgttgtactgttgtacgtcaagtgtgatgaaatgacaggatctcactgcaccctctcctctgagcttcccccttccggtgtattgttttattgtggtttcggttatctgaggtcacctgtaacttgaaaatgtcacaaggaaaactctacaaagaaacagttaagttttcaagggggtcccttctgaagacataggacacgagtcatccatgctcagggtgcccatgttgaaaaagctaagctgccctgtaagtcctttagaagccattttggttattgaccagctgtaacagtattgcaaaggtaggatcaagtaatccgtgtgcagtagcctggtgtgatgtctcaatactcatgtcattcatctcagctcagttcactgcagaggtcctccattatttcccatcattccaagaaggatgagggcaacgtaataaggtactttgagatactaccttggcataaaaccttgttatttttctcttttatcaccaattattattgatctcttagtgtacctaatttagaatggatatgtataggtcatgaagagacatgtatatgatttagtagtatcttaaatcacagacatctattaggagtcctgaaatgtataaggtgcataaggggagactcctagagtctggcacctctgttttgctcttgataaagtagccatagctttacccactgtgttggtttgtatatgcttgacccagggagtttcacgatgagaaggtgtagcctttttggaataggtgtgtcatggtggatgtggactataagactctcatcctagctgcttggaagtcagtattcaactagcagccttcagataaagatgtagaactctcagctgatcctgcaccatatctgccttgatgctgccatgttcctgtcttgaggataatggactgaacctctgaacctgtaagccagccccaattaaattttctttataagacttgctttggtcatggtgtctgttcacagcagtaaaaccctaactaagacacccattattagtggaaatacagataggaggcaaatgataccgaggtatttgtgtggaaattgctttattttcacagtgagtcctgggggctacttggagaatgactgcttgagtcctagcagaagcactaatggcttgtagtgctcatttgtgtcttaactacaggctactatataatgtttgtcactgttctcttattaggaactttgtcatcgatgcagttgtttcctgataacggatggagtgcctgctgtgagtgacaattaaagtttgttgacaattgattgacaaatttagattagtggtgcacatacactatgttctcatgtagccatcctaggaggctttgctttttatatgagttactatggatgttttctgggagtgcatttattccaagggaggaaggatacctccatcacgatatatcattcctttccaagtggttgacatcattggcagccatatccaggcacgcattctatcttttctatccgtccctggcactcgggacccaacttcacataccggtgtgtaagaatttcagtccagtttgtaatcaacttaaaatattatgctcattagcactaccaaaggactggctgctagcagtaaagtgcttgtccaatatttacggacaagctgaaaagcacagctgagctttgggtaggtcattacttcttctcttttaggccacagaagacttcttagatatgagaggaagttcactgcttgtgaggtcacatggtcccctcctgtaataaacaacatgcctgggcttttcatctctcacactgagcctgcactgttacgcattgtatagagttttgtaattgttgctattgtgtgacagggtctcacaatagcagcaggctagcctcaaagaataaccttgaattctccatcttcctgtctcccctccaggtattgagattatgggtgtgggccacagtgcccagccagatgtatcttctaatccaccaagggaatctgaactgttaattaattgttaattgttaaaacattgctggggtaagatacacctttttcttttcttttcttttaaatatttatttattatatgtaagtacattgtagctgtcttcagacacaccagtcagatctccttaaggatggttgtgagccaccatgtggttcctgggacttgaactcaggaccttcagaagagcagttgggtgctcttacccgctgagccatctcaccagcccagatacacctttttctgtagacaaatttgctgagaatctaatacacatatgatttggttatgaaaaaggagaccaagaaagtagagaagcacacacagtgaacattctttaatacgagtagaccttagatccaagctcactgagtggtaaatatattcaggccagttccccaatgaaatatcatgtccaatgtcactatttcattattaatccctccagagaggaataatcccttcagaggccagtaagttagcccttagccacattttgaatgtgaatctaagtagtagtacagctcagtatcttcaggtgttctctatgtgtgcttacacacacatgcacacaaatgcacacacacacacacacacacacacacacacacacacacacacactcactcactagggattgaacttagagtcctcaaatgctctatcattgatttttgcctccagcctgagaatcttaattttaattttaattcttttaaatttaaatttcaaaatagatccttgagtcagttactagaaaattagagtttggaaaatcttgagtatgttaacatcttttcacggttgaaaggtttttgaaatctgaatactgatcaagtatttttattaaaatttaggagcctctggagacttggctcagtggcttagaacatttgttcttcttccagaggttctgaagtcaattcccaacaacgatatggtggcttacaaccatctctaatgggactcaatgctgtcttctgatatgtagacaaacatagtgaccgaggactcacatatgtaaaataaataaatcttaaagagaaaacttaggaaccaaattgagatgggctgtgtatgtgtaaattcacataaggtttcaataactttatggggcacaaatgatagaatatttatactggctacatgtttatgtgagttacttttctactctctgtggtcaaacatatgaaaagatgcagcttaaggagacaggatcgatggtaactaacacttgaaggggatgtaggctttcctggcagggacttcaggcctacaaagcaagaatgggctggtcatattccattcccagacaggaagcagaaagaggtgtatgattgaatttaaaatggaagtgaggggcttcagggcttttaaaataagtattttttcctcttaagatgttatattgtaggaaaaaaaatcccacaaaatattactttctaaaaagcaaggaaattaactatggccttactatttaggaaataaatcaactaactttttctttaaacctcacttccattgtatgtaattacatactatgatgacgatgtgacatagtttagctattgttcaatcacttaataaatacttggctttcactgtttttaattaagttgaataaataaataaatagtattccattaatatgtatacaacacttattttaccaatccacaatctgattattctgatgcatactttatttgtgagtatgtatgcacgtgtatacacatacacacatatatgtatgcacacacatgtatctgtatcttgattatttccctaggacatttaaactatgcctaagaaatcagagagcaagattagagagatgggtcagtggtgaagagcatgctttattcacatagaggacatgagttcaggtcttcacatccttgacggaagattaacaactaccttaactcttgatacatgggaacctgatacatctggcctctcccaggtacctgcactcacagacacctgcactcccaagcacctgtacttacagacaactgcactcccaggcacctgcactcacatgcacctgcactcccaagcagctgcactcccaggcacctgcattcatatgtacctgcacttgcaggcacctacactcacaggcacctgtactcataggcaccagtcacctacatcaacataaataaaaataaaaccataatagaaagagaattcagagtcaagggtaagtatattatgaatgtgaactcagggctatctaaatggctcagttggtagaggtgcatgccactaaaacttgatggcctgatttcagtgcccagtccctcatctttccatatcttctttttaattatgttgcaatacaacgaatagtcacaataatagcaggtattataatagtagatattatctgattcttggttggtttattattttcatttgggacttgcagtttttatttagcttagactggcccagactcaccgtgcagccctcacttccttacagttttaaatggagcttttttctcattcattcattaattagttaatttactttccaatcaaagccccccccccccttccttctctccttctaactccctgtttctctgcagagaaggggaggcctcctgtggatatcatcctactttggatatcaagttgcagcaggactgggcatcttctcctattgagattagacaaggcagccaagttaggggaaagggattcaaagacaggcaacaaagtcagaaacagcccctgctcctgctgttaggggccccacatgaagactagagcttatttttaaaaataatttactatgagttctttgccttgggtttattgctatatttataaagtcaaagttttaattttattgaaattttactagtttttaaaaataatatttttagtacagaatattttcacctacaggagggtcttttctgctttttagacgtaacttccacattgtatcattatcatctttattttataaatatctgatagtagatattattgattaacaagattctttttcccaaaacttaatttgtcattattgtctctagtagatcatcatcttaagtgaatattgaaattattgtataaatttttgtctccctctcacacttaacccactgaaattttagttgatatgactttaaaatctgggaggagcaagaacaacaaaatcacaccctttctccctcacaaatgtcataatgtttctatataattatgccgattaaagtaatataaataacaaaattaaacaaataacctaggataccgtattagttactcaaaaagtaaagttaactggtggccagaggggagaacctgatatctttataactctcaaatttccccagtgttaagccgagagttttgtgtgcatggtttctttctccgtaattgtgttttgtatttagggcgtttcacatccatccatctatctatctatctatctatctatctatctatctatctatctatctatctataaaactgtgtttgtgtattgtgtgatagaagaaaaatatttctattaaaaataactagcaaaatagccccgacatgccgcttgaagcacctgggcagctcagacatgaacttcctaaaccatgaaaaacaagacaacaaagaggatggaagacagggaggaaaaagtcatcaaaggaaagcagcgagaaaccgagaaactggtgtgtactggatcagaggtgagaagccctgttggagctgcagcgttctgtgcttacaatactgggaacagcgagcccagcctggcgttgcccctgttaggccaatgctctgcaattgctcaggctgagtccccagccaaaaaaagcattgtttgtgagcaaactgaagtgttagacttaagcactagagagctggtgcagcattattttaatttgtgtagtaacctgcgactaggggtaataaaaagaaggcaaagcttttatattacaaacctaaaaatacaatttttttcttgtaaaatgtataaattggttttgagaaattaagtcatgtatctatattttctatacataagtacacaggaaacattttagagtttgtttcctgctccaaacatggtcatgttaaaacgagattttaacattgttcattgaatttaaaagtgaattttcttccatttagcatttcttgcaacttcacactgaaatgtctacttgtttagaaagacaaatcaatatatatatatgtatgtatgtatgtatgtatgtatatatatatattccaaaacaaacaaaaaaaccccatatgggatgaaaatgtccaccgaaggaaattactaatacttggatgataaaggaaataacataggtgatttcatggcaaagcataaacaaaggccaggctgtgtaatgtttggctgcaagagaccctgctacagataggagtggagagccccacatttcttcctgaagatggcagtatgtcagtggctaaggcagtggcacgtagctgaataactgtgcagggctataggagttctacacaggtggttttttttttttttttttttaagtgggaaagtcctttcagcaaggcttcccaatttctacttcaaaacccaagtctggagggatgtgtgataccagccttctgacctaaggatgctgaggatacaaagtacgacattgttttggttcctccagttcttgggggataaaccttccatagcactccagaaggaaaaagaaacctcgtattcacttcagaatttagagtggagttgcagatatggagcagcaagaagcaaaaggatgcggctcagactgtcagctgccatcttgatgagttgagtgtctgttgatcaaggctatgggaaaagacaagcaggatgtcctaagtgcttggtacaaatagtaaacacataagtagaaccttgtctgtgacagcaatcagcatgctaccaaagggggaagagtaggaacagattttgagagcattatcagtaaaaatgaaatgaattttaaacatttaatgtggcaaactctaagggaataatatgtacacacacacacacacacacacacactcaccacacatgcttgcacacacaaacttatggggaaataaatgcacaacagaaaaagcatgaataaacaaaactgttaagcaaagataaagtttgaattatctgtactgtttagtcttagtatattttaaacacccaataaatattaggagtggtaatgttcagggaattattacatcattttatttggttggccaaagccacattaaattgaaaataggctgatttgtaggacaatctgctggcaatgtctagatcataggtcttccaaaggaatggggaagaccaaagtcctaagtaagactggttagtgtggtcttctggaagttgtcaccagcagtggagagaaactgattcctgcagtagccaccatagcatattttattgtttataatctttgtaaaattctcttgaaaccaatatatttctctttcagtgtttttattaatgtagtgttataacacaccacagcgcattgtaaatgcttttatgtgcaattgcatcaactttaacatcctgtctgttctaatttatataagccaaaccaatttatattgacagtttacttatgaataacgtccttcagggttttactaatttctaaagaactgaatccttagaattacaaaccccaaaccctttgcctttggagatatttctcttttttcctctctctctctctctctctctctctctctctctctctctctctctctctctctctcatccatgtgcattggtgtacagatgaactcacccatgcaggagcttgcagaggccaaaggctgacatcaggtatcattttcatattttagagatggggtttcttcttgaatatgggatatgttgtttagactatactgattggttagcacaaccctgagatctgcccattccccatcccgccccccagtactgtagtcactggggtacccagccatgccctgcttttagaactcaggcccttgtgcagcaagtgcctcaaccactgagcacttttcccctgctcaagattttctcttttctcttctcttctcttctcttctcttctcttctcttctcttctcttctcttctctcttctcttctcttctcttctcttctctccctctcccgtccccttcccctccccctccccctccccctcccctcctttccttttcttttcttttcttttcttttcttttcttttcttctcttttctaactgtatggaacaatcgtttattgaggaagggtgcatcaatccttcttggtcaccaccttcctcatggttgctcagctcttttagccgtctcttggcatgaatatgcatgcccaccctcttcttgctgaacttgagtctgtgtttgtccttggacactttgtgcagctccacagtgcactgcttgtagggctcgaagctgtacacctcctggatcacctctccagtggtgccccaggacaggtcaaacaagatattttcttacacatctcatagaagatggcgtctcttccattgtatcctaagtacttactggaatcaaccttctcttgtgttccttattgtatggcattgatggcaccaaattgatatcactttattgaaattaattgttcgaagatttttcccccttctctttggcttttcgatgtttgaacatagcatgtctagatgtagtttttaatttttaattttcattcttacatttactctgcctgctgttttcgtacttctctggtccatagtacaacgtctgacatcagcttgggaacgacctccaacctaattgccttaaaaagtttctcttgatctctcttgttttcatgacactcatattgcattctttgcccttgccacatggcttctcggtaaaggtcttcttccgaactcttattttcctcttttgtgagacgctgttgccataatctcagtctcagaattctttcttcagccatgtagagtctgagggggcattccatttcatcctcagtgttctggtctggacattacacaggtacattaatttctgacctgctggttatatcttccatatctgacttccacatctgacagttccgcacttaaactgtcttttccaatggggctttgtgtttatcgtgctttattgttttttaaattgaaaatctgtacttggtgtatgttgttaaagaggctgcagtaaatagtccagagagaacagaggtgagggatggagacatgtaacagttctgtcattctctggtctagcctccaccttctggtgaacttcagcttttaaactgtaggcttttctatggcttctcagagttatgttcacccccagcttggacagaaaggagagaggaggttggtgtggggtttaaccttctgatggagagagtgactcatgaggacatggcttgttaagaagaacaaatgcctccatttctactctcctggctataagcatgaacatttttctcagtattcatatggtaaaattcccagaggttatgtgtgggtgctcctctgtgctcttggagcctccggaagcctagccctatactatgggcttccctaccctgcctctgaggtttattctcctgtaaattcccattctctggatttgacagtttgcatctctcattttcagggcagtggtttgcgctgtggcctcagaataacttgctggacttctactttggtgtgcgttttactttgttgttaggaagaatcacaacctctcaattctttgcacgcaagaccagaaatcagaactcttcacaatttagtcacagatatacagggaagcattgaagcaattgtcatgtagccatttaatcttcataactgcttctttgggagactttacagcaacagtgtaagagtgtgatatgatcttacattagcctggaacgcaacaaaacaagaggaaaagaagttctgcgtaagtcagtactcatgctcacaggtgctttctgatgtacgaaagtacagctttggaaatcattcactagctttgtgcatttctgtatatgcacatgtatgtgtggaggcatatgcacatgtatgtgcggaggcatatgctcatgtggaggctagaggctgatgttgcattttcctcaggcacaccccatcttatctttttttttttttttttgaggaattgtctctttttgaacctttccaatttgacaattgattagacagtcagtgaacccctgggatcttcccatctctgcctatccatactgagattacaggcacatgtgggcacggctgatttatacgtgctgatgcccctaactcgggccctcatgattatttggcaagaactttcccagcccccaatcgctgagtactcagagttgtgttttttttttttttttttttttttttttttttttttgtcttagtcttttgtatgacttgaaagagtaccacagaataactgtaaatagaaggaatttgctcctcagttacagaggctaggaagttcaagaactcaggaggtttggttgggtgccaagagtgcccagtgcttttgagatggcacactgatgctgcattcagaggcgaggagtgtaccactctgtgcgacagagctgggaatccacaaagggagcaaactccttccagcttgctttcttacatggcatcaaagtgctcaagaggccagagcctatgcagccttaacacgtcatggaagctccaaccttcccacttctgtgaatcaagcattcaattcccaacacattgatttcatggatacattcagactgcatcagccttgaagttataatgagatgtgactgtagatacaactccaatcataatcaaagagtacctgcactccatttgcaccctgacttttgcctgacactctcacagttagtggtttggaactcagtttggtaataggagaaatatgataggcgctgttgattacatttctttttctttctttgaagtacaacaaagatttaaaaaaaagttccggaatgattcaatattttaccaaaagtggtttatttttttccacctggactgtcatctcagaagctcagaaaatatatatgttttttaagatgcctgttctctgcaacagctttgattattgtcattcagtaatcaatatgtgccatttctcccactctggttcctcgtccaaagaactcccctactgccttttagatattgtttcctccctttatacacagaaccatgtgcgccaacaaacataaggttcaaagactaaggttcatggacgagtgatgttgaccttgtttgactgatcaaaatggatcatgaagccaactaatggcatagaagagcgtcttaacagataccaggtaccaaagttaaatcaagatgaggttaatgatctaaacagtcctatatcccctaaagaaatagaagcagtcattaatagtctcctaaccaaaaaaagcccaggaccagatgggtttagtgcagagttctatcagaccttcaaagaagatctaatcccagttcttcacaaactattccacaaaatagaaacagaaggtactctacccaactcattctatgaagccacaattactctgatacctaaaccacaaaaagacccaacaaagatatagaacttcagaccaatttcccttatgaatatcgatgcaaaaatcctcaataaagttctcgctaaccgaatccaagaacacatcaaaacaatcatccatcctgaccaagtaggttcatcccagggatgcagggatggttcaatatacggaaatccatcaacgtaatccagtatataaacaaaacaaactcaaaaacaaaaaccacatgatcatctcattagatgctgagaaagcatttgacaaaatccaacatccattcatgataaaagtcttggaaagatcaggaattaaaggcccatacctaaacatgataaaagcaatctacagcaaaccagtagccaacatcaaagtaaatggtgagaagctggaagcaatcccactaaaatcagggactagacaaggctgtccgtgctctcactacctattcaacattgtacttgaagtcctagccagagcaattagacaacaaaaagagaccaaggggatacaaatttaaaaggaagaagtcaaaatatcactttttgcagatgatatgatagtatatataaatgaccctaaaaattccaccagagaactcctaagcctgataaacagcttcaatgaagtagctggatataaaattaactcaaacttaagtcaatggcctttctgtacacaaaggataaacaggctgagaaagaaattagggaaacaacacccttctcaatattcaaaaataatataaaataccttggcgtgactctaaggaagtgaaagatctgtatgataagaacttcaagtctctgaagaaagaaattaaagaagatctcagaagatggaaagatctcccatgctcatggattggcaggatcaatatagtaaaaatggctatctttccaaaagcattctacagattcaatgcaatcccccatcaaaattccaactcagttcttcaacgaattaaaaagggcaattggcagattcgtctggaataacaaaaaacctaggatagcaaaaactcttctcaagaataaaagaacctctggtggaatcaccatgcctgacctaaagctgtactacagagcaattgtgaaaaaaactgcatggtactggtatagtgacagacaagtagaccaatggaacagaattgaagacccagagatgaacccacacacctatggtcacttgatctttgacaagggagctaaaaccatccagtgaaaaaaaagacagcattttcaacaaatggtgctgacacaactggtggttatcctgtagaagaatgtgaattgatccattcctatctccttgtactaaggtcaagtctaagtggactaaggaactccacataaaaccagagacactgaagcttatagaggagaaagtagggaaaagcctcgaaggtatgggtacaggggaaaagttcctgaatagaacagcaatggcttgtgctgtaagatcgagaatcgataaatgggacctcataaagttgcaaagcttctgcaaggcaaaagacaccgtcaacaagacaaaaagaccaccaacagattggaaaaggatctttacctatcctaaatcagataggggactaatatccaatatatataaagaactcaagaaggtggactccagaaaatcaaataaccccattaaaaaatggggctcagagctgaacaaagaattctcacctgaggaatacagaatggcagagaagcacctgaaaaaatgttcaacatccttaatcatcagggaaatgcatatcaaaacaaccctgagattccacctcacaccagtcagaatggctaatatcaaacattcaggtgacagcagatgctggtgaggatgtggagaaagaggaacactcctccattgttggtgggattgcaagcttgtacaaccactctggaaatcagtctggcggttcctcagaaaattggacattgtactaccggagaatcccgcaatacctctcctgggcatatatccagaagatgtcccaactggtaagaaggacacatgctccactatgttcatagcagccttatttataatagccagaagctggaaagaacccagatgcccctcaacagaggaatggatacagaaaatgtggtacatttacacaatggaatactactcagctattaaaaagaatgaatttatgaaatttctaggcaaatggatggacctggagggcatcatcctgagtgaggtaacccaatcacagaagaactcacacaatatctactcactgataagtggatattagcccagaaacttaggatactcaagatataagatacaatttgctaaacgcatgaaactcaagaagaacgaagaccaaagtgtggacactttgccccttcttagaattgggaacaaaacacccatggaaagagttatagagacaaagtttggagctgtgacgaaaggatggaccatttagagattgccatatccggggatccatcccacgatcagcttccaaacgctgacaccattgcatacactagcaagattttgctgaaaggacccagatatagctgtctcttgtgagactatgccagggcctagcaaacacagaagtggatgctcacagtcagctattggatggatcacagggcccccaatggaggagctagagaaagtacccaaggagataaagggatctgcaaccctataggtggaacaacattatgaactaaccagtaccccggagctcttgactctagctgcatatgtatcaaaagatggcctagtcggccatcactggaaagggaggcccaatggacttgcaaactttatctgcccctgtacaggggaacgccagggccaaaaagtgggagtggttgagtaggggagtgggtgggagggtatgggggacttttgagatagcattggaaatgtaaatgaggaaaatacctaataaaaatattttttttaaaaaagaagagcatcttaagccaacagggaatgagcacaataaaaatgttttccttcatggcatttgtctcaaagttattctcatcgcaaagttctccctcatagcattatgtagaagagcaaaggagatgacacttgagaaatgggagaaaagcaagcaaaattttgtcttttgggttgaaagtcacagatattgtcgtcatgttgacaacgtttgccttttccttcaccagcttcactacctctttttgattcttgactaaaggtcactgagcttgcctatgaactttcgcaccattttagagacattagtcagattacagaacatatgtagtcctcctactgactcccagtcagctgtatacttactgaagtgaaaaactgtgtttctcttcaacaacggacagacagatcatttctttgagaggaacacacatgcaaaagtcagtcttaaaaaatatatcaattctcttggcttgatttgtgatattttgagcacacagttcaattttcatcttccctagtgtgcttactacccgagattagctgcatgcaaggcaaagtttatttctgggcacaagtcagctgcggtatactgcagtgtccagggcagaacagccctgctgaattttctcttttctggaactcctatttttcgctcaagtgtttccctttaattgtgattaataagacaaagaggtggctcagcaggtaaaggctcttgctatacaagcttggcgatctgagcttaatcgctagaacccatgtcatgatggagagagagaacaactccacacagttgtcttttgacctccacacacatgctgcaacccccaccacacacacactgcatatacagaaacacaatagtaataactaaaagcttgtgatgaaaatgtatataatataacatttattttattagctatttccaagcgtaggtgagcatttggcactgaggaagccttgggtgagtgtaaggattaatgaagtcctgagagaatgtgagtcattgagaaggatcaatgttgcagacccatgaaaataggcaaagcttgatttcaaggaccaatgccccagacccacaggaactggcaatacacaaatgtttacgacttggaccagtgctagccaaactagaaactactgcttccttcttgcagaagactgcttttctgctgagaactgcttctgacatagctcccccataccccgcaccctctgcgtacatcataagccactaggggtccaggttgctgtgccaatcttgctgctgtaggagaatgaacacagccctacctgatcgcagctttttttgtaagtgtgtctgtcctttcttcattgcttcttctccccagtgaggttttcaggacgaagccagacaggacgtggccgtgcagtagtgtttactctatttacatctgaaggacaaaaacttgtaaaacagaaactatatctctaaataacttcctttttccccctctgccctgagccccaagaaaccactattggctttctgtttctatgattttgactggtcaagctcacacaggaatggaaatataccatgcctaacattttgtgatatcctggtgatctgtgtgtacctgctgtttgtcctggagtcacctctcagaggggagaatgagagaaccagacaatatttatgtactgtgatgaatgcgggttaagatgtcttttcttagtcttttagataaatataaattgtcacattttctttctccagtccagtacatgttgtgtaactccttgtcaatgcctcctggcccgaaatcccaaaggggcacacattcgaggaacacacaatgtgcttgaactaagcttctcactggaaacacaggccatggtaactggattgtgcttcagtaataggatagctcaaaagatttcttgaatcatgtgggctttgcacaggggaaaaaaggagggaatttatctctgtgattgttgccaggtagtgaggagccttttaagactgaagttctcagtcttaccggtggagagggctgttgtacagaactcttcggggaaagacataggcagaactccacccaccagccaaagccaggaggaggatggtttcttgtggagtttctacagagcccttatttgggtcggcgcttggagaaaataatgaagcagtcttgttctgtttcattgtatgatggtctcagaatgtccttgtttgatgtggatggtctaggaggttgtttatctacaacagggagcatgttccttccttagaggaaacatggaaaacattacatgagagaagcatccgaagtgttgagcagataattctggagcgagaacttaacatagtaaagatggactttcattatttccctctctgtcatgggaaactaataaatgcctttctttattcattaaagagaaacttagtgggtagcaaatgtttactgtgatgcaatggtgaacgagcatacatagcctctgacagcatggcccgtaagacagctcaataagaagagggtgaaaagttacaggagatgtcccctgccacaccttggccatgttgggaactgtttctatgataaagcgatgttgacggtggttctaccagatggatgagcactgtctagaggcttgcattagatggaaggcaagggataaactctgacaaagagtgagggaccatagtgcagtgtgtccaatgaaaaaaagaaacaagccaactaaagacaacagaaaagtctctcactttctaaatacactctataggaaactgtttttcttccatcttgcacacacttgcgtgtgcctcatgcggtagtgattacagctcctttattaattgatgatgatacaatgttgtgagcatgctaagtgcagcacatttgctcacaaaatggtgataaacgtgattactgtttcggtggagcccctgtttactcgctgtcattggagtttcaactgtctgctctgcttcgtgcagcagacagctgctttgcaacacggctgatttggtgactatatttggcctttccttccttggcttgggactgaacccaggaatgactattaacagagagggaaaaaaatggtcagaactaattgcaaagtcctttgctaacatatccttctgcaatgtcaactgctttctcagtttccaaggcactagcatatggctttaaaagcacccggttggactctgttgtgggaacttcttgtcaaatacatattcatgagctactgtgaattatcttgatatataagctttttggctaggacctaccaaatacataatcataaccctttgagcttccagtattacctctaatattacacacaatttttagagaaatagctggacaaaggagatcatagcagcttgtatcttctccattgctttaaaacacttcaatattatcatctgtcattaataaaacaaaacccagaaggcaatgttgccattttaattgttgatgagcatctgagagtatttagcttacaaataagatgtctaaactgtttatttaattgaattaatcagttgatcaatttatttatttgtgctgggattacaggcatgtcttactttgttcagtccaattttaattttttaattgttgtttcagtgaataagcagatgtggttggaagcatactattgatgaaaatcacctcagctaatagacgtagctcaaccaaaacattggcttacacaatttgctggaattctctggtgagtcttttcttggtgcgtaaaaacttctcaagtgtttgctgttctttgttagatggcaagataagtggcttaaatggatgggaatttggcttagagaagtggtactagtagaaccagatgtggctatggtgaggaagcatcttcattgatgctgctgtgtacgcctactgtcttcagaactcatttcaggtgtgagaaagtcaaatgtacaaatgcatttacatcacattgaacaggtgttggctagcgctgtaggaacaggtgttagctagcgctctaggagggaatggagattcttgctgaaaacgaagcagggacagcagcgtttgcactgagctgggtggttctatgatgaacctagctcttgaatgggctttgaagagtagaaaatagctcagagagcaacggtgattaagcgtgggaagatgaagaacattctaggacttaacaatggagctgaacaagaacacaatggtaagaggaaagtgggtgctccatctacctagcccatctctgacccattgttccatataagtgattatttgtaggcacagacttactgtggccatttaggttttagtgttttggggttccttgtttcttttatcttttgctgtgcttctttgtgctttgatgacttttttgtggtctgtctactataggtttttatttgtggttcctatgaggttttcaaaagacagagtgtagttctcagtctattttaagctgacaactgaacttcagtcacatgcaaaagctctacacttattcctccttctacatctaaacatacaggtgtgtgcacacacacccccacaccccacatatatacacacctacacaccatacacacaccacacacatatacacatacaaacacacacataaacatacatacacaccacacagtacacaaatacacatacatatacatacacatgcacacataaacatataccacacactaatatacttacacacacacacacatacacacacacacacacacacacgcacgtgcatatacacatgcacaaacacacacttgaaaaaggtcttccagtgtagccctggctagcccagaacccacattttacatttggtgtcataatttgcataatttcatattgcatgtttgttaagttattataactatggttttatatttgtatgaatgttcttacataaaacatctgttcttatataaaaagctcctgtaattatagctgtctttaaactttggctctggatcattatattagagtaataagttatttatacaccaccattacaatatgagtgtattatgaattttgctagacatttgctctttgattctatatttacgtttgagttttacacttttgcatttcccctgtggggggaaaaatggcatcttctagctttggcttaaagaatgacagaatgttctgtgaggcctacgtagcgaccatgaaccttttcagctatttttttaatctgagaaagcatcagaaggtcattttgttgatgtttttcttgttgttgttgttgttgctttctgctgagaagtcagttgatgatagaggagcattcccttgtatgtagcaaccctcttttgtcttgctactttcacaaatgtctttagttatggttattgacaatttgaatttaatgtttcagtgaggcctttttgggttgaatctgagcacttttggcctttatatatctgggtttctatatcgtgcttctggaatggagagttttaaaaacatttttaatttaggcaaaccctccattgatttttttctcacttctcgccgtatgttatgttatcatggtagttttttagaaatccatcccacaagccttctttgctcctttccatcctcgttatctttcctcttctgatcgaattcaaatgacttgtctctggatttgctgatccctccctctccttcatcaagtatactgctaaagctctctgtgtcactcggtcctaatgtttctgtttccagacttgtttcttacctgctgtccatctcttggttaagcttttaattttgttctggaattgtctttctaatattgttagaaattctaatattattatctgtgtcctcttgtggtgcacggagcttctttggaataattcctttggagtctttgccacatgtttatacacttccatatctttcaggttattggaagtctattgtggccctttggtgatatggtgttttgaataggaatggcccccataagctcatattttaaatgtgtggtcattagggagcaatgctattcgagagggattaggaagtgtggccttgttggagtgggtgtggccttgtggccttgttggaggaactatgcccttgggatggactctgggatttcaaaagctcaagccagacttagtgtctgtgatggtggtcaagggagtggaatgttatggtttgtatatgctcagcccagtaagtggcactattaggaggtgtggccctgttggagtaggtgtggccctgttggagtaggtgtggccctgttggagtaggtgtggccctgttggagtaggtgtggcattgttggagtaggtgtgtcactgtggttttgggcttaagactctaatgtgaacttccgggaaatcagtcttccactagcgggcttcagcagaagatctgaactctcagctcctcctgcaccatgcctgtctggatgctgccatgctgccaccttgatgataatggactcctgcaccatgcctgcctggatgctgccatgctgccaccttgatgataatggactcctgcaccatgcctgcctggatgctgccatgctgccaccttgatgataatggactcctgcgccatgcctgtctggatgctgccatgctgccaccttgatgataatggactcctgcaccatgcctgcctggatgctgccatgctgccaccttgatgataatggactcctgcaccatgcctgcctggatgctgccatgctgccaccttgatgataatggactcctgcaccatgcctgtctggatgctgccatgctgtcaccttgatgataatggactcctgcaccatgcctgcctggatgctgccatgctgccaccttgatgataatggactcctgcaccatgcctgtctggatgctgccatgctgtcaccttgatgataatggactcctgcaccatgcctgcctggatgctgccatgctgccaccttgatgataatggactcctgcaccatgcctgtctggatgctgccatgctgtcaccttgatgataatggactcctgcaccatgcctgcctggatgctgccatgctgtcaccttgatgataatggactgaacctctgaacctgtaagccagccccaattacatgttgtccttataagagttgccttggtcatggtgtctgttcacagcagtgaaaccctagctaagagagtgaattcagatgtagaaatctccttcatcagcatcatgtctgcctgcacgctgccgtgctttcctccgtgatgacacggattgatcctctgaaactgtaaaccagccccaatcaaacgctttttaatacaagagttgccatggtaatgtgtttcttcatagcaataggtcgctaagaccagtggtgtcttgttttcctggttattcatgtttcttagagtcttttgtagttatctgtacatttgcacaagagattctttcctccagggtttatcaactatctctgacatagtgattaactttacctctgagctggggtgcattaaagcatactttgactctaaacctagtgagccagggcacgtgtggaggctttcagttcagagggtaatgaatgtgtctatcagctcacacagctggtatccaaagtgttgacaacttggcagtcctatgctgcgaggactgttagggatccagtggcaagggcagcaatggagacatgggacactcagatgcgtacacttggcctcaaaggccagctgcaggtatctgctgggtgacaagtttggtggcaggcaagtgcacagcgggaaagtttagagcacgagaggctcagaagccatagcttgtaaaggcaaataaagactcttggctacagattaatggagtcctctttggagcaatgttttaattctgtcacattaaatattgtgagtcctcagtggtgaaagtgtgaggagtttgcagcagctcctgggtctgttaagtttccagcaaagatggctccagagtcctcttctgaggagactctaaggacagccaagtcacatactctattgctgtctcttttgctccgagctatttccagatgcatactatgccattcttccttagtgatctggggagatcaccaggcgagtctttgaaaaggtgttctgaaagtttgtgggatatggctgttcacccagcctttctttttcttaagagggcagttcatgggctggttagtttcttctcagccagggtagtgatgggttggggagaggtgtgtgagtcaggcaaaatgaaccatttgcccattgttttgaggcattttacttgggcgttcttcctccaccgtatgcctatatcttttacaatgatcaccccccagtacttccagagatatttaccttcctcgatagttcatttggtggggagggaggatgttgtaaaatctgatatcttactccaatgtattgctgtcatcgattgctactgcctgattggaaagcgtgactctaaatcccagccctgcctataactccagtttcagtgagtttggcaccctctcttggtctttaaagctcttgcacatactctcttgtacacgtgctcataaactcatgcaggctcgaacaggttcacataactg

SEQ ID NO: 271 - DNA, 9372 bp, Mus musculus
gcaccccatggcaaagtctgcaaggagttaagattgcaggggagagccggaggagcaagcgcggtcaattttgttgtttaagctgcgaaaacaaagttacagactaactgctttgatttggttttcagcgaaatgacagatagccagaaagaaagcggcgggtccaaggcgaggagctggggacttttatccattcttctttaacgttactgttactgagccttagctccagctcccggaggctgggctcgatctttgaggagctcgtgagctgctgcaacttagtggagaatttccatgccacgtcaatttacagccagccagcccccgaccagagttctgcggctcagggcaccgacgggctttgtctcacccagttggctgaatggaaaagaggtgtccagaaacggaattaaagacaaaagtgcaactctggtgtgattatctacggatagaagataaagtcagtcaaagtgatgcggttctttctgtttcttctggtcagtcctgtgcttcccggcttctaccgaggaagcagaagggagggggagagggaagggagggaggaaaggaaggagagaggaaaggacagagggagggggaagagagaaggagagagagagagacagagagagacagagagagagagacagagagagagacagagacagagagacagagagagagagagatagatagagagagagagagagagacagagattgtttcttaacgtgttggaaacaatattaattccagaaaggaagtgagctttctgaggaaacaacagaggggagaggaagaggaagaggaagagggagagggagggagggagggagggagagagagagagagagagagagagagagagagagagagagagacctagaaagttctcagtcctaggtggaaaacttctttccacacagcgggttttttttttttttttttttttttctggaaagatgtgctgattaaaaccaccaagtataaaaaaagcacaaaaacgtaagctatttcataaatacttggggaagaaagagtgaatgtggtcaaagtacattgaatagatatatagaaatgtcactatgattttaatttttcttttgttcaattatcatgcactaatgaaaaaagaaaaaaacagttaaaaggaaaaacatcctatgtaattgcaaagatgagacagttacagaggaattagttccctccagcattcttggtttgttattttatttatgtatgtgcttgtgtgtggtgcagggaccctcccccagaggaggggcgtcagaccctttggacctggggcaacaagtggctataaactcccttgtgagtgctggaaccacacctcaaaagcagccagtgcccttgggttaggcagctcacaagcccaatgcttttgacttaaaacacccctattagaggacttagtactgcctgaccacagtgctatgggtctcaaaatggccttagttaaaaaaaaaaaaatcaaatgtagataagttgactcctttaatcttatttgtaatgtaaatggtaatttgctgcatgccgaggtaaagggtggtttacatggagccactgcaatgcacatttattgttgtgctgtgcacaataggatgtgtgctccagccactcagagggaggcctggaagcaggctgcttgtgagtgcagtctcctcatgcttaccacagagatgctcttgggcaggttacttgacttctttgagtaccaacttcttttcctcttaaactgtccctagtgggacatctgccacaggatggctttcaagactgggagagaactggtgttctgccctagcacccggcctgcagagagcaatgctcctatgagacagagctggcgtcaggattggaaggaagtgatttcggcaccacttcaactatttacaaaatcaaccctgatctcctttgagaacctggagagtgccagtggtgaggaaaaattcagcccattaaattgtgcacatgaaaaccctggaaggagcgtgtgggttatttagtctgtggatcactgtcatcttttgctccgtacttctttaagtattttacttctcaaaagcattttgtataggagagcattccatggtctccatgttaaaggatgggcatagtcagcggaagggaattctgggtaaattagatgaatcagtagacagaaagagtgactcatatcattacaaagattagtgattgccatatttcatgttcttttttgtagaatggactgttgtgctgttatacagtagcaatggaatctttgctggtcactggcaccaattacggtattggagagttgtttattaagtatccactacctttatcaagtgcctgccacttccaggtacttaaaaagcactggatacaaaagatgactcaacaggaacatatgggacgatatcctggatggtttcgagggtaagtgagactgacacagagaggtgggagcatgtgactggagaagaggggcacagactaaagccagacttgtgagacacgatggcacaaatgagcaacactaagcaactgactgcgaggacataaaatgcaaaagcaaagcaaagcaaagcaaaaaaaaaaaaaaaaaaaaaaaagcaaaaaaaaaaaaaaaaagaaaaaagaaaaaaaagaaaaaagaaaaaagaaaaaaaaaagaagctagcctgggaatgaggaaagagctatgctaagggctttggatgcttaggttttattttgtagagggtaaaaggaaatcaaatagccaaatgaagtcaaaggacatccatttcatatttgatatatcactagtacagcctgagcaagatgctttaagtacatcgaagggagctagaaagaaggctactgatttcgactgaggctgactggatgcagctctttcttattattatgcatgtagctatatattatgtattattaggctataattattattattgtgtgtgcacatactctaattacttgtgtgtgtgtgtgtgtgtgtgtgtgtgtgtgtgtgtgtgtgtgtgcatggaggctagagggtaattctgggtgttatatcttaggagttctctctttttctttctttctttttttttggagacagggtttctctatgtagccctggttgtcactgtaaactaggctggccttgactcaccaagatccttccacctttgtctcccaagtgctggcatcaaaggtgtgtgccaccaccacacagcatctccctatgttttaagactgtgtctctctttggttggagctctccaagtagcctaggctagcaggcaaacaagccagaggcagtcacatgtctccatccccctccctccctctcactgggcttgtaccatgctcagcttgctttatttatttatttaaaatgttgcttgtgaagattgaacacagatcatcatgcttaacaagagaagcacattactgccttggctggcctggaactcactatctatactaggttttatacattgtctttgaactcagagatccagagttctggaattaaaggcatcactactcacaagcacttctcttatagcaagagtttatagtttatagtttatagtttcttaaggtcataactgaataacacttaggccatttctctctacaactgcaaaagagcagaattttgttagacttttaacaatattttaaaatcattttcattattaatgtggcatatgttcctgtcttcacaatcattgctaccgatatgtaggtttcgcatctggatagtcaaaccaatgcatctttttttttttttttttaattaggtatttagctcatttacatttccaatgctataccaaaagtcccccatacccacccacccccactcccctacccacccactccccctttttggccctggcgttcccctgtactggggcatataaattttgcgtgtccaatgggcctctctttccagtgatggccgactaggccatcttttgatacatatgcagctagagtcaagagctccagggtactggttagttcataatgttgttccacctatagggttgcagatccctttagctccttgggtactttctctagctcctccattgggagccctgtgatccatccattaggtgactgagcatccacttctgtgtttgctaggccccggcatagtctcacaagagacagctacatctgggtcctttcgataaaatcttgctagtgtatgcaatggtgtcagcgtttggatgctgattatggggtggatccctggatatggcagtctctacatggtccatcctttcatctcagctccaaactttgtctctgtaaatcctgccaagggtgttttgttcccacttctaaggaggggcatagtgtccacacttcagtcttcatttttcttgagtttcatgtgtttagcaaattgtatcttgtatcttgggtatcctaggttttgggctaatatccacttatcagtgagtacatattgtgtgagttcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctgggttctttccagcttctggctattataaataaggctgctatgaacatagtggagcatgtgtccttcttaccagttggggcatcttctggatatatgcccaggagaggtattgctggatcctccggtagtactatgtccaattttctgaggaaccgccaaactgatttccagagtagttgtacaagcctgcaatcccaccaacaacaaaccaatgcatcttgaagctgtgtttggaaagctgccccagagcacgtgcagacattgctgttattgttcctgaacacagcagcctgacaagcacaaggcgcttacatacgaccttttacatttacatgttagtgtacagcttagagatgatttgatgcagtggggatgattgtgcatgatattcaagtactgcattgttttatataagggctggacatccttggatttgggtgtctgtgagagtcttgacaccaacctctgaggattctgtaatatttatcctggcacttcactgcattctcacaacaacactaggcaagaaacatttgcttattttaagtttccactgtgaaaagttctgtaaggattattctcccacccttgaattatttctaaaatatgtatattctccttcatacatggacaaatagtttattactttttaagtcatttatttgtaagtggacaatacttggacttaaggcacactcaaaaggaaggaattcaagtctcttattataaacatagcaaatgaccagtggctggtgaggtcatggatggtctcaagaaggaaacctattcctggcttttcctaaaccagtgtaattgctaacttcttcctaaatccttgtaaccacagagaaatgcagctctagtctctcatcaaagaaaactgcatcaaagaccattataaaaagccacaattagtcaaaatgtggagaacaactgaccatcaggtgcctggcaccaaatgataacatctacaatataatccctcccagaggggcagaggaccaggatgtctgctacatctcaacaatatgggggtttttgtttgtttaatttgtttttgtttttttgttttttgttttttttttttgagacaaggtgtgtgtgtgtgttgtgtgtgtgtgtgtgtgtatcccttgtctgtcctggaattcactttgtagaccaggatggccttgaacaaagatatctgtctgcctctgcctcctgaatgctgttgaactgagagtgagagcaaaaagttaaaaaggatgcaaatatgaaaggaagaagtcaagacattcttacttacagatgggatgtgactcaataccaaagagatcccaaaggaatactttagcccagcaatggtggcatgtgcctttaatcccagcactcaggaggcagaggcagatggatctctgtaagtctgacagcctggtctacacagagaaaccctgtctcaagaaaataaaagactgcatcagaaaacttttagaatagataaacactttcagcaaagtggctgggtacaaagtcaacacataaaaaaaaaaaaatcagtagatgccttttatgccaatgtcaaagatagagaaagcaaccaggaaaacagattcacaacagcttcaactttttttttttttttttttttttttggcttttcgagacagggtttctctatagccctggctgtcctggatctcactctgtagaccaggctggcctcgaactcagaaatccacccagcagcttcaacattttaccttgaattatattgaatcaagtatatagacctctatgataaaaactttaaagcactgaagaaagcaactgagcaagtcaggactgaggattcgggctggaagagctaacctcgtggagaaagcactgtatggatgcagaacatttcatatctcactttttggatgttgtgaacatcagtaatataactttgtatccacttgactggccagaatgaaaacatatgacactaagtactgatttttttccaaggaaatgtataagagtgcatataggagtgtgaatttatttaactatgttggaagaaacttggcattatcctgtgaagctgaacattcaacattttttttttaatgttccagcagtttcattcctaggtatagactcagagaaacatttgcatgtaggtaccaagagagacatctgagaatgtaaatatcaattctgtttgaaattgccccaaacttgaaccagttgcatctatgagcagctgtttacttcagggagttctgttacacagggaaggagagaagcagagccctagtaggctctcaacattttatttataagatgggagaaaaaggtgttctgcttgttttttttttgtcaacttgatacaagctagagtcatctaggaagagggaaagcctcattcagaagatgcctccattggattgtctgtaggcaagtctgcggccattttctgaattagtgattgctgtaggaggcccccaggtcattgtggccagtgtcaccctgatgaggtggtcctgcgttgtataaggaagcaaactgagcaagtcatgggatcaagcagtgtgttcctccttggattctgcctccgttcttgcctccaggttcccgctttgagttcctttcatgatagatagaaagtaagctacaatacactctttccttcccaagttgttgtttgccatgaagcttatcacagccacagaaaacaagccaggacaaagcgtacgcttgtctgcggaagcactgacttgctggcaacggaaactgtagacctgaaggagaacctgatttgccagttgcgtttaccttatacaactccaccccttttcaattttttttccttctttttaaaattggaaataaacttttcataaagtacattctcctcttaaagtcctcccacatccttactgcctcccacccatccagttccaccttcttcgtttttagacaacaaacataccaataaacaaacaaactggaataaaacaaaggaaacagagaaaacaaaaacaaaggacacacacacacacacacacacacacacacacactataaaaacacacacaccataaaaattacaaaattggaaactactagataagcaaaaggtaaaacccgagcacacaaagtgttatgagacacaccatctccacaggtattactgagttagttttgtgtcagccaactcttgctgagcctggggcctgccctaagtgaggtttatatcctagtaagactcctctgagaaaacaagttttcatttgctaactggaggtagcttctgggttagggatgtaaacttgtgaccctcttagcactgggacccatcaggcccctacttgtagagccccgggttagctgcctctgtctctgtgagttcatatatgcattgatcctgtctggaaggtgctgttttcttggtgtctctcatcttcactacctctcaccatctttttctttctttctttctcttcagcatcgtttcctgagccctgaggtttgatgaagatgtcccatttaggactgagtgttccacagcctctcatcctctgcacactgttcactcatggctatctatacaagctctcatctgtaggaggacacttttctgatgctggctcagtgagacactgatctatgcatacagcagaatgttgttaggcgtcattttattgttattgtccttctagcagaacagtagtgtttggtttgctcctgggtccatgcctgtctagtctcaggttcttggccaactgagaagtgtcagggactggctttatttcatggagtggtccctaaatccaaccagacagtggttggttactcccacatcttgtgtggcattgttgtaccagcatatcatgcagagaggccatcattgcataaggaaaggtttgtaactggcttggtgtttagctttatcctctagtcagtgcagagtaccttccaggaccatgaatgctagtgagcagacaaccctctacttttagttttatctactttctacttgccttttgcaaatttgcagatcaactagaacacacagactgactacgccgtggacgtttgtttcaccttctgtagttcctgtagagaacgccatcagtctatcttctaaatcatcccaaaaagcatatccaactcaccacaagtctttacacaccatgcagaagtcaaaaggaatgaacaatatggttgaatcttaggaagaaaatgttgaattagaaaggtaagatagagactacgtgccccgctgtcttttaaaatggtaattaaatataggcagtgttactcaaatgcattggtgctatacaggaacgtgaatgtgtaagtaaaacctcagggcaggctgtgcagtggtgtagcttcccccagcctgaagcgggctggtacagactagtctgccactgaggtggggccacctgtggtgcagctgtccgacctggctggcttctttcgaagtgacaactgccctgctcttctgctacctgctgagaagctgaacccgttttcctgagaatttccggaataagcggccagcctggccaccgagtgctgacgaaatggctccaggcaccaagtgtggagccggcagactagtgctaacaacttggcaacaatacatcaagaagcctggcgggggtgggtggggggggtgggggggcgatgggccttcccccttataagcacggtctcttaataaactcgtgggccttgatcag

SEQ ID NO: 272 - DNA, 62036 bp, Mus musculus
ttcattttctagcgatcactttccttctgctggtgacacactgttacttcaaaggcctggaccggggcgtgtttcctgtaagggtgagcagatttgaatgaccgctcaggatggacctgctctgtaagcacccaccccatggggcaggcaatcttgggaattactgctttcccggcccctgcctgctgggctcggggcctggtgaggtgatgggggtggggtaggggatttcacagttccctagctcaattaggagacaaagcaggattgttcttagctttgttttacggaatttcaattggggggggggtgtaaaaaagattccccgaggacgcaaaaccctaaattgttcttgctttatcttcttgttaaaatgtgttgtgcattcctgggctggaaggcagaggaaataaagcttcgccgctaccccacgcgcccttccctatctagccctgtcaggtcccaagtatttgagggagttctaattacagaggaaacagactccctatctggtctggactcttgtcagtggagagtgctcttaaacgttccacatggattcagggaaatacgatttggagaagtgctgatttttattgggcatgactaactcaagctgcatctttgtatttttttttcactcccttttaagaataatcgcttcaaaatgattaatgatgcctgaagccaccgtcctcacttcctgcggtgaaacgcggaactttttgtgcatgtctgggtttgtacaagggtgggctcccaactcactgagacagtttcccatcctgtccagacagttgggttattgttcaggaaagctgagtctctggggggtggggtgggggctgcagagaggggaccctgttctgtccccctcagggagaaaagaaaggcttcgctccagttacaggagagtgaaattggttaacctctcaaggtgccaggacaagcttgttgctggattagttgggtcctaattctctcttctctctcactccttcttccccgcccccttccctctctcccgtgtgcgcgcgcacgcgcgtgtgaattaagaacaaaaccttggtgtctttgaaaaccagtagaaacaaaaggtcaccaccctgctgggatgcagccatctctaggtccaggcagagctcccctgccccccggaactccccaggggagcatcctgccttcttcctaggatcgtcctgggaaagctgttgcctggtcgtagcccggagaccgcaaggattctagctctagccgagtcccgccctcccatctctgccggcctaggagatatctgcggcagctgcaggggccattttttataaatcgtatttagtaaagactgtgagtgatttttgtagatgacaggaaagtactagaatactggtgactggttcccctggtggattctgagaggctagtttgtcatgtaaatgtttgcaaccttctgtccaactcctccattctgtctttgcatttcagttctgaggaaggccgactggtgaagtatgtactaaaagatttcctttgtgaagctcagtgcaagcaataacaatctcttctgcccataaggtatggagcgcctgagctttggaggactggccacgttaggactagctagcttaaaagagacaagaaggctaacaaaattctctccactaaaggcgcatgccaggcagtgagcagggcacaagcttctctcctgagcagattcatcacaggagatgtcggtgtccaagggattcatcacgttagagcttgtgagccccgactgagaacaacatctgcaaaaaaaaaatatggaaacatgaagtattcctttagggttaccttctattgaaaagtcagggagcacacacctgcagtcccagcacttgggaggcagtggggggaggggctgctgggaggggagctgatctctagtttaaggcatgtctgggatagatagtgaatatcaaacaaataaggagtcaagtgtgagaccaaaatgaactcccccctcccccagattcaatagcctatctgttttttcctgagcagtgctattctggttgtataaatcaaattctcggtttgcagaacgattctggcatcaagtgcattagaaatagtgattttaggcagggttcccagggggttagagctgggagcactggtctttatgttaatagggagagcacctgcttgagcaatctgggaacactggttttcttcccacggtgccttctccatgtgaattaatctgttagctggtatgtgtgtcagtttatttaggaacatgtgtgctgacaattggctcctgactgtaaaataaggtcttgggggagatcatgattaattgcctgccttactgtgtgtgtatgtatatgtgcctttgatgacaggcattatcagtgcgcatgtgtctataaaactaaagacaaactaatggcaagcaattattaagacatcggaagtgtgaatgaacaggaaaacttggagttatctggacttccattctcttcatggacctcggagccagggagatcttacttctgaaatgcagcattttcagatatagaacaggcagaaaagtgttcttggagctcttggaattatagggacacacattttatttaaaagaaacagggctgcttagtacagtggcatgtgcttgcctgccagccttctgttggctaaggcaagttcaaggctggcttgagtgctctaaggagagcttacctcaaaacacaaaacaaagacgccaaccaaaccaaaccaaaccaaccaaccaacccaccaactaataaacaactgcaacagcaacaacaacaaaacaaacaaaaacccacagcaaacaaacaacaaaacaaatacaaacaaaataaacaaacagtgctagatctcaaacagaagatctttacaacaattatttgtttttctgctctgttccagccttctaaagctgtgaatggtggtcagctctgtattcaatgtcttaacaaggcagagtcctattggtctcttattaaagcccagaacaacagacaactggataatacagttccccacaaaacaaaatgtgagcaatttacagtcatttttatcagtgagatattgaaacaaacagcacaaaaggtagcattgcttccttataaaatgaacacagttttatgaagaccaaaacctattcccagagaaatggagctttaagctgaagaactggacaacagtgggggttttgtttgttttggttttggttttggttttctaagacagggtttctctgtgtggccctctgtggagatggatgaagatagaaattttacttcacaaggatgaggaatttttttattggttggttagtaatttgggtgttttctttggacacaggctttcgctgtgcagtcctggctgtcctggaactttctctgtagaccaggctggcctggaactcagagatgtgcctgcctctgcctccagaatgctgggattaaaggtgtgcgccacacccagctaaggcatgctgaagactacaattctggcattagcattctctttggaatattactgtagcatcggaatccagagtgaatctaaggggagggtgcagaggtgaccagctgagagacagcttccccagcatatgacaatttccccagcatatgacaactgtctgagtgctggatgtcctgcacacatctgctcatttgtcttgttttagacactggccttgggaggttgctggaagcgcggtgtggctcctgcagtgggcatctgggggagaggcctgagcttttatcttactaaagccaactgcctgggaatggagaacactgaggagatggaaagggtgagcaaaaagctggaagaggcagagaagtcatctcaataaaaccagagatggcagcaggcagcacggagggctgcaatggcggaactatcagcggctgctgcacgggaggctacgtgggctggaaacaagccagctctgctgtggctagattggggccagggttaggtgggcagccaggccacgagaaggttggtgagaaagtgaagcgggtggcgactgcgcacagttcagaaggcagcagagtggcgggctgtttttctttctttcccagaaggaggacttgaagattctctcaatcactcagcaaatatttattggtgtctactaagagctaaatgcagaggagttggagataaaaggagctcccggtgctccgaaagagctctccgtcccggagcttgcaaagggagaggagaggtgaacagcgagcctaataccgtgtgtgtcaagagccccgtgggaggggaggccacagctcttgtcacacaagagggagagtattgaggcttcctggagggctaattaggcattcaccaggcaaatcgcgaagggagaacaaggggctcagagggacggagctggaaagctcagttgcagaatagtgttgaggcaggaggcagcagtgggtcagcaggctcaggggaaacctccagtatggctcatagggagtttctgaaccacagagtgggtagccgagggcggcaaagagcagcagaggcttgaccaagactggaaaatgaggttccgagggagggagaaaggttggccttggctttcctggcagggtgggggctgaggccatctgccagcacacccgaggattgccatattgtcattatttgagattcacaaagactttcagcagccctgtaaccgactctcactgacaccccagccctacatctgttgatctgcttttaaatgtggtgcgatcttccctccccggtatctgcagcgatgtaagtgccaggcgtgacaggcctggacaggagccaaggagtattgattacatactgtctgtcctctagtcgaaacttgtttatgttccagagtcaaacatcacccaacaggaaggattctttgtgggagttttccaggaaacaaaatcagaagttggttttgcattcattcatgtgtatttaaaagggagtctctggcctctttttaaacttcaaagagaagagtcatataggagatgccacgtaacatcttctgacacaaagaactctgatctgaactccggaggccactgtaccttggggtaaaggaccttctaggttccaactagggtggtgaaccccagagaagaacctagacttttgacatatgaatgttttaggtttaaattttgtgtagatatgcatgtgagtgtggtatatatgtgttagatattgacttctgagtgtgcttatgtgtgtacgcgcagaggcctgaggaagatgttggatggatgctcagtcctgttgatctcccttgaggtctctcatggaaccttgagacagacttgcatcctgcaagtctctttcatccctctgtctccacacccctcagcactgaggttaccgtggtgtggggtcaagctcagctttttgttagggtgcgggcatcctacccaggtccctcacacttgtgacgctgccactcctacccactgagctatctccctcatcacatctccttttagatccaaataagcactttccaacagtaattctcagttctttcctgtatgtagcttgcatagtgaagttggctaatgtgaatttcataagttcgtgaaaatctgtgtcagccaagggacccactagtatctactgagaggcaagaggggccagaatatgagaaaaatctatacacaggaagtccgaggggggggggaggatgcagacattgcaaagagaataggttttgcagaagatggctgacacatttgactttattcatgatagttttaccatgtaaactagatgatttttggcaagggtttgaatggagtgcaatttattccattttttttctttacacacacacacacacacacacacacacacacacacacactgaaggaaaaagcaacagtgttttcagaagaacagcatgagttattcacttagagaatgtttagtcttgcaaggagttgacacgatagagtactgtccctgacacctctgtctctcactaccaccccaaagatctccaggccctgtcacgttacagcgcacagagactgcatagctgtgactagtacaagaatcttgaagacagagtttgttttctggatgggccaatgcactctcagaagaggaaggtaggagtgttaggtcaggagggaggcagaaagctgggtcagggcatgtgcatacagaagcagaaatcagcgtgatgccaatcctggaagcaagctgggagcaaaagaaaccaaaggagccaggcatccagcaaccggagagggcaggaactggagagtctctgcagaagcctctagaagaaatgcagtgctgtactgacacccaactttagcccttagtacccactctggccatctgacttccactttgttaaagttacattgtttcaagctattacggtctgagttccttgttacatcagcaagaggaaactaataataaacctagtgagtggttggatcgcttggagtttatattgtttctgcattctagacctgctcttaagtgtcctatgtgataattcacttcacatgttcttcttttgtaagccgtacctctctatgtgtgctctatgtgtgtgtgtgtctgtctgtctgtgtggtagtgctaggaggtcctgaagatggaacccagggtcttgaaagctccaccctgtcccactcttgcttttacacgcccatctctattagcggagagcccccaggggaagaacagccttattctagctccgtgtctctgcgtgggcgccgtgctccgtgtgggggccttgcacatttgctgagtaagcgactcaagaaaagtgcctgggagacaggtttcaagtggattcattgtgactgtcctctctggtttggttagatgggggggggggtgtcactcttcaatttgaagataacaaccttagaagaaaggcccagccttgccccagccttcacactgtgtgtgcctctggaatgactcttctttttggatgcagtctgccctgggagctgtgggctgagttcctgtgagatttgttgtctctgctggattccataccaacagaagctgggttcttgagagaactgcttcttttttttttcttttttcgttcttgctagagttcctgtggaatctagagagtgtagtgtgaacttagaattacggcttttctatgtcagcagttcttggggtggggggtcctctgcctcagggtgctgaagaaagtctctttgtcacctgtcacaatactacctccctctacctgagaactgatttctttgtttctcttctccccccttctctatatatggaactttcctttccccagcattggggcataacatgcccctcccccacccagcttccaccccctgcttctgtttccctctaacccagcttgccgggtctttgtctgctgctggtgacaagcagttcaggagttcacagcacacattctcatggtgaagacaacttccttttcaaagaggtccctgggcatttctaaaatgaagccctagaggaagaggaggaggctgtgccgcccgccggctctgcctctgtcactgcacagatcccccacattgtcgttaaccgaatagaggaggaagtgggcatctagcacaggaagctaggaagaggaggaggatgtgcgccggctctgcctttgtcgctgcacagatccccgcattgtgctagcttcctgtgtgagatgctcacctcctctaccaggttagcgacagctctctctaaaacacatgttgggctgaaagactggttttccctgacagatgaaggaatttccataaagataattaaaataatgtgaaaggcatatatggcccacacacctgaaaccagggacttggcagattttcctacaccacatacacaggggcattagtgactaaggtaagaacaacccaagtgtccaccagcagagtagataatgtttgaatgcataaacaaatgtggcatttgcatacaatgggacattaaccttagaaaagggtgatattctgatatctgatgcaggctacaacatgagtcacccttgaatacattttgcagagtgaagtaagccagatacagaaagataagtactgtgctgttccgcctctgtgggagaactgaaaactcacagaactgtggtcaccagaggcctggggagaggggccatggagttacagtctaaggggtcagctgttcaaggaggtggatgcacactaacatgcatcggtttaatcactaggtactcatcatcaagtctttttgtttttgttttgttttgttttgttttgttttgttttgtttttgttttgttttttcgagacagggtttctctgtatagccctggctgtcctggaactcacacactctgtagaccaggctgacctcgaactcagaaatctacctgcctctgcctcccaagtgctggaattcaaggcgtgcaccaccactacccggcgtcatccagtctcaatgaaactgaccagtgcacttggtgtggtgacacttggtgtggtgacacttggtgtggtgacacttggtgtggtgacactggtagagcttaccttggccgtccttttaccacaatagaaaatgggaacaacgaggaatatgggcattataattttgctgtttcttcattatttatttttcttttttggccaaggctgcaagtagaaggttcaaacgatgtacaaatagttggagatttaccaaccaacatcgctgctgtttgtgtatcatctatgctgtgatgtgaataacacttattcaaacaccaatgagaatacattttcctcctaagtaatttttttccctgtgacttttgtacaccaatctaggaaagaaaacatatctattgagacaaatacatgctttcaaaggtcaccaaaataaacttggtgactgtggcaacccttggaactgggcagaggaacctgcattttgcaatgcttgcgcacacactgaatgatactacttgtcctgggttccctgacttcatacaggaaatatgtgacctccgggtcctcaggctctctgaaagggagctttgataaagacaaagcgagcagggggattcctcttggttcaggtaatttttgcggctgatagttgtgatcaagttttgaaaaacaaataccacctgctcaccgctgaatctgggaacaagagttccagtggaaggacgcagatttgatggccagaggcccggggtgcttggcaggctaacagggtgatttttttagtgagtcattttgacattcggtgacccacctcgcgcccatcagtcttcataggccggcccagggtaaatgcctgtctacagtttggggcgcaggcctagtggaagcaaatgtgccacctccaggggagcataaaagacagaccataggagatcacaaacctgggagactcccgcctttgtcctgaccggtcattcagtactatttaaaatatcacattgaaagttagctccttcttcttccctgcttcactcccgctctcttcttccttcctttctttctttttgctttctttcttttattttctacctgttttttttgcggctcatgcttcttaccctttatatcatccagaactacacatgcctgctgatacacttatgtgcatgtgcacatgtacccacacacaccacaccctatacacacaccatacacatgcatatacatacacacatcatacacacctcatactcacaccacaccctacacacagacgcacgcacaccacatcctacacacatactcacaccacacaacctgcacacacaccactttttatgcacacacacatacaccacactttacacacacacagcatacataccacacataccacaccgtatacacaccctatacacacaccacatcctacaccatacacacaccatacaaccacacacaccacatcatacacacatgcacacacaccatacatcctaaacacataccacatcctatgcacacacacatataccacacactacacacacaccataccctatacacatacaacccacatcctacacacccccacatacatcacccctccacatacacacactacacatatcacacacatcacaccctacatacacatactacacatatcacatacctcaccatacacacactacacatgcatacatatgtatgagcaccaaattaatctctgcttttttttctttcatgtcttcagaatagaattataggtagctatgatataaaatcgaaaccgaagggagctggcggatagaatagaaaatatagagaagacgtgggcatagcccttccttagaattttcccttctgcggttctcttcaaccactgcacacaaaagccaggcctttccagataccaggggtactggagagcccaaagtgggaacaaccaagcatgctatgtcctttttgaagcaggggctataattctgcttgggagatgctgtgctactgaggagctagctgatagacagcatgggaggctgcagggtgaaccttcctggggctgtgagaaagcaaaggctgtttgctggcttctctctctctcttcctctctctctctctctctctctctctctctctctcttcctttctcttcctttctctcttcctctctctttctctctctctgtctctctctctgtctctctctgtctctcttttgtagggaggtctctgtatagcccaggctatcctggaactcactctagaccaggctggcctcaaacttagaaatctacctgcctctgcctcccaagtactgggattaaggtgtgtaccaccactgcctgacttgctgacttctttctatctccatgactagactcaggttggcaggatgatctgagaggtcaacttaacaatctggagcacagattgatcaacaactggaaaaaatttattgtagcatttgaaatgttaaatatcagcagtaataactgtagtaatgatgatattattatagctaagagaccagctaggtatttttatgtggcatgttttgaatcctgtgacacagtgctgttttctttgcttcaaactctggagacagctactattgttaaaagcaatacacagggtatcccctgtggagagataaggtatatgcatattgaagccttggagtgaccatttgagcagatatccatgattcatgagttggacagctccgaactgcaggtgtttggagttccagccaagggtgggagtgggggcaggggagggggtcatatggtaagtattgaatcccagtagagaggtgactgactagagtggggtagtagccttcaagtcgcaggttagaggttaggttggcatgttctgccaggtaaaacaagtctcagttgccagctgtgattcttcctgctgagttgacattctagtttgtggatggagcgtccgaggacgccacagctgcctcagtgtaatgacctcccatttaatcatcataacactccattttacatattgaggctacaagaagctatttacctaaggactggatgactaagaggcagacgcttcattatttgtccgtgtttcgcctcctccttttacttctttaagattggtggttcctgtatttgacgacgacgatgcctcccgatccaccataaccatcaggaaacaaagtgaagtgtttttggaaaaaaaaaatctccctgtggtagaagagggagacaggcagttgtctgtagtcatctggtggccagctaaggtggcaagccttccttcccataggccggttgttctgacagcatgcagcaggcatgctttaatttaattagctttgaggaggtaagaacggacaattttgaggtgtggtttttcttgaggtggtgtgcagatacgtaaaggcgtttttttaaaatggtgttttagtggggcaattacagagcttgagtaattttgtgtttcgattagggagagtcaacattacagtgtagggtgaggactcacgctgccagggagagacagacaattggtggctgcctccatatggagagccccggcccttcataggtgtcatccagtcagtgacttggcgattcctgccctttccactttccctgctgtgtgcgctgggcacttggcactggaggactttgtcttccatgcccctgcctctgtttcagagtgggaggtgtagcagagcctagagagtaagatgagggggaggtgggggattgcttctctgttctgtgttgtgcttctaaaaattagtttcctcttgaagacagctccagcaggccgctcctccttcagggtttcactacaaaatggaccccaggataacgatacctctttcctgtgccttcagtcccggatgctagcagtgactctcattcaaaggctccgcccagagtgcatggcctcactaagcagttccctcagagttacataccctttatcccacctgtggtggatgcttatttaccaagacagaaacaccttggtaattctttttgttttttaagatttatttatttattttatgcatatgagtacaccaccattgctcccatcagacacaccagaagagggcaccagaccccattacagatggctgtgagccaccatgtggttgctgggaattgaactcaggacctctggaagagcagtcagtgctcctaatcgctgagccatctctccagcccccactttggtgattcttaagttggatgtacgcacataccttagggatccagttcaaggacagattcagaaagcctgggttagggtccaagagtccacaccttaacaggtgccaggtgatgtggaggctactggtctctggaacaccattcactgtatgatcacagctggaaatctattcctagacatcttttgaaaattaccgctggttgtggtggcacacgcctgtaggatttgctgaaggaggcagaggcaggtggatttctgagttcgaggtcagcctggtctacaaagtgagttctgccaggacagtcagggctacacagagaaaccctgtctcgaaaaaccgaaaaaaaaatcgctttctgctcacacgcgtgtgtgtgtgtgtgtgtgtgtgtgtgtgtgtgtgtgtgtgttttgtgtgttctctacaaaagcaactgaagaaatgctaggtccacaagttgctgacttattgtgagttgttccagggaaacttattctgaactatggacagtgaaggttagcagagagatacagaatttgattttagaaatttacctccttagagcagcaactgtagatctagcatcataagtatttgtaaataaagttttattggcacccagctgtgctcatttgcttgtgcattgtctaagtctatttgcctctcagtggcagtttgaatgcttacagcaggaaccagatggctttaagcatggactatttactaacctgacttttacaggaagataatgtggaactctgcctctgactattacaaggggtctctcaaaaactaaaatctttgggcaaaacgcaactacagggaccatcttgtctctttttacagacaaggatccttctattgccccagaaatactgggttttaaaagaagctggggggctggtgagatggctcagcaggtaagagcacccgactgctcttccgaaggtcctgagttcaaatcccagcaaccacatggtggctcacaaccatccctaatgagatctgactccctcttctggtgtgtctgaagacagctacagtgtacttacatataataaataaataaatctttaaaaaaaaaaaaagaagaagctgggacaactcaatgtaatttgaaggaaatcaacagttattacatgccctttaaggagagccagccttcaagatagaggttggaaagctaacatgtgctgttgtgacattgggctctgggctattcagagtcaacagactgttaatattttctatttctacatatgaacagttgtttctttgtcgtcatccttaccccccaatttgaatggttcataagtcagaatcagatttccaagggccgtttgggcctggagatctttacaacagcttacaaacagctgctccaaatgaaatacgctaagtaaggctggccgctctttcccagacagcaccccaacctgtcattattccctaccaaacagttgggagtcaggtacaggtactataggggaacatgggcacccacagaaaactacatacttagtatagcctcttatgtagccttggctacactcaaaatcatttggaggctcggctcgtgagctgcctgtcaaacacggatggaagtatatgggatgaaggaccctttggcatttagtggctctgaaagcagtgtggagctattactttagactttaaggaacatcttcagcaataatttctagcacttgtggattcaagggaaaaatgtgcaaaatatcgatttgtcacagttgcatgtcattgtcactcagtcactcctaatggaagtcagcttcaaaattgttggacgtttcttggtggaaggttttttttcttactgttggtatcaggacctccgaaacccgttacatcacataggcgggacacgtagaccaattgccaaggcaactgccaccacattccctgaatcaacttggctcacctcgcacctttacctggattacgtcatcagccatatataaagaaagtcgtccccccccccccgcctcttccccccctttctctttctgcttccaccttgcccctctctctcccaataaacctctctctcccaataaacctcatgtggaactgtttgtcctggtgaggtccttctgaagccttgagacgttcaagatcataacactctcagatgttacaagcatctttgcaagttgtctgcagactaaagcatcctgaacacctgtccgcagatcaaatagaaaatgcactgaattttaactgtgagctctgaactgtatcagtgtatcaatttcactagtgcttagcatagccttgccctgttgtagatacaggaagagcaagagcatgcacgttgtttagtgggatgggagctaagctgttgtgtcaggcttgcattaacgcctatattcagagaacaacgaaccactgtgagaacacagttatgctggctgggagacagttgcttccaggtcttggttgtaggctctcctgtccttccgacggttccagcaaggtcaccctagtttggatctgctgacagtagcaatcatgctgaagctgcagacctctgcaagtttacactgtgactggacaataatgcttggaatgtatattgggcctttcatctttgaagttcaatgttctaactgtaatctttatgacttcttggtgaggtagcaactgggggattgttttgatttgaggtagaggtgtggacttgtggcagacatccaggttcaagggtctgtttggggtccctgcaggagtcaaggctgaggtaggaacagagatggatattttgtagccctatgtagaaaatttctttattctctctctctttttttcaattcaaaggcagtgtgtcaccctcacccccacccccaactccctgtaggaaagaaatatgtgcaaggattctagctcattccaagtatattaaaagtcagaagtggaaatcaaattacaaagtctaacttttctaaagtcttttcaaagtacttctaaagcctttggtctaagagctgggcttaacttgaagcttagaatatattcacgatctctgcttttccctctccgcctggctggtcttacttccttaaggtaacaactgcctgtactagaactcacaggcttgttttgccctgatgattgccagccgcaccgcaccgaggctttccagagattacctcctctcagatcctaacacaacaacagcactttcagattcgagactttataattaaggcatgatggttatttgcaggacagtggaggattatcatgcagattagaaacaggtctgtataaataataataaaacctaagggggttgtacaggcacatgaaagaatccatgttagataaccaataatatctgcctccttgaaaaatctcattagcatttatcaagtagttaatggtctcaaaacacttgacaggtaatccatagaacatccttggcagataattaaatattctgatctgaacttgcaggagcagacacaccaagcatccgtgagacttgaccggaaggataagacaggaagccgctgttggagtaggcaatcaataactgcacgttcctcagctcctcagagacatggctgtccacgctgttcttcagcgtgacctttcagagtcacgacgaaaacccagtcaaggagaaaacttacttttcctttagcaaactcatatttggttcaatagaaatgcagtgaatttccataaaaatgattccatggctgctgccaggcttatttgtagagggtaagtaggatgctacccactcactggtgagctccgaggtacaggaacttcggccccctcagcttgtgcgttctgaggattcttaggacagctgagtgtatttgctggggatctgacagtgctagagaaggactccttgttccagcgcctacagcaacagtgccattttggaaacgctgtgctgtaccgtggtacagagaggaagtattacaaacattatcatgagacattctttaaggtgcaatgaacgacttcttccttttgtaaactcacttaaagcccttctttgagctccctctcaaatcttatctagtagtactttatattgataatgtagggcgagccaagagattatgttgggggtctatatcgagataatacgtggtaagtatatgaagagggctttagattagtaacaagtgaaaaaatttcaactttggagaaaaggtaaaaacagactttttcttgtttctagttttacttgaagatttctcacagtactaacacacacatacgcgcgcgcacacacacacacacacacacacacacacacacacacacacgcgtgcacacgcacacgcactcacctatgtgcgtgtgcagctgctatggatggaacgcagagtcttaggcatgccaagcaagtgcttacccctgagccacatccccagctccactttcaagaatgggtctcactgtgtcatttagactggcttccaactgtcagccttcctgcctcagcccaccaagtgctgggactataggaccaggaccaccatacctggctctactttattgtttttctctcagtgcagctaaaacgtgacacaaaacaacctcggagacagaattttattaaaagacgttaaccttgacaagtaaatgtttcctttaactgtttcttctggaggagccatttcctccccctccccaaactttcattttttacatcaaagacaatatgctcagttggtaatggcctaaccaagtcccgtgtgtcagttgtgctttcaacagctttgcgttgctagatacctgtgaatgagggctgtcttcattttgtagagggtgaaagtcagtcgggtaatacaataagaaggtcatacactaatctgtgaggaagtcagggtctaaaccagggcaatccagctgcaggctgttaaccgatgtttatagcaatcgccaaacaacccttttgatcctggggtggggtggggtgggaatgttgaagacttgtcacaggagaataggctgtttttaggaagctcttctcagtgagaaaaaccagcagagttggctttagtcataaaatgtttccaacgtgactagtgacttacacttagagacagtgcattgactctgggtttactaaaggtatacatgatagagtataggagctttccttccactgactttgataacaggaaagggaagacaggagaacagtggagaatcgtaaaggaaaggagagggggtaaaggtgtagtttctaatggcttaagtccttcctgggcctgatgctttgactcagcatagatagcatccaactacgttcctgtgtatataaatctacgtgtagcatttgtatgaaagaccctttccaaggaccacatgctatacatccctcgggtgataacaactgcagcgtttggagtgagtgctgcccactgagagcctccccgagttaacctcttaacaaagtgcaggggacaggattttcaaagggaaagaagccctgtgaagcagaggctgggaaagtctgaaactgcacccagatggccttgctgttaggccttatctcacagagccagggatgaaaggtgagaggccggtcaacctctgtttatttctgccctcctgctctgtctgatgctttgaccccagagctgctctttgtattctcttccacctcctccctgcagtcggaggcagcctgctcatcagcagttcttgctgacagcagcacagaaatattgtagcgtacaccaagaccacttgaggcaggtcgacttcaagcagtaatagactagcgtcctagcctcagtgctaggagagatggagaagcagagttctggggagtcgtgcagagagctgcatcctctttgcagagggaaggctactgggggcatgactaacaccaggggagccgtttatgtcgtattcctttcctgagatacttattagtgttatttacagtaggttttattattggggccacgccttaagaatggcttttcctaagcagggtggtagcgatgcacacccttaatcccagcactgggaggcagaggtagatggatctctgtgagttcgaggtcagcctggtctacagagtgagtttcaggacaactagggctgttacacagagaaaccctctcttgaacaactaaataaaaaacaaaataaaataaaatcttttcttccttcccttcctccctccttcccccttccttctgtccttccatcctttctaacttccttcttttctatcttctgttcctcttcagttttggctgttggctctacacttctgtataccacaaactactaaaggaaagaaagtaaggctaacagaaagataactccatacttgtatacaacgagagacgccagatcactcttgggctgacagatcttacttttgctgcatcaaactgttgggtaaaacaactctcattttctctcatggttttgcaggaagggaccccttggagtgggaggtagcagcaggcagcagcatccttcctcagaggcgatgcctcaatgacttgagcccccacacacacttcacaaagactggtttacaacgtaagaacgtaagaaaatgatcgagcacagtattagctcatcacagccctccagacacttgttttcgttggaagagttttcaggagactacaaggtgaagggaagccctggtatcctgcttctgggacctttttaaaaatcgtgttcagccgggtagtggtggcccatgccttgaataccagcacttggaaggcagaggcaggtggatttctgagtttgaggccagcctggtctacagagtaagttccaggatagccagggctatatagagaaaccctgtcttgaaaaatcaagaagaaaaaaacatgtccaatgctccagatctcttctgtcatggcatgcaaatggagatgtcatcgctggtgggaattcatccaatgtggaataggctgggtggagtgatacttggtgcccatggctacaaaataatttggaaccattttcccactgattacagctagactgtaccttgggaatctgggtgggtgctagtcacggagtggaggaaaggcagagaatggcggtggtggcagatctcagccttgcttggacccattagaacaacttgatgctgcctgtgatcttgagaaccctgcttcacaaacccaggatccctttccttagtgaaatctcttctcctgttgagacaagcgggagacatctgttgttatttgaagacgctctcaggagcctgctgggttccattcaacctggtaaatacagttttctttacattgttctgtcttccgtgactcaagtactcctgtgctatccccacctggcacccaggaataacgtttctgccgacccttaatagcgtgccaagaaatagaagcatttcttaaaccagcttgtctgctccctctccctgggttgagggagagtgtctgtctggtgggagggatgcaaaggagatcagggagccttgtgcaaccgccagggatgacccacatcagggcagagcagatgttatctaggggaggtcaactggagacagatgttgcgttgtggcttctgtctgcttcagctacgaaccagagatctgaaccttactacttagatgttgttatgtccccttccgttccctacactgcggtactcagaatgcaactgcagataccgttagttgagatgagttttgatgcctttcacactggcttctcgatgagcacagccatattctttgctccctttctttatagatgctgccctggaccaggggccattggtatgaaatcacacgcatctcttggtgctttctactagaagttccctaagtcatgcagctgtgtcaagggggtccttctgattgggctggggttacccaggccagagggagaaccttagaaatggatgatgagtgttcccttggttgtaggtcatgggagaatattctagaccacggcatgattaaccagaatgaaattctcatgcgcctcatggagatttaaatgaacaggagggccacgcctagagttttactaattggacttcacccagatgcaagagcttgtaaacttcaaagatcgaggcaaacatttgttgatttcctgaacgtgtttgggggacgaacctttgcttgttctctggaatggcacctcaggcagtaaggtgggcaatttacaactgcagcacaacacaggccaaagtcaaggttccgcactggggttgcttcccctccagagctttcagttgctggcatgcctaaaacagagacacatctgagagcagagatgggagaggcagatgaaggagaggaaagtgctctggtaaaacaaggcaggctttttaaatgtcccggggttcctgcgacagggctccctccttctctgaggttagtatatttaattattaaacacagggcttcatcaacatttggactccttggagacaagcagcaattatctcagattctgttcccactgccatcccgccccaacttcaaaggcaactcattactaggccccgaattcttcaaattactttcccatcatctcaaatgatgtttataagtagttcataatgagagtctaatctcactcctcagattactaaagaagctctcggaagatggactgagataaaattatcccaactcgggctgattatctttggatcaggctttccaacaagattttagtcaccggtttgttaaagttttttaaccggtttttaggagatattttatgtacatatatttacaagaataatttatacagacttgtcccgggctcttatttgcaaattaacatctaaatgagacttctcaaaatgagctattttatgtcttgcagatgaataattaaaaatgtatattaaattcaaacaaatgtgatgagcctgtctttgaggttgccagtaaaatatagtcgcctttgttttatggaagattgtatttcatataaggaagatcaagccgtcccagggcccgtaaggctttattaatagtcagacagcctacttcattaatctgagcagtgtcaaggtttgcccttgacaacaacaacaaaagaaaggaaaaaaaaaaaaaacagagaaaagaggcatagtcatcccatcttatgtttgtcactttaagactgttttttgtcagtcattatttacatgattgtttgatatcaatgtgaacagtagaccaggtagagcggctgtaagaatcttctggaaatcatccttgtatagactttagaattctcacgcttgcgtcagactgaagccactctcccgaatcttatactgttgactgcttttctttccctcggttgccagccctcgaaagctggctccccttttgtggaagtcaggtgggctgtctggtcctcaaggtgtccttacaggttgcaaagggagaagaggaaatggggtgtagggggggttgaatgtgagaggatctgcctgccattggcctttcaagttttttgcagggtagacagctactgagctacaattccactgcagagcgacggtgatcaggaggatgggacgagtttgcaaggcaacatgaactggagggcaacgtaacgaagcagcatccatcacacgtgttcaaaaacagacatatgttgacacagagatggaaaaactatactgtgaaaactggaactcctccactttttatatattctatagcaaggacctttagactgtgaccgtcccttgtcacccctactttatctttcttgtcccgtattgttacaattctgtgctaaagccagaaaagccattcagggagatgagtcgagggaggttctatgtcgcccagctttgagagaactgagtgagcttttccaacaaaaggatgaaggatgttgcgatgcctgtcatgcttgtgtgcatgtctgcctatctttccttacctgaacgggatcagatgccataaaaaaccggaaactttgacatgtgatcacattaatttttaactgtgatctcttggcattagagaccaaatcactgaagagagatacagcttaatagtctgtttcctgggaggagagaagagacttgtaaaagagagaaagcaatgcaggttaaggcagggacggcaggtagagggcttttcttactccatcctgttcttggggtgtcaggtcacctggctgcctggctagaaagaagggcataattcaaacagaagcaaggaccagacagacagaaggcagtgggaagctatcaggagcaggtgaagaccagagccctgtattgttattatttttttgtgtgtgtgggagcagaaaactttattgatggtattcaagagagtagggagggctccttaggcccttcctgttatgggtgtctggggtggaaattgtgagggagatgctcagtgttgggggcccgagttgggatagggtctcctcagcaacttagggcctctctcttggtctcagtgtccttgctagggtaggtggtccagggtttcttactccatggaggccatgtaggccatgaggtccaccaccctgttgttgtagtcgtattcattgtcataccaggaaatgagcttgacaaagttgtcattgagagcaatgccagccccggcatcgaaggtggaagagtgggagttgctgctgaagtcgcaggagacaacctggtcctcagtgtagcccaagatgcccttcagtgggtcctcagatgccttcttcaccaccttcttgatgtcatcatacttggcaggtttctccaggcggcatgtcagatccacgaaggacacattgggggtaggaacacggaaggccatgccagtgagcttcccgttcagctctgggatgaccttgcccacagccttggcagcaccagtggatgcagggatgatgttctgggcagtcccacgaccatcacgccacagctttccagaggggccatccacagtcttctgagtggcagtgatggcatggaccatggtcatgagcccttccacgatgccaaagttgtcatggatgaccttggccaggggggctaagcattggtggtgcaggatgcattgctgacaatcttgagtgagttgtcatatttctcgtagttcacacccatcacaaacatgggggcatcggcagaaggggcagaaatgatgacccttttggccccacccttcaagtgggccctggccttctccatgatggtgaagacaccagtagactccaccacatactcagcaccggcctcaccccatttgatgttatcgggatcttgctcctggaagatggtgatggacttcccgttgatgacaagcttcccattctcggccttgactgtgctgttgaatttgccgtgggtgaagtcatcctggaacacgtagaccatgtagttgaggtcaatgaaggggtccttgatggctacatggtccacctgaacccagcttttctgtatgtgtgtctttcatctcgctgtgcctcgttgtccaagtcaggtcgaagttgtgcagatagatcttggtaggacacagaagaaaaggagaaaaaatcttgtttgtaaaataaaccatctgtatgaagtctgtgtcttttgagctagtgttcctgtgattcctgctttccagggaccgacatttcaaagaatagcaaccaccaccactgcaaagatgcaagaggaaggtccgcccccagtgagtgtgggctcctcgttaccaacatcatcgtgtacagagaaaacccatgtagagcaaaattaagctgtttttaaaagccccttggctttgtctaaatgcattgcttaacacagacacaattgtgtgtgctctcttgcttctagagggtgttccattttgtttgaaatctactcattctctgactggccagagaaacctcttgcagcttgtgaagttattcccatctaacactgttagcgtagtgtctctgattagtccagatgattaaaaagaatctggattaaatccccaaagaacctgaacagcagagcaagttggattgtatcctgccttcatgtctatgcagcaactcaaccaacagtgataagacgtgggcaacagaaggtctgtagggagctggaatgatcattggtcgaaagtcaccattggatgcttacattcggaagtctggaagaagaatctgctacatggccaaattctatacagataattagattgccatgagcatgccagtactaggactgagtcagactgctacttagctgtcttctggcaagtcctaggtaaagcctgacccacccctgtaatcttcaagacatagctatcgttttttattaagccctttggaggatcttcagagtctgggaccttattctctctctctctctctctctctctctctctctctctctctctctctccccctccccctccctgtcaccctccccctccccctcccctctctctccatggaccataagatcataacttgtttacttttttgtgaaaatcagccctccttttttttaatcccccctcccagggtttgtggaatgggccttggccttacctgtctcttttgttccttgaaaggtaaacatttatcctttgtcctttactggctttgaaacagatggcaacagaattaataactgtggaaaaatgaaatgtgtcattttgtactttttcatgagttcctttctgttctccatgcagtagttttgtgggtaggctctcttgtgtctctaagtgtccccttccccgtgatctcagcctgtcccttgagctttcctgcctctttctacagaacctcggcacataggcaaatcaggcaaagtagtgaccaatgtctgccaaagctggagctatgatcatgttcacatgggttgagtgtgggacacaggtcccagtacacagaagcacttgttgaaacacttagtgtaggagttggatgtagcagtagcttctgcttccctgccttaagctctaggaatgagctgagctaccaacccccacccagattccctcggatccgtggatgaaacacacacgcgcacacacacacacacacacacacacacacacacacacacacacacacacagacacacacacacacacacagacacacacacacagacacacacacacacacacacacacacacacacacacaaatcacaaatttaatttttaacctgccttatggcccaattgctggatgtttctaatctgcctagggaaatggcctatggccactcagccagagatctcacatggctggttaccctttctttctccctcagaatcatggtgaaaatcctctctcccctgcatttgctagcttgcctgcagggacccggaagtcatgcctattccacccagctcaatggcctcttgcatctttcttgatagatcaagaaccaattggggagcaagaccttagcatcagaaccacctccaacagttggacagagagctcagtggttaatggcacacattgtcctggcagaggaccgagttctgcgcccaacacgcttatcaggatgctcatagctgtctgtagctctggtttcaggaggtttgataccccatgttctcctcatacatagacatgtgtaggttcccgtaaataaagaaacaaaaagaaatacctagtatagaatcttgctatgcttgtgtctttctccggggactggaacgcaaagccccatgacctgaaatggacaagttgccatgttgctgggtgtacacacttgcagctatcttggagtgactgtgcattggtattcaggatagccaatgtgctttcctcccttctaaggagctccttcccagaggctcatcagttctctgctgagtgtgaccagactacacagcctctgggagtaggtaaaatgtgggcttgttcctaggaagatgcttgactctcaagagaacttgcagcaagctcaacatggcaattcagtctccgagagagcagatccccaaaggggaaggtggagagtcaggctgaatccgatctcctggctcagccaccctcgctggctcctggctgtgaaacagtgaaatcgtcccactggttctttgcttttcatttggttgctaagcatggggctcaccaaaccctctttctgcatcagaaataatatgactgaggttttgtgtcttgactgtctgtgaaggcctatcataggagtcacatacgtctagtactagagacccttggatgggttgcctatggcccttgtcacaatgcagacatgactgcagggcatttcccccatagtttaacagaacaatttatcaattactaggtagtcatatataaattcagaatttagtgggatctaaatgaattttagatgaatttcctcacttttaattttcacattaagtcggtatatggtaaatcttaatgggactattattcagaatagagcagatttttatttttctgtacctataaaagtataatgcactttggaaaaaacatctctgtagagaaaaaggaaaaccaaactgcagatgtcatgagtgtgttagacaaagataagaaccaaatttgcaggaagtaaaacatttactttgtcagctgctaagtgtttggctttgaatgcagcgttatcagttatccacagaactcggtgctgtaactatgagcctctttgttactgtattttttcctaactctgcttctcccaatttcatcccatcttgattgcatttctctgagtcttcagacatctcagagatcctgtgatgctgtctccaatggtggcaggaggtgttcatagcaggttccttgcagttaactgttgagtcctgcctcaaagtgagtcagtttatgagttcgagtttgtaaagtactcagagatcctcatgtgaaatgcaagatccgagtacgctgggttcttgcttcctcttattcatcttttgtcaagtgcctggtaccacaacaatattcactgagtaaataataagccgaatgaaacacacttccgtctccattttaataatgtactattcatactttttttttttctggaacaaagaatcattgtgggaagttgctctgccaatattagcctgatatcttattgcaagcggaatgaagagataaaatggcaaggcccaggaacactgataaagtctcctttcaaacaaaagcgaatagggtaacaacacaaacgacagaaagccaagatcctgcttggtgccattaaaggaacgtgaatgtatgcgctcggttattccaatacttgccctggttataaactgctgagatgcccagaggaaaatcataattatagtttcctgagcaattctctgttgtttttggaaagctattgttctctggttgtgatcgcagccttaggagaggctgacagagatgtttaacagagagcagaaccattgccagccatttccagtgggaattgagctaccaaatatttttctcaaattatagaaaattgccatttgtagagtccacacagcatttaacttcttaatttaggattagacatctgtaacttattgttaggacatccggagggtttgcaaaactctgcaatatgaatatatctttcagttttgtcttatagcatctctgaagaaaattgccttggtcctgtctataaagagttgctgatggccgaaagaaccactctgtaattttacagctgaaaagatgaggtcttccccagggcagtgttgacatgttttcgcccaaatttgccaccacttgaccagggaccctgacagtggttagccttcgggctgctgccacaattccaactggatctagcagagcagagaggaactcctctctcatgcctccatcttagctgaagaccaggcagaatagcaatgaaacttttggaagccaggattcccattgctcctttctctctttctattaacactcaggtggcatgggtgagttgattttaaattatggacataaggatcatttgatgactaataaagtcgaggggtttaaagtttttgaaggatggagagacttgtaaggcaatttggatcttttctttgtaattcgctcagattcgtttcagttctgtttcttcagataggtcatgatggcttcctgttgtgtctggccagtagatcacaacctgggttttagcctggaaaggcattttggaaacctggaagagaagaggggctgggctgtgcgagataaggaaggaaccaagacaaagctctctgctcaaggtttaatttttactatttcggcactcaattataaaggaagggggaggggcccaatttccgccaaataatcttgaagtccagtagtagggtgatcacgtgatggcttcgaaacagcaaagcggcaggttccagcagtaggcgtgacaaaaagattgagtgaaaagctccacccctgagcaagcaggtttcagtctgggggaggggagactacagcttccaagagaaggctgcactgaagtctgagccttgaaggaaggcgaagatgatcctggactaagattcaaggggctaaaagaatggtgtgggcaaaactgggcagttggagttgatgacatggccttgcccagaagtacagaggaagctagaaaaattccacaagttgtaggcatgagtgtggctttctctggaaagccatctttgatgtgcaacactagactgattgctgtttctctacacttccagaatgttctgttcttgacccaaggtagcagaacatggaattatgttcttattggtacccgtccgctgtattaagctccatatagggaagactttgacttgaccacatgtgtgttcttctggatagtggttgacagacattcaaaaaccctttctcttaaatcaacagttcccaacctgtagttcatgaccaatttggggtttgaacaatctatcagagagctctcctaagaccttctctatatcagctacttacgttatgattcataacagtagcaaaactgcagttatgaggtagcaacaggattgtttttattgttgtggatcaccataacttgaggaactgtattaaagggtcacaacagtaggaaggttaagaaccattgcctaaaatgatgtcttcaaatattctgattatcttcaaaggcctcagaatagcttagataactgctctaaaggcaccaagcaaatgagcattttataattaatatttatagttgctattacaaaaagaacacaataaagtaccaattgagttagtgtttttgttgttgttgttgttgttgaatgtacctgaatggaaggtaaaagaacttctttatgaaggagctgtgtctggtgacttgtcagcataaggcatttttagtaatagcacaagcatagttagaacccttatatgtggcttatacaaagattatattggaaagaatcctgaatttggaaccagagagcatgcagcctcaccttaaaagtggctacatgtccctgggaaagctctgatcttaggtttcttatctgcatcctgaaaaaccattgcactcatctggcttgccttgcagagctgtgaggatcaacatggcggtgtagatgtgagacagcggactgcaaagaaatcttctccttcccctcctcccctcctcttccttcgttttcttctttttcctccttctcctcttcccccttctccttcttctttctcctcctcccctttattcccttcttcttcctcttcttcttcttcctcttccccctttccccttcttcttccttttcctccccatgaagtcacttgtccgcctgaatgcttcactgtatttttgttcttcagttgagtgacagattaaagaccttagcacttttgatttgatgctcaacccataattgattgtactctaccactgctttctaatctgacagggaaaataattcagactgggagtagaagaatataaggctgtaaaagtttgtccttggctgaatgtttgaaactctctggtgtttaacagaataagtctcccagcagttttgtggtacagctttctgacagtacatggccatagctggtgaccaattgtggcctgtgctatgctgacattgccggtgggtgttgctcctctgcatcattctttgctctctgttcctttccaggctgtggaaggctggctttggtcaacagattgaaaaacctgaccagttttcattcagcatagtttctttcggtctctgtgagaagaggaagggcattttttttatttccaccctcagtagtttgatgaaatgtgaacctgatagaaatttgtcattccttggtggctctttgtcttggttcatgacaggtttattatatttgatcttcaaaggctgaagagcagagtgtggtgtttgatttcatataccaggtacaattcactttgattatcttcttggaattgacctcacactcagggatgagagtctgttgtcccagatcaccctgtgtcttggacaaccgcagaaccacaaagtgtgtatataacctagttgttcagtatttgtcaggaaactgccatattttgctgagttgtgattctctgatacacgccatttaaaattatttctttgtgtgtgtggtagatttaaacttctgacagggaaatagctataaaatgtaagatgtgtaaccagccagggctggaacacatgctggatcacttgctctgctgaaattggtcatatgtaaatccccttctttgcataatgatctgtaaatgggaaaactggaggaacaatgtcaagtgcgagtcagccacaccgcatttgagcactcttgagagtcaaaatgtttttctaaatttcaactcttcctccttaacatttggctatggtgctggggtcctgtctagcacatccttcagtttataaaatactcaggccattgtggaatcaaagtttgacaaaacaaacaagcggagaagcaaagaactatgtagccacacattttgttcaagtgcacaggaatgcatgtaaaaactcttgttacatgtagggcccaatggtcagagtggaagagcaggggcttggtagctttatatagtcggacaatactcttcagttccttttgtgaaactctgagaatttgtgaagactaggacagtctccttgaaaacaatgaatgctgttcaattgtgaggggttcatggatttaagattaagaattaacatgtgggagacatagataagggagtgtacagttatggtagtatattgtgctctctctctctctgtctctgtctctctctgtctctctgtctctgtctctgtctctctttctctgtctctgtctctctctgtctctctctgtctctctctgtctctctctctgtctctctgtctctctctctctctctctctctctctctctctctctctctctctgtctctgtgcctacaagaggagaggccccattttccattcaggagagggtcccactcttttaccaacaatctaattgttgttccttaaaacttgcaataaatgtttgctgtcttggcagtggttttatgggggcaggtaggggaaggcagaaaaaggaacattctagttggcaagaaaaaaccatttgatttggggttaggactttaggattttgtagttcccggttcgtcagttttagtaagctggacatttgttacccttcgtaattgtcgtattggaggcttactgcctttgtctgctaacgtgggcctagtcctggaaacttctagcctctgtacaatctaatctagacctggaatgttttcagcctctgagacttagtactaagtttacccttcttagttctttctgatctctggctggctggttcaactcagctgttctagctcaaactcctctccaagctgactgattcaatctggattctcttggtttctcttgaattgctctgtttggctccatactaacgttggcaatatgttctaatcttctggttcctactcattctccagcttgtctgtcttcacctgtgtctagcttgttctgtctctacaacctgtttgtgtccaactgtcctggcctctctctctcctttctgcactgttctctcttaagtcacctctccttcatctctcttgagttcagcatgtcctattctgccaaatctttccttgattcatcacttttcctgctactcaattagacatcactttcaagtgtgggtgcctctttctacaaactaactttaccttcattgtttgggattacaggtgtgtactaagggcatgtctgtattccagccagagggattaaaagttttagaaacaggtttttctagtaaacaacacaatcttagggttcacagcatgatcacatatcctgtctcaaaccttttcgggttccatgtgtcttaatctataaagtcaaaatgctgatacccgaaccctgggcatgtagctcagtggagatgtggcatgaataagaccctgggttctgttcccagtaccaaagaagaggaactgggaaaatgttgtatctgttatatcaacctcatggccagggagggaaccttatgctggaaggaaaaggggtagtgttacaaaataataaagattttcacaagccacagtgttctagaattacaatgcattgccattactatatctgctacatgacagatatttctgaaactgacaaatgtgattaaaagtaggcctccaattgtgtctagaacatcatgtggttcctggaaggtgagagggcaactatagtcagaacaaaagaatcccatggcatccatctgtgatgtcagttttggagatgaatccagcatcagaaacctcttcaaaaatcttcaatgtattggcaagaggcgaatttataaattcagagatagtcataaaaaaaccaaaccaaaacaaaaaaaccctataagccagcagtttgattatttactttgtttactagaaggaggtacccatgtttgaaagtgatggatttatttgctttattcagacactggttaaaaaacaacccaggaggttactttgttgacatacctaccagaacctaaattccccatctcctctttcttggcttcccacacttctattgagaagtggctgaggcctagctggcagccaggcaggaaggaaggcgatgatcggtgtggggataagggaacgggtattggaagctgaagtgctgggtttgagtcccgactcctggcttcacataagtgactctgggacaatgggctgtcttctcatttagtgcctcagagtcttcattaggaaggcagtacagctttaagcaagagctcctggtaagtctgaaggactcagccgtagaaggtactgtttttaatcatcggattcctagatgtatgtgtttgttagtgaaatgagcaaagagaagagacgacaccatattgcatttctacagattgcctgcctagtttgcttcctagttacgcacatgtcagagtgcttggctgcctgatgatggctggggagggaatgcctagaactaacagatcaaacagagccaagagttctgctctggctgcagaagggaaagcaatcttcaatggtgatttttcacatcttatacttagcaaaaggagggggtgtccccccccccagaattacgtttgatttttctagaagctttcacaaagatcctatcttctgcaaggatgaacacccacatgctctctctcaatgctaccccgccccacccctaccccgacttcttcctacccaatgttcactgctgtattttatgttcagatatggcagctgcccacatagatggatcccagtgggtcaaaagaggcatcgtatccataggaaccagaaaagatccgagcagtctgctttcaaagccatgtgtttgcgatgtggccagactggctaatgaaggtattttgttccagttatgacacttagaaacagacaaggcaggagctgtcagctttcatccagacactggagtgtagaaggatgcccaacagaagccactggggtcgctccctgacttttttttaaccagctccaagaatcctgccccatgtgccagctcccaggcaggctggatacattaggcaaactagaaagcaaatccttgaaatgggagctattttttttcccctttgacaaacaggtactacataccagctactctgctaagccctaaagaaacacccaggcaaatgagacacaattcctactttcagtaagttaatagtgtggtaggaaagacacatagataaaaattacaatgtgtgatcaatccgatttgaaggttcagcagagtgtaaaaggggtctttgatcagttttgtacaagatgcttcagattcctctgcctggagaagatcagatgggaatccaggtagaggcactggcaagaagaaagtagggaaacatgaggaggtgaagggcatgagactgtctgctggaaagtcagggtgaagaggctgggatgggccggatcttagagagacctgagaacaatgcaagggaactgcaggctcaaaggaatcacggctgaatttaaaacagcttacagtggaaaccacaagcctgcaggaagtccatctcaccgggctatgctggtgatttatgctgtcaggtctgtggttggaatgggtgctctggggcgtaggctgatgagtgaggacgagcggagtaagggaagctgggaggcccattcgacggaggttgaaaagctgcaaaccagcttgaggagataacgttggtggggacagcggactaatgagcagcttggtgaacatggagctggatcacagcccatatgcaggatggacagaatgctgctggaatgggcagtgctgctcacctgacagacaaggaggtattgggagtgggtgctgtgattcggatctcgactgttcccaaaggttcctgtattggtttggtcccaaggatgacactattgagaagtggtgacactttttcagagtaggacatcttcaggtcattgggaacacaccactgaagaatcccgtgggattacaatccttccttcattatgttttgcttcttggcaataaactgagtgacttagatctgccattcatccaagccataatgtcccagtgccttgttacagtccaaagcaacggaacattgcaacctaccatagcctaaaccttctatcggaggaggtgcagcttccctatgtcagtaaagaaggaaagagcaagttgttgggtgaaggtgggatttcctggttccaggagggggagatggggccttttcaacaggcttgggaggagtagcttgaacaaccatgaaaggccttggggcacctagggcatgcagcctccaccgagggtgggggtcaaggaggttggtgggagctagctgttagctgataaaattcacccagcacttgtgttatctgactagttttaaagtaataaagctgtctagtgtttttcttcctcagaaagaggagaaagaagatgggacagttgatggagacttggctaagctagccggaaggaagatagctggtgaatcacagacatctcgagttgggagttggttgtgttccatcctggactaagctatatgaagaaaagggaaccaggaaaggttggctcactggccaaggcactgggcaaggaggtagcatgattttttttaaaagcatgacactttatttatttatttatttatttatttatttatctatttgtgtatgtttttcaagacagggtttctctgtgtagctctggctgtcatggaactcactttgtagactaggctggcctcgaactcagaaatctgcctgcctctgcctcccgagtgctgggattaaaggcgtgcgccaccactgcccggctgcatgatttttaaaaatgctacacagccaccttcaaaatggtgaggcaaaaccagattttccccctccctctcttttctccttttgtatgtgtgctctctctgtgtgagggtagacatgcactgcatgtgtacccgggcagaggtcaagggtccatgttgaggatctttctctgctgccctccatcttactttctgagacaaggtctctcactgaacctagagtttgctgattaggctggactggctggccagcatggctctgggatcctcttgtgtctgtctctgcatgttggtattaaaagtggtgggggtacaaccagctttttgcatgggtgtaggaatccagatgagaccttccctttaccaaagttgattaactcaagtcttttgttatactgacaggaagctgactaatgccatggagaaccaaccaatctagggacccagaaggagggagggtggtaggggatgtgactctcagccccacccctcagcacaatggttcttagccagtatttgattctgtggctctgaactggacaggactagaggctaagctcagcaggcctgactaacctttaaggtacgtgaagatacctctgttgctctcctttggcttcctcatcagtagcataaaacactttcagtatctttgattcttcctgcaagagctttccataatgatttctctacattcccttctgtttcctcacatcctcttaaaatgcaaagccccaggctaaaaacaaaccatgtgtctttctcaagtaatacttgtaattatatattttatgtgcgccgggcacactttattaaagattactttaattcccacttttgatactttatagttattaaatcccttcttttcccgagaaatacagtaaaatttaaaactcatgaatatttgtctgcccactcagcagtcccttgcaatggtgtatttacgagctccgttgtcagagatcaagaacttttctaggctgattatctcaagtatttttgttatactgacagaaagttgactatctggtgggtaaccaaccaatctggagacccagaagaaggaaggggtgggaggggctatgactcttcaaccccacccctcagcacatttgactcaatggctacaaattgggaaggactgcccagagcgctagtcctcacaggaccagggtggagaaaccccactcttcttaattcacttctgtcattgagggcttttgccccaaatattctaattatgttgggaatctactttgatctatctagtacttaggttttcagaaactttagctggacatctgtcagcgatgagggccctgacacaatgtgtgtgggtgacttcctttcatagaggaagggtagaggaggaagatacaaaaagagagagtcagaattggccatttgatctgccatcttcacacgggagttgtcttaagcacgtaaaagtctaggaaatgagccgaggaatggtaggtaggtctgttgcgtcaagaaatacactggtaaagtaaatactgttacttgtggaaacaggtaagcctcaggtctcagggagtggatgcaacacacattttttttcttgccacattgcaggccagtgaggatggtagggtgggggcgggaaatgctgagggtgggggaagaggcgtgtctctgttccatgctgtcatttagagaccatggttcccttgtttggggtttgctcccttctggcccacagagtcctttctatttaactggcagataaacagaaagggtcttgagtgggacattttggatcaggtctggaagagactcgtaacaccgggaacacgttcggtgggttacaagtactccaggggatggtgagggaggatggcaaatgtggtccagatgggtgcttgggaaggagaggatgaggatgggtgttggtggtgagcagggtttggatgttttggttccaaatgcagtactaattactcatgagaattagcaggcaacctcatgaggtaatgagctgcttgtcactggaatgtcggttggagaacagattcttgccatttctgctttgcagttctataattacaattccccaaaagtatagctgttgtgcttgcagtttctctgtggtacagaatgcttggctcatattactgttaccccttccgtgaatggtcttatttctctcgctcctctgtccccccccccctgtttctctgtccctctttatctttgtctatgtctctctctgtctctatctttgtctttctgtctctctttcagtccattcatcccttctctctcagtgatagcaagctggggtacagatggcgaggtgcccttggtggcctgcagccagggtctaaggaagaacctctctggagggagttttgtgtttgggaggatgaatgtgtggcccattgctggtagacatcactctgaggccaagaggctctcatggcgtcatttgtactagttcagtaacagtaagaaggacacaattacacaatcatagtaatcagtattactatgattcctgtaatcatagtaatagttgagaatcctaatcttgtgacattccaggagccattggagtccacggagaggacatttgttttgtatatgaagaggagcaggcaagtgatgcaaagactttgttcttaacacaacccaaccagtactggcatcttatcgggcaaacctgggcctgatccttgctccaggctactctggccaccagccagaaatgccagaattcctgtcttgcttcagccactcaaatggcctcatccagatctatgaacaacatgccttgttggaatcttccagatgaggagcagtgtgaggcaggagacggaggatcaggttctgctcttggctctgtgtggtttggggtctgtggatgggtcttaggtttttccacattgaaactgaggaatttgcattagataagcagttttcttggtcctgagagggaggcccagccctttccggaggtcctctaggaactgtagagaccaggaatggtgttcagctcagctatgttttacatggattcctgagtgtgtgtgtgtgtgtgtgtgtgtgtgtgtgtgtgtgtgtgtgtgtgtaatagaggtcagagtctgatagtgggtgttttccccaatcacttctcaccttatttccctatttttctttctattccttaacagcttcacactctataattataatgtataaaaggaatgtacgtagctttagcccctagtaccctctctcactcttcctgtttttttttttctcagaacacttcttcccaaccacttcccttgctgccgccttgtcattttaattttgaggcaggatccctcagtgaacctggagactgcttagttggtgacactggctggcgagtgagtcacattcaaccccagccctgagtccccaatatcaaaatggctctaaaaccaccagggaagtcctctcaaacctccgaatctctttctgtctttaaatgtttgtgtcctactgaaatgtgctctatggatttcattcttgaacttcatataggggccaatgagagaagacacaaaactatgaaaaaaaaatcacatcccaagccaaagattgccatcacctggcagtgggttcaagtgctgctaaagttaagcagcaatgtaaaagaaggaggattggtagggactgtgtgagtcaagattttgttgctgtaactaacacctgagagagcaacttcaaaggagagagctctgttttggctcatggtttcagcttctggtgaaccagagcatcatgagggaagggtgtggcagagtgcctttgccagcctcaggagaaccaggaggcagaggttagagtgtggtagcaggcattctctgcttattctgtatgggtctctaacctcttggatggagcttaatcctgcagttagctgtctctggaaacacccacaaacacaaccagagtgtgctttactctcttcctccacgtctctctattccattaaattgacaagtgcgaggagtcatcacagtgccaatccatagcatgtcagagtgtgtcagtcagagacaaggtccttaaggaggtaactatgtgaacagatgcttgtcgaatggatcctggtccaacataactgatattctggtgagaagaaggagtatgagtgcagaagtacatggtgtgaagaccacaggaagataaagtgagacgacggccctctacaagcaaaggagagagaccctcagatgggacccatcctgccaatatctgagtcttggactttcagcctccagaatcatgagtggatggatttctgttgttcacaacacccagcctgtcatattttgtcatctccatcttagggaatgaattgaggaggttttgtgtgtgtgtgtgtgtgtgtgtgtgtgtgtgttgggagagaatgtgacacagcagggtaagcacagcttggctaagaaggggagttgctctctagtcagccagtctcagtttctgcatgagacttctgcctcagggtttgccagatgttctgaattttaaagtgaggccaggtcattttgcttttataatgtgaaatctctgtttctgtgatttaacatggacaactaaattggagggtggagtttgacttgcagaccacaactttgtgaccccaacatgaaggcaacagtttagaagtaacctcataatgtcggctaaaactagagaggacactttgagagacataaacaaagacaggagccaggacacctggtcagcttttggggcccatcctgctgttcagttttgagccagatctcaattcccaccatgctagggtctaattggtgccttccaacatgggagactagagacttcaagttggagtgccatctcccctgacactagacgctacaactactttctacctgagtatttcttgccactgttaactgtataatctttctaaagttacaaataaagaaattgaatgtaattaatgatttaagtataaagaagtgggtagccaggcgtggtggcgcacgcctttaatcccagcactcgggaggcagaggcaggcggatttctgagttcgaggccagcctggtctacaaagttccaggacagccagagctatacagagaaaccctgtctcaaaaaacaaacaaacaaacaaacaaacaaaaaaaccaaaacaaaacaaaaaaagaagtgggtagaatatccctatgtcttagaaaagctgtccaaacaggaaagaaaagaaaacaggagacacatcaaaattgatatcatctgtcttagggttttactgctgtgcacagacaccatggctaaggcaactcttataaggacaacatttaattgaggctggcttacaggttcagaggttcagctcatcatcaaggcgggaggatggcagcatctaggcaggcatggtgcaggaagattttagctttttacaccttgttgtgaaggccaacaggagaagactggctctcacatgcttaggatgagggtctcattgcccacccccacagtgacacacttcctccaacaaagccacacctcctatgagtgccactccctgggccaagcatattcaaaccaccacatcatccaaaatattggcaggagagggtagaaactacttttccttagcagctcttcctacgttaagatgcacactgctttgctcttgcatgggggttgtttttgctgttgggtttctaggcccctttgtcagaatgtccaggacagtggaactccataatagacatggactactgctagtaattaccaagcccttactatgtaccagatgctttacacatacagtcagtcattcttgctgtaacagagaatagcacattccagaaaatttcatagtttgcaaaactcagtgttaaaaacaaacaaacaaacaaacaaacaaacaaacaaaaaaaaacaccaaaaacatataacaggacctaggggaggaaaaaatggaaccaaggtagaatattcaaagccatgtaattctgattaaccaaaacaatcatggctacctgcgggattgcttggaccagcttggcagcagcaaagttgctaagaatctgccacggaggtattaaaatacacaagagcaacagagatgaaaagctggtgagtccttaattaggccctggcaggggcttgatggggcaatggaagtggagctgtaggtggcagggctgttgtcaaggtgagcagaggaagctggctagcgcctcctcacagctgcaaagccacgaggtgaggagtgagcctgtctgaaggagttgccttggctgctggtgcagcttgactgtaaagttcttgctgctgctactgtaggaagaacccctgagccctttccctgccacggaagcttgtgattatgtccccactgtttcagaaacctcccatgattggaaggtgagtcaagcagtagcatgtaagctcccccaggctcaggtaggaaaaccaaggtggttgtgcgtgctcgttatcttgggctttttttttttttaataactattgctcatttgttttgtttttaaaaaatgaatggatggtgtcctgaggaacaacatctggtgctgacctctgacctccacatgcatatgtacatatttacacacacacacacacacacacacacacacacacacacacacacacacacagagtctagtctacagagtgagtttcaggaaagccaggcatacacagatgaaaccctgtctagaaacaaacaaacaaacaaacaaacaaacaaacaaacaacaacaaaaagaaaagagaaagagaaaaaaagcaaagaaaaaagaaaacaacagcctagcctagtccctaaggtggcaataaactgtggtaactttgggaatgttattaggtcatgaggatagagttcccctgaatgcagttattaaccttatagaatagggccaaggaagcccattttccctttacatcatctaaggacatacataagtaagggctatttctgagccacaaagtagccatcaccagctgctaagtctgccggggtcttggtcttgcacttctcagcctgtagagctgtgggagatgaacatttgttgtgtataaaccacccagtgtctggtattttgttatggcagcttggatggactaagatgtcactacaagtagctgcagcatccccaaagactgtgtgagaagcagcaagctaggagttcacctgtgacttgttcatactctggctttctgtggcttgcttcgggggcacatgagatgaaggtatcacagttgtggctaaatagagcagcaggctgagtactgatcttgtacagatatcagacaccccagtagttattttcagactttagtgtggtgcactggagatggggcacaatacaaacaagaacattgcccattttcatcatgaaaaaaaaagcgtttgtttgaggactgtttaacagcattagagttgtgggatcgtaaacagaattaatggtggaagaagcctaacaactaacacttctaaataattctaatatttccccatcctgactgtgagctttggaaccaggtgaagcttgggttgtatccaagctttatcatggattgtgtgacactggaaacggtcttacagcccgaacctcggttttgtcttccatatttcttacttccccaggtcctagggaggacgcgttacactagtaaggctgaagtgtttcagatactcacgtgccccactgtgcagactagctgcgtggtgtgtcacgatggtcttgagaaactcctatggaatgtgttgttctcaatcttgcctttgctccagaagatccagaaaccagacaggagtctcctcttaggaggacagaaagggcagcctgccaggttcagccttgctggagcctaggtcatcgtagtgggaagcttgtactttccctaagttcttactcccatacatggacgacattacagaataggagataggacgactctgacaaatgactcccaaattccagacttatgaaggcactgacagcacttctaagacagatggcgagaactaagaataaggagagtagctttcagtttacgtcataccttcactttccatgtaatttctttcttttctttcttgtttccctcattccctccctccctcctccttccttccttcctcccttctttccttccttcccttcttccctttctttctttctttctttctttctttctttctttctttctttctttctttctttctttctttctttctttctttctttgagacagggtctctctaggtagtcctggttgtccttaaggttgttatgtaaactgtgatagcctcaaactcacagagatccaactgcctctgcttccaagtgctgggattaaagtacacccggctttcttccctgattctgaaagcctgtacctgtgtcaaacagaacttctgaatgtggtggggaagaaggctgcatctctgtttctcctccaccatttgtgcttctgcctaagccccaactctggctgctctcttgttatttaagccaagaccccaccactcagggaagtgacgagaaagtcatggggtgctagtaatggtgaacaacctgtgggcatctttgagttattcccaaatggtctcggtggaccattgaagatggtgatggtaacaaccacgttatgtatgttatgttaccttagatacttatcacagggactgcaatgggggattctctgctggtcttgaagtgtgatgtgttttgagtggctgtgtccaaagaacccaggacaggagtccctacataatcgaggggtgctgttaataagaaggcaaggacctcagttcctcagctccaaggggctgaatactgccaaaagctgcatgggagccctgctggtgttgacctgtagactgtagtgcactgagcagagagacaagctcagctgtcctggcttcagagtaaccatgaagaaacagaggtgtgttacttgggagtgattatgttggagatgattttcggggcagtaaagcaaaatgaatgtggtgggtttgagtctctgggatgtgaaggctgtgatgtgagtgagagtctggcagcagaacacacccagatttggttctttgagatgagaaaccagatagtggaggtcagctccaaggagacaaggtgtaaagactgtgggaagcagacctgtctaagagctagagaagtgggaaccctgagatgactgcaaatctgctgagtatcagcatctccatgtgagacagagaagagagggccgcaggaggccagcgtttcccaggaaacacccatctatgaacaactaacacaacaaaccctgagcatctctgctctatagagtagtgtgcaaataatgtaataccattaaaagtcttagcatagatttgtcccaactttaaccacatctgaacaatggagaagaacgatgtaagaaaagccaggatatttttgaaaaagaacagtaataaagggaatgttgccttatcagcaaatttaacatgttgtaaaaacataatagttgtaattctgatagtattatatcaggaatgggtgggcagacaagtgaatgccacaacaggagtccagaacgcagccaaaactctagatatgtgcatccttgtgtatttattttggaatttgaaaaggattttagtccagctagtgagaaaaaaaaatcccaaacagaatagtctataagcttatattggacaaagtgatcaatccactggggaaaccccttagcctgccatgcacacagtattttaactaatttagtatttaattataaaagatgaaaaattctggtcatataaattgtggaggagtaattttgctgtctgggggtaaaatgtgacatttctttttctcactctctttttgtccccttgacctggaactctctatgtagaccagactagctagctttgaacttacagaaatctgcctgtcagtgcctggggtgctgggattagagacccgggtcaccacacccagccctctagggaaagcattttctaatgcactagccagcatcccattgttatgacaaaatgccagacaaaccagccttcagaaagagggacttattttgactcacagtttcagagagtttaatctacgaccactggttctgcactcatcatgtcagggagaataggttgggctgctcacttgatggtggcctggaagcaaagagatcagggaggaaagattgggggtcccaacatcctctccaaggtgtgcacacctttccccaacttgatttcttccaagaaatctttaggctctacctcctaaagattgaaacacagtgccataggaggatgaccatcttacagcacatggtctttgggaccctttatgatgcacactactgaagcagtaagaaaccaaagcaaagactcatgaagtgtacaggattgttagagttggttacacaacaatgtgaacttcggtgcagtaccaattacacaaacagtttgaaaaaaatgaaccgagaaaaggacatgtaatgtgaatcactaggcgttgttagtctgaggggttttgcaaatcaattaaaaaatgcaataaacaaacaaacaaacaaacaaatgaagtaattcaagagcaaggcagccacaaaatacatcacccagattttgtctcaccctcggtactctttgtactttttgattccagaaactgtgatttcttgggcttccaggaagagtgatgctggggtgctggccagcatcaggttcttttcaggagatttatcacaccaaacatctttctgttagcctccgttctcatccacattatccaggaatttctagtaaaatgagcagatctttttatattaagcaatattactaaatggagattttacacttctctacatgtttactctaaagaatgttaattaataattatatattcagatggctatggctttatctttcctttcattatttccatttcctcccccccccccccaatctttctctgtgtagccctggctgtcctgaaactcactctgtagaccaggttgacctggaactcagaaatccatctgggattaaaggcatgtgccaccattgccaggtggcttttaccttttaaggaaggtaactggtgcttctttgttgtggttggctctgggctgcttgctctcccaggagaggctgtctggaatgaagaatgagtcacatgctcaggtggcttcttttgaaccaatcccctaatgaataaaggagccaatctctaggcaagtaggtgggacttcctggttggatggaagaagataggaagcaggagagagttaggccctttttggaatggagacagcagagaggtaagatgtagctgctagagtttcccagtatcatgggggacccgcaaggattcgccactggaggaatcagatttttataaggcttacaagattagattttagttgttgtacccagagatggagttaacattgtttccgaactaagtttgtgttgtgttttccttcatgcagcagctcgtctgagttcaagagggaaagatatggtggccaagcatgaggtgctccacaaaggccgtgggggatttgaagcacgaggttggtgtggtagtgactccccagtgggaacctagcgagctgggtggagagattgtggagttcagagtcagactctccatgagataaaaacaggtaggccattgccactagtgcatagccagctaggctgccaggacacaggcacaagtgtgggaatgtgctggttcgctttttttttgtttgtttgtttttttgtttttttcgagacagagtttctctgtgtagacttgaatgtcctggaactcactctgtagaccaggctggcctcgaactcagaaatcttcctgcctctgcctcccgtgtgctgggattaaaggtgtgtgccaccatgccgggctccagctggttccctttttaatatttcccacaacacttcttatatgaacattcacagtgtttgtaaagatataaaaaactacatgaaaaataccttgatctggtccttcagagataacttctattttctttgtgtgagaatgggcacacattaacatacatacactcttgtgagctcacatattaacttatattgttacaaaagtgagttcatacactttccccattgtaacagtgcatcatggttgtctttccatgtaaataaatgcaggtctacgtcaccatttaaatggttacatattttcttaaagtgaatgaattgttattaatttaaccagcctcctactgatcgaaacttagaatttttcttttaccattataaagagctctgtaattgattccgcatgcctagctttggctaggcatctggttgtttcctaagaataagttcctagaaccgagatgattagtcagttgtcctaagggaagaaagagccagacgaaagggggtgatgcaatagcagctgtaacattcggagaagagataccaagttatcacagtcactatcacccaagcctgtcgccaggtcagcccagtgggcgcctgcagaaatgagaaggtttaagtggcagggtttccagaccctccaactgtgggtttgcagaggatagatgctgttccttcctgctctgagccaaacctcggaggatggtgacaatccagggcagttgtagccctggtacgtatggacatgtttgactgtacctttgagaattccatggggagtcccagaagcaaggggcagggggattttcaggtggctggcagagatgcgtcaagggagcctgagtcactgctcttctgtgatcctatctctagccagtggcaggtgagggctggagaaattcagataattgtgtatggggataaagaactctgtacgcctaatgcctaaaaaaaaaaaaatcctaattttgcactgtgcttttaagcacatacagcagtcttgcccttcaatggtttcatactccaaggactatattgcgggtctgttttatagtctagggatggtgttttccttctgtatacacacagtcaagagtatgctcttgagttctcttgacatccatttgctaactctaccatatatgatgcagatttaaaatccttccacctcttttatttaaagtcagctatgtagttagctttctcaaatgttgccttgaagtaattgctgatatatagagtgtatctgttacatttactcctacctctcaaataaatagttctagctcttacatcgtgtgggttaaaatggtggcttgagtccgtcccagggcttgggtcagtaggcgaggcaggacaagggaagtttgactgtgcatatcctacgctgcctggcgggggcgttgggctgtgagaagccgcagaaacctgctccaggggtggggaggcacagtctgaggtccccgtggacctgctggagttggcttgggggtcccggcccacaaggaggccaagaacggcaggttctcacgctctcggacactttcgacaccaccggatgccgaggaagagccgagaacagagtacttgtgtatggggcccgaggggctggctctggcctggggccaaagggaaaagggcaggaggagacgctctggctggttccctcggggaggagagtgtcctaggcttggttgggctggcggcttggcttggtggagaccgtggctgagagcgcagagaggcctcctgtgtgagattagacacggttcttcagagaaccctgctccattgctccagcatggtgggtcccgatgagaagaggctgtccatggatttaaatcatttattgtcatggtggaaagttgtgatgagtgaaaccttatccccctttctcagggcggagctgagattaaatacctattgcagggaggaatgtctgggagagggagcttaattggctaagacctttaggcctttagtatctcattaaaacggagatctgtcctgaggctggtgacctgtagtcacattctctacctgtggaggggcttggggagttgccctaggtgactgatggccatggaattatggagagctgaggccttgtatcaggagcctggtgtttaggagcatggcaggcaaatgccttccgtcccttgcagttcattgctttctaccttacagggtgctttaaggtatgggagacaacaggtaatctgggtcataattgagctggaaactcagaggacttctgacactgctgatgggcaggtactggagacaaggaggctaaggagcatttgcaattgatttgctaggacctatgcaatctgacttcaaaggtgatgtgtttattgcccagtagctctacggcactgggagttttacagaaagaggtacattcagtgttctacctagggctgcccccctcttgactcagaggagcaggaggtaagaatgtgggggtatgcagagaccagctcctctaggctgctgatcacagtgtggatgttgtttgccttagggagcaacaaggatttattaaccccccaacagggagcatgacacaggattaagaactcggattatgtttaggccccaactgtggaattcaacattatactctcgctctaagttataaaacacacacagtaacaaccttctctttagatccacgcacggtcttttctgcttcctcattccctgaagctctgatgatgtctaaggatgattcattccggtgagctaatattagacattctaacttccagagagatgaattacagaagaatgattgcaatatagagagatacatcagtttgaaattcagaagcctgagaccagatggacataaacagaatcccagagtgtgacactcaggctagttcagtggtaactttgacttgggaagccacttcccaacttgaacatgggctggtatccctagaagggcttggttgccaaaacctagaccccttcacttagagtgataataattcagtctgggcctcgcccaggagctaacaactgaattggactgagaccaagagttggcactgccaacatgttcccaggtgatgctgatgatactggtgtgggtaccatatcctgagatctgctgacttaaatactcactctgatcctttacaagtaaggaaagcagaatgcagaaatgggagtgttgcctaaggcagcagtgagaaaaatggaagccctgtgattgaatttaaagccaatattctttccattcaaactgtgactctattattactcctaacaaaagactgagtgcacccacgctaattcatttacttgagaacaaagagacgccaacccctccacccaccaaactttgacttcttgcttggaggctattgacattgaggagtcatgtgacttttcttgcttcagcttcagcaaaatgatgatgatgatggttctaaaacttggttgaattcaatgcttccttaatattctcaatatccaaacctttctttttcttgatgctgtggacttgtgtgtgatggtggtggtggtggtggtgatgatggtgatggtgatagtggtgatgttgatgatgatataaaccaatcctacctcacagattggttataaggatttccatataagtactataaatatatgggtatatgccatatacgtgtaaagtttttaaattgtactttatagcatgctattattattaaatattatttcaaactgtttcattgacattttgtattcataaaactttatcctgtttgtcaaactggttgataccagaataatctcagtaacccagcgagaaccatttcagaacgtggctaatcatatagcgacagaagcaagtagctttaaaaggaggggagattttctaaattatctcttccaaccttttacgcaaaggagtggagaagccatggaagggttatcccaggtgtccaagctgtaatggctgactagccacaccaccagttctagaactcagttgaattcattgcttccttaatattttcaaaccttttccttgatgctgtgaactgaagcagtgggcttgtgcatgctgggtaagtgctctgttgacgaactctgttcagttcttcatcatgctaatgctctctgagtttatgccacttcacattactaggaattcagctgagctatgtaggatacagttcatctaacggtttgatatctttttctgtttcttctgataccctttgcagttctcacttcctcatgagacaaaatgaaatgacttaatttgcattaagtttctcagatactcagagtgtatgaatggaccccccacacccaccagtttaaaacttctcccccaaactatttcttgtcatgacatgagtcaaagtcattggaggcaaattacggttcactttgtaagtagggactcatttaaagaatctaaattccaatttggacagcaaaaggttaatggtgcatagaaaaaatatcccagcagcctacaaatctaagcataattatgtatgaacatgaggcttttattgctgtcaaaattaatcacttttcaacttccagctgttaaaacccttctggaggctctccaagaaattcccctacagttactcttccttcaattaaactctgtgcagttcacaggctcctgttacataagcggcaatttaaatatggacttattgggtcttccagtttttctccctcccttcctccttccctccctcactccttctctgtctttcctgtctttgcttaacactataaaatgacaaagcatgacgttttcttctgacccctttagcacagctcttaatcgtatagtttaagaagcaggctgtgtgaggttaacgaatctgtgctccttccaatgcgctctaggtgtgttaagtgactagcgatcagtattgttagccatttccttaggctgtccctctgaggtgtgtaaatgttatatggcttactctctttctcaccccactattcttctgccccctcaccccataaactttataggaagtgcagtttacaaatcttccctaatgggcttagtctaaatttcctacatcgctttctctggagtgacggtcactcccctcctttcgtaggactgcgtgtccctatgttgcttaggctgctcttgacctggtgggctcgaggagatcctccccctcagcttcacttccttagctacacacgcagtttgtcatggtgagggtgatcgcagccatctgaggtgtctgaagccttccagtcaccctggaagagcttgtggtccctttcttccatcctgaaaaaaaatctgctcagaaatgagttgagtctgggagcgcagatgcccagggggcatgagtataaatcctcaatgagattcataaattgctgcagcatgttattattggggcttatgagtggagatcagcccacatctctgcacttgcctggtacagactgagtgcttgcatgtggatagcatgctgggtgtgtgctggcttttttttttccgtagaattctgagagaacagtctttatattctttctcagtgctctgtggggatggataaggataacagctttacttcacaaagacacttatattatttattttattattattattattattattgagacaggtttttctctatgtagccctggcagtcttggaacttgcgttgtagaccaggctggctttgaattcaaagacagccctgcttctgcctgtgctgggattaaaagggtgagccatcacaccagcttggggatggggaattttaatccttctcttcctctcccatgacatcagggcacaggtgctaaactaccccagagtcagcaaggtcagcttcattttactgagctgtcactcatactgaaggggcctgccctcctgtgtccggtatgcaaagcatctttcctggccactccggtaatctttgcagcctcagcctcatcaactctgcttcatgctgttcagtaagtatgtgtgcaagtgctatagggaacagacgcctgtcgtttgaagaagtctctgccatatctgctgtcatcctctgctttcccgcaaaattaatgttcttccagatgcaaattccttcccgagcctctctacctgttagtggcatatggcagaagatctgaacccgggccgggggcatgaagacatctttgaggaagagagaagggatattttgtctgaaaaacataaggatccagcaaacacctgtgttatgcgttgttctaaatatgcagtcttgtgctgatgtgtgtttatgtggtcaggaggagagacagcatccagagggggaatctatatcccattatccccacccagactctaaccggcatatcccagaagccccaagctagggctaatttgggacactgaatggattccttgtgcaatcaaagtctatctgtcccagaggacagggagtaagctgtgtgagttgagtatggtatgtccctgagggtggtttccaggctatgtagccaccaacagcctgctgaccctaccacactcacactcaaactcacattcagcatttgcacagagaaggggcagattcacaagtcaccgtcagattctgtctctcagagctgaaaagaagtgtgctagcctcctgtcctccttcctaagctggctgcttagtttctcatgtggctgagttgattttctcgatcaggctaatttagacaaattttcccgaagccgagggtagacagggttaagattaaaaatggttctgacttttgacaactgaaggccaagaacctgccagcctcttacagcatgggaagctttaaaaagctgaggaacaggcctgaggtcatgtttgggtcaaagacaggaaggactgagggtaaagtattttacctttctatctggtacttaatatgcctcctaattgcaggacattccttaggcatcgccacacacgtaatttctgctaattggcttatgtaacacatgcatgattattgcttttcaatggaagcaactctgtgcatttcctgtgcttctttccctagttccgtactctgtgggtggtttggccccgggtttggtgttccctagacctttcgattctgatttttaactccaaacatttctccaaattctacgcagtgtcaatggaaaacaattagataacgcaatcaacaggctggagagaagaagtttggtttggagtgagaatctctgtgcagttagcaaaatacagttacactaatttatattgcttgtattccatctgctttctggtttaaaacgtcttggattgcctcagactctgtatatgtaatattttccatttacaaaaatgtcctgcatcacccatcagcgccccccccccgctctttctttctttctttctttctttctttctttctttctttctttctttctttctttctttctttctttctttttaaagagagcttttgaaaactgatactggctagtctgtgatttggttcttgatcttataggtagagcctaacaagatcatcgagggggactttgaggactgagatgtctgtgttgtggactcagtgcaaattctaccccaaaagccaggagcttagagccgctgagctttgcagcagcgctcacgttattatccagaaaattcctcctgcgcctctgtctttctaccaccgacccctggttatgctttaatgcaagctgcctacatgccttcatggaactgctaattgctttggagccatagaagcatggatgtttataaacttttttttcttccttacttgggttacaaaaggatggcgtaggaatggatgaaaattgatgattacaggaaaatgtcatgcaagcaacggaagtctctgggattcccggaggcgaggggaatggatgtagagagtggatgtaggggtgaaggtgggggttctgtctgaggacatggcacttcagggggtggttgtggaggtgggactgggggtggtggaggtgagaaagtggaggctctctcagaggacttggctctctcagtctgcttgttttcttgccagcagctggacagttcgcttttgttgacagtattgggaaaagaagggaagaatgccacagaggcaggaagggggctcatcgattccagcttcactgcctggattttcacgggataaataggactgtttggaaggctaatttacaggccctttttatggtaataaacattgtttagaagacaactgaaagttcttcgtcttaagacatgagaaagaattcctgtcttgcctcttggaacacagcactatttatttagtttacactttaccctgcaaaactgtcttctatgaacacgatgatgtcttacatttgcatgctactttctagctgaatttcatgggcgttatttctctgttgaagagcatctttatgttattggtgcaggtgtaggaatgaagagaaaagcaatttatatgggaaacacgtcaagatggaggacctagggccaggtaaaaggcttgtggctataaatagcacctgtcagtttaagatactcctgacttgcctaggagattttctggacaaacctcctagaaaggagcctgcatgtgttttgttggagaagtctcatcttctagaagcagcacttgtcccagaaatgctctactgcttcaaagctgcttgaagccatgcctaaggtgtcggcaaagtgccatgcacacgccctggctgggctctacggaaagaccatccagtcattactatcgtctctttgccagcttagcctagggaagggctcaaagatagatattacttccaaatagcagcttggctctattttggggactttcagtatttctatattaccggctgacattctgaaagagtcagagacagacaggtttgatgagccatggaaaacataaagaacctcaggtttggtgtctgtgtagggatgtcactttccctgtgtttgactacagtgtggagctcaatgtggggttgctgcttctccagcctcttaggaaaggtgacactccttgaatgtgtagggtcaacgctatccttacttgagcttgacatattcatgattttgttgtgccttcctggtcaattgccagagtttaatagaatgccctagaactgacactccttcttcaattgtaatgggtaatactgatttcctactttccaagctctcggatcgcttaggagacaaacctttggcatatctgtgaggcatttttctagtctgcattaatggaggtggaaacacccacttccaatgtgggcagcgccatccacggggaagcggaacacgagcactcacctctctgtttctcgacttcggatgagatgtgactcatgcggccgacggggcggagtaggatggtgtgacattctgtgatgctactcaaaatgatacatatcttaaaacttgagaactacttatttatagaacctttcgtttaaacatctgagagggtagttagtcccaggtgaggcggcctgtcagaatggagagctcagacgagaaggggaactacctggtatgagtgtcaggtctggaggactcaaccctcatgaatggaattaatgtctatttggataactgacagattcctgccttccggaataaaatgcacattgctttggggaaagtttcaggttcataagttcttcatccagggtcctttcagtagataggtgagggattatctggaacaggcaagggcccttaatgtcattgtgcgtcatcatgccagtgtctctaaaaccttacctcttaacctctcctcatcttttaccagttgctggtcctgtgatcctcctgggacagtaaagccacacagggcagcaagagcagcctttctgttgccggagatattctgtgggtattgattcggctccctctgacttacttacaatgagctcccaacacaatcgaagtgatgtataaaaccgtgaggctggagcttcggccaagcagaggcagtatgcaatacataaaagctggaagccccccttccccccccccccccccgccgcgcttctgtgacacttccagctggaagatgaatcggagccacacattccagctctgcttgggtagcacggaaatatgcaagctgcaatcatctaggtatgctcactacagctaaagtggtgctgtggtgccagtgccacgtgccgcgaaggctgccagcgagcattttttccaaggaccgattattgggaaattcagcctttcctcctctcgctccccaaccattcatggaaaggttgccatgtgccaggaagcccgactatttcagtcagtcatgaagccatctaagcacaggtgttggaagaggtcagcctttgagccgtgatttaatacttaaaggtttgtggatagtaccttttacattagttgcctaagtgttagaagggtccctagtgtggggtgaacacgtcctcatagttaaatcgggaggctttctcttaaaagtgctcagtgtggaccaaaagttacataagcgctttgccttaaaggctatccagttggtctttcactttagttcaggcttaaagaacaaaaatagctttctggttttgtctccttctggacgagtggccatctgtttaccgtttaatatcaccagctcatgacttttcaaggaactgcgcaggatttcatggttgtgcatcagggacttccttcccctagttcactcttccactgtggtcccttccaccgggataacacaaaagcacttccctgtctcttttggtttatctgtgacctgcccccaaaaacacatatatgttattttaactcggcagttcataacctgtgggtcacgacccttgatgtgtcagatatcttgtatatcagatattttcattataattaaaaaactgtagcaacattagttatgaaggagcaatgaaatcatcttgtggttgggtgtggggtgggtcaccacgacatgagggactgtattaaagggctgtggtgttaggaaggttgagaaccactgctctgatccctttttttttaacattcgaaccttccagaagcctgaccagacttggaactgaagcaccttaaggacaaaagaaagacttgctgagctcgctcacagaccttctagagcagcgctgggctcatggatctggagattatggacagaagataatgtagatgttataaccaggccagcgtcctgtggtaaagggtgtctttagatcactgtttcgtcggtataggtaaatgacatgaagaacatctttataggcaggggatgagaatctgagatgaagaaaagaggctcccctgatggaccattctaagctactgtcagaagcaggatccatagaacttaaggacatgattgcaacaattatcagacattggcctcttaggtcatggtgatcttttagtattttggctttctgctgtcctttcataaaggaacctcatttttagcttctattgaagatataaaatcatctcatagtattttctcattactaggagctgtaaatcacttcaaagctgtctttctccttgatcatttgcatatcaaagtatttctcttgagtacggtgatctctccccctgtggtttgctgtgtaccagttctctctggatcctagggcctagggaagtgtggattccaagtgactggtgtttttctacagtagagcttttttgttggctcttacctgggaggacaatggggaagggccagggccatcctgttctttgctgggtgtgacctttcctgctctgcttcagggttccatgctgaaaccacctttagccatcatcgagtgggactcctttttacattttggtgatttcaatattgtttttgtatgggttttgagtttcagtcctaaatctgtgtggtgtgacagagggaacctctacacaaaggcctgccaatctgcaacctcttcatgctgccactggttagatcaacagttcactctagacactgaaccttgcctgcatgcgtgctagtgtcaccaccaacatcagtatcactgtgcaccagcatcagcatcactgtgcaccagcatcagcatcactgtgtatcagcatcagcatcactgtgcaccagcatcagcatcactgtgcaccagcatcagcatcactgtgtatcagcatcagcatcactgtgcaccagcatcagcatcactgtgtaccagcatcagcatcactgtgcaccagcatcagcatcactgtgtaccagcatcagcatcactgtgtaccagcatcagcatcactgtgtatcagcatcagcatcactgtgcaccagcatcagcatcactgtgcaccagcatcagcatcactgtgtatcagcatcagcatcactgtgcaccagcatcagcatcactgtgcaccagcatcagcatgactgtgtaccagcatcagcatcactgtgcaccagcatcagtatcactgtgtaccagcatcagcatcactgtgcaccagcatcagtatcactgtgcacagctcaatctccatacgtcaatcgccagatcggtccaaaagtgtcttgtctgtgtgtattttctcccactttaccactccactctggcttaagccttcccacctgctactgtgtactgtgtggttgctggctttgggaactcccaaactttccctctgtatttcatgtttctgttggcctgacaagtatctctttctaaaaaagtactagtttattttatgtgaatgaatgttttgtctgtgtagctggtatgtgcttggtgcccatgaatcccagaagagggtattggatcctctggaagtggagttagttacagatgcttgtgagccttcatgtgggttctgggaattgaacccaggtcttttggatcccagtgattttaatggtcgagctatctttccagctccttcagggcctgagagaggtcctagaacccctaaattccccagtgactcccctttgttattctgagaagtttcagcttcaacttgccattctgggaaacacaggaccctataatccacctgccttccgggatgaacacatggcttcacccctgaaggcagtgcttaaggcactgcatgattctccacttccaaacgtgatctgtattttctgcccacctacctctttgcttagtcattcactgtattattccctattctgtgctgagcacgagtgtgctctctctctctgtctcctttctttttgctttttttttctcatctttcttttttttttgtcagttttatgtatctttgaaaattttattgaatgtaacctttttaagagtcttggatgcaatgtcctttctttgagccttgaaatctgaatcatctctttagtgtattgtggcaaatgacggtgtttctctgtgtattcctagctgtcctggaactctttttgtagatcaggctggcctcgaactcacagagatttgcctgcctctgcctctcaagtgctgggatcaacagcatgtgctaccactgtccaggtcttgatttcttgatttcttgatttaaaagaatgagtctctgcataaggcttgcctaggccatcagctacaagcttcactggacagtgtacagacagcatagagttggcttcatactagggattgagcatctattggtggaataaatacatcaatatgtgg

SEQ ID NO: 273 - DNA, 5316 bp, Mus musculus
aagaactcagagagccccagcctctagttggttttacaagaaagctataaaaatttttctcttgatcagactggtgaactagtaaagcagagggctgcagttgttaaatgttgctgtctcatattttctgttgtttggctctatgttttccattctagtttttactctgtttcttattgctttacctgtttttctggcttggggtatctggatatatgaaccacaagactgataagaattcaatgcttgaggccagtgggaagctttgaaaaacctagggccctgctacagcaccattgtgactgtggagaactggacctccccttcctgaattgcaacattgcagaaggtatggaccatttttcctgtctgttttggatatatgaatgtggccactgcatgtttgtttctctctctctctctctctctctctctctctctctctctctctctcacacacacacacacacacatatatatatatatacatatatatatatatatatattcttaaaagtttcttttgcaatatcagagcataaccataattttggaaagcaaaaccgatttttaactgtgtaaacaatccagtctctctaaaatcaataccaagtgcattattttcatgttacagagtttgactgctagttattatatatgaatgcatgatggtgcagcttttaaagctcattaaagaaacattgtttcaaatcctatcttctattagtctggcttctaggacaagaattacataaaatattatcccaatttagagatacctttagagacctgtttccctgggttggtcatgccatgtgttgttgtccagaaagactccaaccctgagttaccagttctaagccaactttctgttaccactgttacaaagtttataccatacccaataacttgtaagtcagtaacatatttatacatttaagaccagtcagaaacaaacataaagtggctacacacatttacttatttagactacacagacaaaattttcttacctttttctatcagtaatatcaagggaggagcaccttgtcaccagctgaacccaataatcacagtcacagagatttttgtaggagaaacagccatcagcttcctgaccaaagaagccaagaagctgctggtccctttaagagcagcttttacagtagactcctagctacaggtgcaggtcaacttaaccagtttttgttgtgccaattcagagtgtcttttttttttttttaacaacaccaaaaaaaagaaaaaaaaaatccttgaaatgagttaaaaactatatcaaggggtgaacagccagcagatatgaaacacagagcaacagtcaagcaatgaaacaaaaccacagacttaaactgacagacatggacagagtgatgcactaaggacaaacaatagaccaagaggaagagaactagatgttccaccaaagggacccagaaccagaactaggcattacccctctgggaaccagagaggaagcaggatgtctcctgacctcctcctaaccccaggagagctctggaacagcttacgttcatttttcttctctttcaccaaaccatccccagacacaggtgagggctgcttttctgaaacccattctccctctcatggcaaggctctaaactatctctaatcagggtctagagactaaaggcatctatgagaactattttcgcttccctagattttagcatacctctaaccacatatacaaaacgcattctaccattaccctgtcccatttttacagggtttactcactgctggcccaagttttcctttgcactggctttctttccctgcaatgtccttcactataccccttatactccagccccaacatggaagacaccatctgaccaagccagctcagtcagtaaacggggtcccaagggagggatggaggattaaagaaagaaagagagagagagagagagagagagagagagagagaattagacaacatcatatcaagacccagcaagtgctgaggctgattttttttttcagtctgctttatgctattctaggtacatgcaaagagtagggtcagttctaggtcaaaagcaaaatagtcaaggaaaaaccaaggcataaacaaaggtccaatgattactctattcagggacttaccaaaatgatcaggacacaaagaatatattctttagctgtagtaatttttagccatgccctagtccaatgtaaatagtcttgccaaattcctgaagaggcctcaagagctctctacactttctcttcggctggatccactcgccagatgtttggcccattccctagccttcgcctatcttttcagctttcctgggcactgacaatgatatactagaaatagttacagaagggaacacatcattccttgtcccctaacaagctgaaatgctaggtcagaaggaaactccctggcatagggaacaaaatggcataccacaaaaatgggccaagatttatcaatatacagactcacaaactaaaatagttctacaatataatagggcacttggtctgctttatgcagaacaaagacatattatatggctttaagagaaaactattatttctatacaaaccattcaggattataatctggttgtactcagagaaatattacaaaaagaggacctgagattaaaaagcaaaatgactattactctgttcatttccaggctccttctaaatagtaacgctaatgtcagttatcacagggcctttggcccatctgcttctgctaattactgttgagcctcacattactgatagatgataattcctatgtgggtagcattaagctgatggttataagatcccactatacacaagtacccaatacagagtcaaacatttgacaacatttacaactcaagggaagaatgtaagagccaacgttaatctgtaagccccatctacccaaaagccaggtaacttcctgggatgctgggaattgtagtttttggaaaataacggtgtcccataagaaatactgtggctgtgtgttgttgtctttaaaaagaccctacaggacatgcctcatcaccacttgctgggagtcccagagagtagacctaaccagagtccatcctggtcagtaattaatgcttgcttcatatttggctcaaagtcatggaactggtttttctcttgtgaatctcaggattaatacttgtccacattttgtgcaaggtcgtggtagtacttgaggcatagggccagttccttgcccagtggttagcatttccacaattggatacgatcttggggatgctgctaagttctgccatttgtttatttaaagctttgcttattaaaccttttaaatgctatattctcagatctctgaggtgtttgagggtcattatttacttgtttttagttgacaacatatacagaagtctatataaaggtagatataaattggtctcttctaccaagctttgtttctgtaaatgaattgtatttgtatttagcatgattataaccatagttctgaacacattaaagaatttgattatttgtaatgtgactgatgtgcacatcttaagttatctttaaaagtttacaagttagcagtttttacaagattcaaattttatagttttatccttgttaaattctaggcttcaaaatttgaatggaagatgtttgtttgtttgtataacatgattttaatatttttcaactgttcatattcaacaggcagaataatcctcttccgggtcaaaatctggattatcacttgaaggacgtgtccagaagatgttagcactgatcagttttactatatcagaatacgctgattcaacaattacaccacgattagttgaaacatactcaaccagttcattcagtggtgctcttttaatttctttgctcttcaagtctgaaacagagtccatgaaatcaaacagtacacagcactgttgtagcttctggcagaaaagctcttgctgttcatttgaagtggcatctttgagctggggcagggggtgcagctctgcctggctgccctggctgccctggctgtggaactgcgacgagccctgagaacgcttctgcctctgtgccttgcgcaccgatcaggtgaagccgtccacaactggtgcgagtggcgacggcgacttctcggcgacccgggcgctcggcccctcccgcagcggctgggacaggcacggcgggcctgcgccccagcaccccgggcccaggccgcgccgccctcacgctccgcaagctgctctttacgggacagcgcctcgctgccgtgtccccgcgccaggcagccgcctctcggggctggcggaggggagggtggggggggggcggtggcgtgcgggccgcacaagctgctgacgcccgactacgagggctgacagaggtgagcccgagttggaccgctggagcgagcctcgtggccccttagcgcacggagtccggacaggtcttcagctgctgtcgcccgcgctgtccgccagccaggagcctcctccatctccggtctgtgcgagccactgctcagcgctcgctcgttctcatgtcagcgatggacccctcctcgcccggggcggccaccagcacccagatccttggagcttcgcccttgctcagcctccggcgcccacagagcacaccctgggagcaacttgagagggtggctggtactcggtgcgcatgccacagttcttaaagatacaatataaaggtctagtcctcttaaaaactgatattacaaactgttaaggatgataaaaacacaagttacacgcttttagggatggttaagaaatgtagctgtccagtggccacggaaaactgggtctgattagccttctcagggctgggggaagagcacaattcccctttttttattttttgaaagatgagtggaaaggggacacaaaatttacttgtactctatgatcccacctaggaaatatggtgactaggcggccgtgtctgcttaggtctgggtctatattactcctccttaccggtctagtagaacaagcgaagcttgttggtgtttgtttggcacttgtctctgtcttaggtcgacaggagctcaagaatgccagttgcccaccagccttcaaaagcacacattttccccattcagaccaaagccatgaagggcatatgaatatgcactcaatgcatttcttcataggtatgaataactgccatggtgaataactgagcttgctgagggtgatactgtgtaaaggcaaccaatctgcttaagataaaaagtcaaaggttaaaagcaacaagattaaagttgtctgc

SEQ ID NO: 274 - DNA, 10924 bp, Mus musculus
gcagaacacttttattaaaaagaattcacactctggcatcactaccagaatccatcactgaaccagaattcagtgtggcttcttccatgtgcaataaagattccagtagagatcttgtaagaggatgagagccctgacatttgagagctaggggcttcctggttcctgttttctgtggcagagataaccatagtcacttggagcaatgtaacagcttgttctcatgagtggctgtccaggctcatccattccacagagcatagctttccatgttttagtctattatcagcatggcctaatcagttaaacaattagttggcattgtctttagtctgaaagaaggctctacatcttcagcaaccctttctctagttgggatgatgagtttgtctttggccagaggttgttgattatgcaggtcccctgagatccaactgcccgttgaaaagcattggttcagccagaattatattgctgaagtctcccttatgctgagagcaaagccttggggggtctgaataatccaggggtacagtcccctactgctactacacactccacattttgggctaggtttttttgttctgaagtaaggcctcattttatagcctaggctgacctttggttcatcgctacggattactgcacgggccaccatcaatggctggtcttcacaattctcttaaagcataggccggcctatatatactttaagcttgaaagagaggtggccttcaaaatcagccaggcttctgtggagataagggactgttcttcccgacttgccagtcagatcctcactcgagggagtgctcccagcagaaggaacactgaggtcaccacgaaggtaggattcaaattagtggctaggtgaaggaacacagaaatggttttgttttaataaaatatagaacatctagagacaaatagacactttctgcagagttagttgaactttgcacatactattcaaatattctagcactgagctgagtccctagtaaaatatagtgtcaagcctttgttatagacatagatagatatggaactttaaaatacaatgattatttcataatacagaagtttcctttgaatctgatgaagataaggaggcagtaacacattttgtttttctagttggttggttcttgtttgtgaaattgagattttatgatagcctgggagttgtacccacccatatgtgtaattttgtatgcaattgaaagtatagacatttactgggaggtgtgttacttttataaaagaagtcctatcattcgaacattagggctcctcagacccttgcaattatatgtgtgtgtgtgtgtgtgtgtgtgtgtgtaaaattttgacctgtttttttagtgagcatgtatgccgagagattcatacatgctataccacctgcttcatttcatcactttaaaattcatgatgcccatagatgaaataagtaaggaaactgaggtacagaaagattaatttgggagctggagagatggctcagcagttaagagcactgactgctcttccgaaggtcctgagttcaaatcccagcaaccacatggtggctcacaaccatctgtaaagagatctgacgccctcttctggggtatctgacgacagctacagtgtacttatttataataaacaaatctttaaaaaaaaaaaaagattaattcgatccaaatcatggctggtagtcttctctcaagttaaatattaacgtttgtaacgtctgcagctgtacttcctaccagtgttggtagcccttacaaaagcattgtagaagaaagtattcaggaaaaattttttccaaatcaaattaaatcagtgtaatgtgtactacatttgaattttcaccaactttgtcaatagggatttactcaccaacttagttacaatttagggatggcggtctctaattttaccacaaggtggcaccaaacaccgccttctataaatggggagctcgttctccgacgtagtcacagtttagggatggtggtctctgatgttaccacaaggtggcaccaaagcgccattgtttctagtctacaatttagttcttattaatgaagtttgtccttagaaatgtgcttaaattgaaaattatattttttaaagacgaaaggtttttcaaatgtagacaaagaactcttcctaataataacctaaaagtcagcaaacctataggaaattgcaatggaggtgaatatctatagccttagtggggttgtctatagtaacagttttgtaactgaacaatgctaattgcaaaaacattatctttggctttgagtatctttatccaagttccatgaagatggaaagaataatttagaggctcacagcaacttcttgtaaataagccaaaggccatctgggtggctaggattaatttgctttcatgacactaaatttgtctaacatcttttatttcctataaaaatcagagttaaaaattaaatcagttatagaggataaagagcagttgacctggatattaactggctgtcctggtaatgaggtatgctgctttgagttatgtagttaacctctggggatggtttctcactgtggtgaaaggattgtgtttgatctttaggtgaaggtctctctgtggtgccccagtcttgaatttgtggactaagaagagatgcttctgtctcagccttcagcttagtggttcaaacccaagtgccctaccaccagagtgttctgctggtgcctgaaatgagcaactttaagctatgacctctctctcaccttctatgtctcatttattgtttctgagcatcttgaaaacgttagggagaaagggttgagacaacatgagacagaacatcctagtcattgctactcaaaagtgggctctcctacctgtgcatgtgtgccttcgttaactctagagtaaacacggagatgctgttaggcccccaagacttagggaagggattaaactaggttaacctttattaggttccttacacttcaagttcctaaattccataaataaaattagattgcatgcaatttgagtgaatagagggatttcgcttcacgccttaaattccaaggctgtccagaaaatgcagctcttgactctgtgggaatcctaatagggacatcgggtggactattcccaccccatcgactccgtgggaatccttctaatagggacattgggtggactattccccaccccatcggctctgtgggaatcctaatagggacatcgggtggactatccccaccccatcgactccgtgggaatccttctaatagcgacatcgggtggactattcccaccccatcggcaggtcagcgttgccttatggaccgatcccaggaccaatacacgaaaggcagacctgttgctgggtgggttggggctcctgtgatgaaggatgtccttgcttagcttttataggcctgcattgtaccccaggactcttccccctcagtttctcaggcttttccattccatctctttcttgcctgagacagacctaccactacctcgacacccagacttggcctgcctcagtccactccctgcccattaatgtttcctttaatcaatatttcatatatgtaaccttgtattggggtttgtgcctaaaaagacccctgcttgcaccattctctagcaggaggccatgatttggggaagagcttacaacaggatcaggaatttttaaacactgacaatccagggtccatctctgacctactcgaatgaaaacaataaagttctctgtgaagtctatgtttaaaatctccccaggtgacttctgtgtggacagaactatatcaatcaaaactcttctgtcctgaatagagtggatccttaggagtagacacttagcggacccttctaaaagaaggtcgagccagagagggggctcagaaggtaaaggggcctccttgccaataccttgattgaagtttgatcccagagactcacaaggtatacaaagagtctggtcagctgtcctcaatctttcactccatacatagcatggcatgctcatgtatgtatacacacacacacatctatacataataaaaactttaaaggattctaaaattattcggtaaataataacacattattttaaactcaaaggagcgaactaagacagctgttgtaatgtttccctaccagttcagcatcccctgtcttcagtttcataagaattttaactttctctgttgttcttcaaagtgacttttatatggtttaatattaagcatgacctgggatgggaaaggcagcaggaaagataaattgtatcgtgtttggccaaacagcaggaatggacagattcagagaagccgataaaaaaaatgaaaaataataataattaaaaaaaggaacacaggcgtacttttttacaaacaaacaacaaagcataaaaggcttaaaactctgaggaactggggatcacatgctgagccatggctcgcaagaaatctatcctgaaccattctaatattctattgcattgactaaatcctcctagtgttttgtttgcttttgtttttgtttgtttggtttttgtctgtggggaagggtttttggttggttggtttcttttggtttgttttggttttttgatttttttgttttttcactttaccatttttcaaagagatcagagtactatttagggttggtaatgtgcttttcaaagacgtcaccctgggctggagagttggcgcagcatttaaacactcttactgtacttgcaaaggaaggacccatgttcagttcccagcaccctcatggtggctacaactatctgtaatgggatccgatgccctcttctggatcccctgcattcttctgaccaccaagggaaccaagcatgcaaaatacacatatacataaaacaaatctattaaggaaaattttaaactgaaagcattgtatccagatggatttttttaaagatttatttatttatcttatgcatatgagtacatcaccattgctcccttcagacacaccagaagaaggtgtcagacctcattacagatgatccggaagaacagtcagtgctcttaaccgctgagccatctctccagccccatatccagatgttttatttcaaaagttaaagatgggctggagagatagctcagcggtttagagctcttccagaggtcctgagttcaaatcccagcaaccacctcgtggctcaaaactgtctgtaatgggatcccatgtgatgccctcttctggtgtgtctatctgaagacagctacagtgtgtgtgtgagagagagagagagaatggttctcgccatcattgtcatcctcctcctcctcatcatcatcatcatcgtggtccttgtcacagggttaagaaacgagactcagatgcatctggcatatactctacctctgagccacacaccccaactcttatgaatgtttttgaaaaaaaaaattagtatccaagttagggaaagaatggcaattcatagactatgcagtcttccctctaattcctactgaaatgttctgcttgggtaaaagttccgccttttccagattcctcccatacctgttcatgtcgacagtaaaagcttcaaagggcgtttctccgctttgccatcagcacatcctcaccccaaaggctgctttttcttatggatgtggtttacacgtacttctgtaaaataattgtctcgtgctaaggtctttgtacagcactgcaaacttcttcagcattctaaaatgtatccaatttagactatcaagatggagcagcaggtaatggtccttgctagtgagtttggggagcagagttctgtctgccacaggggaaggagagacctgaatcttacaagctgacttccacccacccacacaattaatttttttttaattaaagaaagtactctttaaaaggagaaaaagaaaaataaagaagaggaggaaaaggctggggaggaggagggagaagaagaagaagaaaaggaaataatcctcaaattcgatgatgaaacagagctggcattttagtcttaaagggcctcatcatggccaggggagaattgccctgctttcctgtcctgatttctccccccacttttgttctttaggttcttacgcacataacttttggtttatgtttctcaccactagcttatatactgtagacttgggacctccatgtgtttcctgtacaattcaactgttccctggaggctcattcttctcatgggttagaactgaagggaaaggtgggggaaagatcagatttacaaaggtttagggatacaggtgtaagtaggaagatgtttctgatatccatctgaatggtttggaatttggtgtcactgtaggtcttggaaagagtaaaaaaggcatgtcacctggaggtgtccaaccaggtgaggacattaagggactgatggttacaaagagagaaaaaatatgggcagctcactgaaaagccacggtgaagacagctgtagctgtagattctagaggttagggtagaagggaagattgctaatggtaagtccactggccctggtaaatctgaaaatcctaactttatgataagttcaaagccccataaacttcaaatacagtgcattatgagacactggttcattcctcaaatggacccacactaccattccatatgagggcaagggctggcactatcttgagaaagaagttcttatttagttactaaacaattatttaattactaaataactccagctgagctcccacagacaccagcaaacaggaaagaaacataagaccgggaacttgaacttcatctaccacacccccagggtgacagccctgggaggcagttgtggacagcaaggggcccagataatgatgagtggaaaagtgtaggcagcgggacactcagcttaggcagtgaagtgcacagggagaggcagccccaccctcacttgccaggctcagatctcctcagcccagactcacctgatcagacaccatgactaagatggtttcatctcagggttgcaagtttagttcaacatttccaagatgacatgtggaacacttaaagacagagatcacattattctctcaatacatgcagaaaagacttttaacaaaattaaacatttgactatgataaaattcctaagggaactaggaatacaagggacatagctcattattttttttaattttcaaaattatttttatttattttctttttgttttcatctttaatcttttttttttacagtccagtctttatcaccctcccattctgccctccaacagttcctcaacccattcttcctcccctgtctccaagaagacatctccacacccacacacgtacccccacaccctgccagacctccccattccctgaagccccaagtcgctcaagggttaggtgcatcttctctcactgaggtcagaccaggcagtcctctgctgtgtatgtgttgggagatgggggcagggggaggccgttcatatcagctggtgtatgctgcctggttggtggttcagtatctgagagatctcaggggtctgagttatttgagactgctggtcttcctatggggtcaccctcttcttccagcctttccttaattcaaccacagagaccccagcttctgtccattggttgggtgtaagtatctgcttctgtctcagtcagctgcttgttgggcctctcaacgaacagccatgctaggctcctctctgtaagtacaccatagcatcagtaatagtgtcaggccttggagcctccccttgggcatatattaataaagggtctatacagcacacctctagccaacattgtaccaagtagaggtaaacaaaaatgttacctactttcttttaagatcataaatgaggcaaaggttttcattttcgatgctggtatataatacagggcttgagatactaaccatagcagtaacacgagagaaaataaataaataaaagggaataaaacatgttttaaagaaaggagtaaattatttttatttgcacaaaatatttataacatgtaaataatatgttacaaaaccctaacagcttcacaaaataattcttaaatctgacaaatactttcagcaaaggaaaaggacacagtaaatacacagaaatcaatagcctttaaaaaaatagttattttatatttgaccaatagctttcataaataacaataatgagtttgccaataaagaaatcattaaaaaattaaaaatcctcattcacagtagctttaagaaaaacaaaatacctaggaatacagctcacagttgtacgatatctcctgtggaaactataagatattgatgaaaggaatgaaaaattcattttaaaatgagacctcccatgatcatagatggcagaatccatactggaaaaatgactagttactggaagtgatgtagaaaatcgatgcagccgggcggaagtggcacacgcctttaatcccagcacttgggaagcagaggcaggtggatttctgagtttgaggccagcctggtctacaaagtgagttccaggacagccagggctacacagagaaactctgtcttaaaaaaaccaaccaaacaaacaaacaaaaaaaacaaccaaaaattgatgcaatcctttcctttaaaaaaattacaattacattcttgttttgttttgttttattttgttttgttttgttttgttttgttttgttttgttttgttttttcttgacagggtttctctgtatagccctggctgtcctggaactctgtagaccagactggcctcgaaatcagaaatctgcctgcctctgcctcctaagtgctgggtacaattacattcttagtaatagaaataataattaataataataattaaaaagtcagatccatggaggttacagttcaaaatttcatatggactcacaaaagtccctgagtagccaaaacaatactagacaggaaaagaaacactcgaggcagcacaaactcaaactatattgcagagctatagttacaaaacctgcgtggcaactgtacaaaaccatgtagatcaatggattaaagcacagggattcagacctaaactcaaacagcaacagctacttgatttttttttaaatttatttatgtatatgagtgtactgtagctgtacggatggttgtagagccttcatgtggttgttgggaattgaattttaggacctctgcttgctctgctccggtcagtcctgctccatcagcccctgttcactcagcccctgttcactctgtcccaaagatttatttattattataaataagtacaccattgctgtcttcaggcacaccagaagagggcatcggatctcattatggatggttgtgagtcaccatgtggtttctgggatttgaactcaggaaccacttcgccagccccagctactgacaaaggtctaaacataatatgaaaaagagaggctcctcaacaaatggtattagggaaagtttacctactcctttggaagaatcaaactccctactcaatgtcatcctatgcaatggatcagacaataaagaaacatctgaaatcactggaggaaacttaggtaaaacagaagcacaggaaataatcccagggttaaacaaattgagttatgtgaaatagaaaaggttctgtacaataaaaattaaaacaattcccagagtgaagagactagctataggggaaaaagctatgacaaccacacgtcctacagagttagctggtggtcactactttatgggttcttctttcccaccctttatccacactcacacccaccccattcacctcctttcactagataggagagaaagaagggtatagggagagaagatccaccaaaggaagttctctccttttgtttcttctttaagcatgactactatgactactaacaaactgcaaccactccccacccccccacctcccaaacagaacaccaacttcacctattggtggtctagcatttatacaccctctgaaaagttcccagaatcccatgcgtagcacaactgcagaaactgtctgcatctggcaaaaacatgtctctgctagagcacgaggcagatcgtaatcatctgcttcagacattccgaagcagccccgtatccccacgacctgggattaaaacaaaagcacggttcggtcttataccaaattgcagaaatgtcactacaaaataacatctagaccacagaaagagttgtgaaaatgaaacgctgaaagaacaaaccatccaaccaacagatgagccgatgaaaccagacagacctcctcaggagaaaaatgcaaatgcccaatagacacgcaagtgtttaccatgtttacccaggcatcttaccccagtcactatagctatcctcagacaacaataaacactgatcagaaggtagagaaagagaaacccttatataatgagcgtgggactgtaaaccggtgcagccgtgatgggcgttagtgtgtgggtgtctcaaaaaatcctgaaggcagaggctggcaagacggctaaaccggcaaagccgcatgctatgcaaggttggagacctgaaccagatctctagaacccacgtgaagatggacgtagagaattggctccacagacttgtactatggcctacccatgctcacccccaagccgtgaacatacacacacgccaataagaatgaactgaatttaagaaatgaaaatagaactactcaccatgtgtccttagcaatctctggaagacgttcctgaaggaggaagtcagcataccacaggaatatttgcacttcatgcctagggcttcacaatagcagaaacaaaaacaaaaaccaacaaatgaaaacaaacaaacaaacaaacaaacaaaaccagaaaccattcaacagctgaggggatagagaaaatggtattttat

SEQ ID NO: 275 - DNA, 1966 bp, Mus musculus
agtcggaaatcaaagatggctggaggtcaggccccgaaaggttagggcgaggaccggcagcaggcgccgtagcccccgggaaaggcggaaagaaaaaaaaaggtaaacaaaatatctaaaattacaaaaaaataaaagttcccttcctccgaaagggaactaagcccaacagcctcccccgccctctgcgctgtgcgggtggcccgtaccccggcctgggggtggggagaggtcgcgccccctccccccactcggcctgggaggggcgcgtgcaacagatcgccctcctcggggggtcccccagaggtgcgcccctcccccaggggcccccaagagggtagtagagagggtggggagacttgggggtctctttcttttaaaagcggcgccactagagagggggtgaaggaagcccaagttaccggcgtaggtgggtgcttatgtatccaaaggagggaaaccaattatgggactgtggacgaggagagagaagttggagggagaggcagaatgtggaatcaactttacaataagagggagaaaactagggggatttgcaaaggggtgggcgggttgaggctccctccgaggtgggggattgaggctccctccctccgcatctctcctttcctggaacagagtccggaatccccattccagaatcggctcccggaacccgcgccctcgagggacgcgcggcagtgctaggagcgccctcccgggacgcacggacagtcgggcgcacggacgtggccgcagccgcactcaccgggttcctccgccgccagcgcctcggcgaggtcggggctcggtagctgctgaggctgctcgccctggccctcctcccagttgatgtgctggggcttcgcctgcttgcgcctcgacatggtgcgcgcattggggcgccgggaagagccctggtgacttgccccctctccgccaccaattcctggagttgggaaattttagcccccttcggccgaaacgcgcatgtcccagtaattattattatcaataatgcattgcgatttatcatgagctctgacagctgattggcctgggtccaagacctcagagatcatttaaataagccctcattgatcagggaggggagaggcatgctgggccttgtagtccggccctacatgtgacaaaggcgtgttcatctaggaagcatagctaattagcatccgggctcagattggccgaggcgtggatcgacttggaggtggggggaatcatccttgcggccactatccgaattctgagacggaaaaaggaaaattggtttattgaaaatcagggctggacatgaaagttctagaaccgatgtatctcggttacgcgctccacaaaattattgtagtaattggcgtagttgataactaccagctgagaaaggtctttccgctcacagaaaaataagtcggttcaacttttccctctaaaatcaaacctgaacaagagactcgagtcccttttcaattttctttttacggaaatgttaaaactgcgttttgaagtggccggtggtaccttctgtccatcccacctccccatcttacctaatttcaagctcttccgaacccaccagggtttgcatccttaaaatgctgagtaatactcgcgggattcatattcacgagccaggatttgttgtaaacttcctggattttcggaagcacttctaaaccactgtctgctaactgtagaaagggcagatgaaaagcaaacttgctagaaaacaattccagaatagcaagtggttgcagattctatccctaaagctgttcagggctcccaaaaggtacgagggtgtttgtacttaactgctttctagaacactgcaatacagaactgacttacagaaaagccacttcctcctgaagttgtgtggtcctgattcgggaatgcctagaatttcctaaaagggtgtgtatggatataaaaatttatttctcaaatc

SEQ ID NO: 276 - DNA, 47668 bp, Mus musculus
gagaatcgtagaatacaaatcagttttgaactgcttctcaaagtagtctgaatggattgccaagtctccatggtggtcagagtttgagggacctcttgtgaagctgtgtcaggctttgcttagtcaccagcaactcagcataccaacctggaatatgagaggtaaaacagtccatgaggaccagacaggctccgttcgttgtgctattccttaacttgggaattcaattactacagaaaattagtgacaccttcaatctctaaatgttttgtccacgtgctcacacagaaggtggtgggaagggctgagacagctggtgttccacattcggattcagatgtgttcactggcctctctacctgtatcatggatgcatttgtatgccatctgcacagacacaaactggaaatgcttttagattacaatccaaaacttttcccattcccacttcatcattcataaatatctaaatacctaaatgtctagacctgtgggtcgcaacccctttgagggtttaatgaccccttcacaggggtcacctaagacattcagaaaacacagatatttatattacagtttataactagcaaaataatagttatgaagtcacaatgaaaataattttatactttgtggttgaccttaccacaacatgcggaactctattaaagggtcacagcatcaagaaggttgagaaatcactgctgtagagtatcttacaagattttatttggagtaagtttcctaataaaatgattcgatcataattttcttgtctgtgcgtgtatatatgtatatgtgtgcatgttcatgtgagtgcaagtgtggttagacatgtgcatgtgttgcttgcatacatatgtgctaacatttgtgtgtgtgtgtgtgtgtgtgtgtgtgtgtgtgtgtgtgtgtgtgtgtgtgtgtgagacagagagaaagagagagagagagagtgagagagagagagagagagagacataggacaatttgagtgttgtttctcaggtgcatctttgcatctttaattttaaaacagagcttctcatttggttggaacttgccaggtaggctatgctgctcactgttttcttaatctcctgagttccagctgcttctaactcccctgtactgggattacaagtgcatcaccacacacgggctagtcacaggttcataaagatgatacttctccaaagatctacaagagaacgaaaatctcagtgttccctgtgcagattcatctgtttagcaaacatttggtgaacatcttcatcaggccatgtctcatcctggacaagaaaattaatcagaacacgggcatagcattatccataaaggtgaattagtggcactcagatgttgttagtgaccaacagctctgtaaggtccactcaacaggagagaaatcatgcctgccactagaaacctagccaactacccagaaatagtgaggtttggtattttagaagagaatctactactacaagtttactagaccagcataatttctaactgcattataaaacttatctttagacctaagcatctctctcatccctcatcaaaaagaagcctctcattacagcagatggagaccattacagaatatcacaactagctacagtgaaagaatcaatgcattgtgaggagcccagccccaaatggatacatctataacacaactctggcccctaagtttcagagagcattatagaagagaatcagatcataagagccagaagactaggcagtctgctgtgagaccttgtcacctacaaacgactgcctccgacaagcctgaggaatgacaatatcagtagacatcctaacatggagatgggaaattttcagggatccaacccttagaccagtggttctcaacctgtggctcatgacctctttgatggtcccatatcagatacactagataccagattactttgtgattacattttgtgtgtgtgtgattacaatgtgattttttttgtgtgtgattacattgtgattggtaacagtagcaaaattatagttatgaaatagcaaagaaattactttatggttaggggtcataataacataaggaactgtattaaagggtcatagcattaggaagattgagaatcactgccctagacaaaaacaaacaaaacaaaataaacaaacaaaataaagacaagtattcaccacttaaaaagaaataattcacctcccccaaatataagcatcctaattgtttatccaatgcaaaatggtcaaccctgaaatcatacacacgtaaacaataaaaatggaagaaaaatgaactctgtatagtgtgtgtgtgtgtgtgtgttaacaaaataatcaaaaaagaggccattagtttgaggggtgggggatatgggagattgaaggaagaaaagggaagtgggggaatgatatgactatatttttactaaaatgcatgtttgaaaaagaacatgagctagacagatgctcagtggtttaaagcatgtgttgttcttatagaggacataagtttgattctgagcactgacatggtcgctcacaaccatccataacagctccaaggagtgtagaaatacagtagtggacacagctcaaaataactcgtgtatgtgcttcgcttgctccctgccataggatatccctttaatgtgagtgacagcagtccacaatggccatgccaggttagaccccctccaaatatgaagcatccagaaaattcagtccatctggtttcacaaatactaatccaacaacaacaacaacaacaaacaacaacaaaaaaccagcaagctttctctctgccgtctatggtgtagctcctggcaaaggggattaaatacacagtaatctacaaagagaaagcattgtgaggaggcagatgaacgtaaggtatcaagttgctcaaaggaactctgagaataaggaaagactgcctttccctgggagtgggtaattgaactgggtttccatcgatgggaagagactcgggaaagagttcagctttcacagaacacatgaggagggttgtcaggctgaatagtggccagtttgagctatgctaagaccttgcactatactttactctccagggaaagccactacaggtatttgaacaggtatttgagcaagtgagccaaatacacaagctgcatatatacttacataaaagacggcttcaacaatacctcctttctcggcagtcaataactctacccttacattggatatgcaattgtgagtctctctgaatattaaacagcaatgggaaaaactctaacgagatgatatctggctgtgttgggtagcaagaaaaggtggagtgtaggcagcagagtttgaacttcagaagtatacaaagaattgcaaattcaagacattaacaatgctctctctctctctctctctctctctctctctctctcagctcaggggtgaggaaaattttcccctcatctctcctggctttgaaggagttctagaaaggcctgacattttctggtttgtagacaaccactccaatctccattttcacagagccaccaccatcacaagaatgtcagtacatttaggtcatggtccattctagcccagtatgacttcatcttaaattgattacatcagttacatctccaaataaggtcatgttagcaagcctagcacttgagcacatcttggtggaagtgaatactactttgcttgcatgtccttgaacataaactactgtgtgtcttccactatttaatgaacgatctcctgtccaacacaatttgacctcttcttgataactaagtatctactgagccatgtcagggcaaagctccagattatgacagcacaaagccctagcagtccatggaataccagcctcctacttctttgttgtcctctctccctactccaaactgttctgagttcagaattaataagagaaaggcatgctcagaagcgatgagccacctaaaaacccttaggaccacctgtcctgcatcacactcctgatcaactccaccctcaggagatcctctaccagactataccagagaagtcgaaagcctgtgcaggaatgcataggtgaagctgagtggaggggattgtgggggtgggtatgggggacttttgggatagcattggaaatgtaaacgaggaaaatacctaattttaaaaaatgttacaaaaaaaaatatattcaccttcaggggctgggggatgggtatcccgaagctactcatcctgaaacagccagaagaaattcactagaaggcagtgttgggcctgtcctgactagaacaaaatattttattttgttaaacacaaaatatttaaaagtaagaagaccactttgagttttcctctatatgtggagaccaaattttgctgagtcctgacttgctagtccagaattagaacctcagcatgttagatataagggaaagagtatcgcaagcacagagctcgactgtttttagcatgtatgttgacactaatcaggatcaactgatgggacttatcacatttgtgacttatcctttctttttttcttaagtaaattacagtaacttctttgttaagtaacttgcaaatttctctttttcaagttttactgaagtctacatttgatgaagagagggcttcagtctgatttaccttttatattcctagtaaaatactcaccatagagtggcaactagataagtactaggaagacttttatgcaaaacaaatcaggaaagaagatacttacaaggtgaagtgttactgtaacagaaaaaaaaaaagagagagagagaaaaaaagtcctgtgagtcactgttagggtatggatactgtcatactgtcgctgcaggagtgtgagtcacacagttagcccccactcgattgctgggctgggaccttcttagccctgaagctaagaaagcatccagctgacctgctctgtagcacactcaggaccaaggggccaaacccaacactgatttaagacatgaaaacttactcatctcttcaactcaaacccagcattctttttcaggggagaaaatatctgttggtatgaagttacataaaatcccagattgctaaaagtctaatacaacaaattgcaaatgaatctactatacttcagaatagcgtttgtgagttgacaatgttatttcattgtttgttttaactctacttaataatttcataaacttattgctacaaggttactttgagacaaatataatatgtaataaattaatggtgctatataccatatctgtcacctgactttttaaaaatactttgcaagtatttgctgtgtctcaaacaccacatcttgtaattaagagccaaagattaataggtgcatggttgtttattaatttttctctctgaaagttttcataacaatgctttcaattgttcggtagagggttggaaagatggctcaggagttaagagtactgattgctcttccagaagactggaatcaattcccagaacccacatggcagctcacaactgtctataactccattcacagggaatccaacacatacatagtatgcacatataggcagaacacatattcacataaacttaaaaataaaggttataaaacacttttaaaactgtgtaaaggtaagaaaataggatatggattcttaaaatcaatgtttgaacagacaaggtatttaatacacacatagacacatacatacatatgcatatatatatatatatatatataaatttacaatcaaaattacacacatatgtatttttttagaccttagagtgtattctccaacatatcatacatccaaagatacttgccctagtcagctttgtaaacttaacagaacccagagacatctgagaaagaatcaatgaggaattgattgtccagatcagataagtcgatgggcttgtctatgaacattgtcttgactattaattgatcttggaaagtctagttcacttgggcaggtgggttttgactatatgagtctacaagtgagtcgacgggtcagtagcatcatccaggtaactgttccaccttcttgtctatgatgtgagttttttggtcagaggtaatgatgtgtggaataacaagaaagtgccttcaaggtccagactgtgtccctgccctaactttcttcaataatggactatatataacctatgtgctgaaataaaccccttcctccccactaagttgacttctaccatgatatttgtcacagtaacaggataaattagaataacatataatctcaaatacatacacatacatgtgagatatatccattatataatggatatatacacatgtaatacatatcttacattttttaatttatatgtgtgcatatgtatataccctatattatatatacatatcatatgtgtatatatcatacgtatataccctatatcatatgtatataatatatatgtatatctcatatatacacatatatatatcaaaatgtaagaaagtagggatgttttgtaaaataataaattaacagctttgttgtgggaaggatgtcttcttgccttgtttctagctgaggtatatttacttggctaaaatatgtttgaaaccctaactagaataatggttatgtaacagagacctttccaaattatcatattcattatattttaatatttatttgtaactgtgtgtgtgtgtgtgtgtgtgtgaatctaggtgcccttcaaggcaagcagcattgaatctgctgtagctggagttacaagcagttattgggaatcgaacttaggtcctctggagtagcataagctcttatttgctgggtcatctctccagccccacccaattagtatattcttatgccatcatgctggcattaggtcagacttgtgttaaaataatatatttagaactaagggtaacatatataaagcatttctgatgaagtgagttttattcagttttatgtgacgtggcctggcatttgtaatagatctgtaaaccatgaagcgaaagggaatatgggatagcaaccgatgctttagccaacgcagaccaagggaaaagggtgggatgcattttttttctagcagttccaaagtaaggtgttttctcattggtctcttgttcctgctggccatgaactttggcatctagtgcatgagtttctctgaccaggtgatgacttcacattgaaaactgaagccattagtgatttcaggggagatgccttcacatctgttcacaggtcagcacagtagctggtagctaagcagagcacaaagtcccaacccttagacgtatatattcagaatcttcatttgtgtaagatcctggctggtctgaatacatgtcagacagagagaatcactgcatggatgtttatttaaataaagtgcaaagtcctttgctgtccttcaagccataacattccagacattcatagaaatgatggggaacgcccaaagagatgggctttagctttcctttccatcattgttataaatacagaaatgatattttattattatctttcctgttttcagaaacctggaaaaccaggagtttccaaacttggataaaagaagcaaaagcatcagctctttggatgatgaagggtgagctaggagacactgggcacactgcagtaagatgctgacaagcgacgcaaagccaaccacgtttggagtcattagagactagtcccctagatactgctgtgataagttcctcaacaggcctgtcagacccagctgaaccagagagcagtttgcctgtactgcctctgaaacccttcccagtggagtaacctccgtctgtcttctagatcaaagcatttgtctcctacggtctccttgtttctgtctattccgtctctggtgatagtatgaggaaatgcgttatgctaaatctaactaccacctgcaccaattcattgtcttccttttgttgtggggaaataataaaaacgagctggcatattcttgcacttgtgccaccaactctctgtcctggctgcctggtcggccatgcactggcaggcgatggccgacctgtttttatctcgtcatgagtctctggcctggagcgctcaaaatgtctccacccagctcgctaagttcccactggctggttgctaccacaccagccccatgcttcaaatcctccactgccgttgtggcaaactcatgctttcccgccatacctttctctcttgaacccagatgagccaccacatgaagaaaaatgtgacacaaatttagttcaaaaactatggtaactcagtctctgggtgcaacaactaaaatctaattttttgttgttgttttgttttgtttgttattattttttattagatactttcttcatttacatttcaaatgctatcccgaaagtcccctataccctccaccccacccctacccccaccccccctccctgacccacccactcccatttcctgaccctgataaccaccaaacccaaaccaccaaaaccaaaaccaaaacaccaaaaccagatactattgcatatgccagcaacattttgctgacaggaccctgatatagctgtctcttgtgaggctatgccagtgcctggcaaacacagaagtgggtgctcacagtcagctattggatggaacacagggcccccaatggaggatctagagaaagtactcaaggagctaaaggggtctgcaaccctataggaggaacaacaatatgaactaaccagtactccccagagtttgtgtctctagttgaacatgtagcagagtttggcctagtaggccatcaataggaggagaggcccttggtcctgcaaagattataaaacctaattttgtaagccttattaaaatctgattccttcagaggcaaatccttgtaaatctgccatgataccgggaaactctagcagctacatcttacccttatgctgtcctcattccaaaaggacctaactctctcttgcttcctctcttcctccatccaacccagaagtcccgcctactcacccagtaattgactcctttattcattaggggattggttcacaagaagccacctgagtaagtgactcattcctcattccagatagcctctcctgggagagcagaattaacataaaaattaacataagaattaacaagcaacacaaagccatccacaacatcctttcccttacacaggctgagttgactctaggtgaacaaacccctgattcccaccctttgacgctcatccctgactatggcctgcctcctggtcccactcttctttcttctcctccttcagtccctgactctgatttttttatgtttggctcattctcaccttttcaccttgtctaaagagcatcctcttctcatagcctgtcatcagtctgtctgatggctttctaataggaaatggtataatcaataataacctttgccctagtccattcaaactgctatagcaaaattctgccgtttgcattccttaaacaatgtgtcttctttcctttcatccctcttttcctccttcattcctttccttccttccttccttttatggagaccatctagtgatgtggcacaggcatatcttaactttgcctcagcctcctacatactgaattagaagtgtaggccaccatgcctagctcagtggacactcatttctcattgttctagaaactagaaatccaacaatggtttcaggtgatctctccccacacccccacaaataatggaactggagtggcaggctggcaaggaaggagggagggagggagggagggagggagggagggagggagggagggagggaggaactttgagtgtttaaggtaagaccttgttaacaagataactcttatggtgttagctgttcaatagtgtaaaaaaaaaaaatactgtttagggctgaagatgaagctcattggtaaagaattcaggcaccagactctgggtttcacatagtaattgagaaaaacagaaacaaacaaaatcttcctttttgcaaagaaatctagaaagttctcctaatgcctgcatactcaaattacacacaataattctttttaaactgtactttggcagacataatgagaaagatagacatcatttttggaaaaataaccttctgaaacagtataggagtaatttatcaacgcaggacatgatctctagtaaggatctgagctatttaaatcaccctcaagagtttacagaaatagagatgattgctgtgtgcattgtcaaatcagatcataaacacactctcccccccccccaaaaattgctaagtaatccactgaaccttagagtacttttttccacagatatcaagctgattttcaaaacataactatcgttcctggttctgagcttcttagaggaaaaggataaaaatagtcacttactgggaactccataaagagttgtccagggtctggaaaatgtttcagtaggtaaaagcacttgctgagcaaccatgggggccagactccagatcgcgggcacccatgtagaaaaatgtaataatgtatgtaaccacattgagttcaaatcctctctctgacactcagtggctgagtaacataggcaagtaacatgatctcatggctctgttctcacacctgtatgtgtggatattaatatctccttgaagggctcttataagctgaggtatgtggaccatggtaagctcccaacaatagccaagagcttgtaatcccactgctttaagtgtagaggcagaaggattgttagggcttgttacccagcaaatctagtcaaaacaacaagcttcaggttttgtgagagacccagaaaatgatagaacagacacttgaaattctcctctggcttacacgcataaacgcataggaacatgcacctacatatacatgtgtttatacgccacacacacatacacacacacacacacacacacacacacacacacacacacacacgagtacgtaagtaaatggaaaataatcacccagtgaatgactcatctttaattacttcatttgatttatttattttgagtttttaaagacagggtcacacgtcacctaggctggccttgacttctgaccttcctgtttctctgcctcctgggcctgggattataggtgcttgtcacacccatgatttcattttcatataaacatcaacacatgcttgcacgaaaatgaaatcatctttaggaacaattgctactagcaagggtttccaaattgtctattagaaatctctcaaattcaaaataataatattcattattaggaacttaccatggcccatacacctcagcttataaaagcctgtcatttagtacccacatgttcaggtgcaagaacagagccatgagatcatgtcacttgcccgagctacccagccaccgaatgtcagaggatttgaactcaatttagttcagacattgcattattccagcttaagtttgttcatttattgtctatagccactaaaagatacttttaataaaaacttttcaaaagaaatgcagtcttcatgttattattgtcccaaccggcatatcttaggatagtctcttaggataagctcttgtagcttgtggagttcacagcttggtaaagctgttaatgacttttctctacccgaagcctgtgaagagcctctggcactacagcagctagccagcagcagagggaagcatcctgatcagtaccaacttcagttctccctgtcctgtgacggaaatggatattgtcttcagcaatagggtgctctcatctagccctagtgagtagccaagtacacaggcaatggcctagattgtttagggagagggtcttctgggacatacctaataaacaggagggggtcagagtcagttttcttttttttttccattttttattaggtatttagctcatttacatttccaatgctataccaaaagtcccccatacccacccacccccactcccctacccacccactccccctttttggccctggcattcccctgtactggggcatataaagtttgtgtgtccaatgggcctctctttccagtgatggccgactaggccatcttttgatacatatgcagctagagtcaagagctccggggtactggttagttcataatgttgttccacctatagggttgcagatccctttagctccttgggtactttctctagatcctccattgggagccctgtgatccatccattagctgactgtgggcatccacttctgtgtttgctaggccccggcatagtctcacaagagacagctacatctgggtcctttcgataaaatcttgctagtatatgcaatggtgtcagcgtttggatgctgattatggggtggatccctggatatggcattctctacatggtccatcctttcatctcggctccaaactttgtctttgtaactccttccatgggtgttttgttcccaattctaaggaggggcatagtgtccacacttcagtcttcattcttcttgagtttcatgtgtttagcaaattgtatcttgtatcttgggtatcctaggtttggggctaatatccacttatcagtgagtacatattgtgtgagttcctttgtgaatgtgttacctcactcaggatgatgccctccaggtccatccatttggctaggaatttcataaattcattctttttaatagctgagtagtactccattgaccagacgggtttagtgcagagttctatcagaccttcaaagaagatctaattccagttctgcacaaactatttcacaaaatagaagtagaaggtactctacccaactcattttatgaagccactattactctgatacctaaaccacagaaagacccaacaaagatagagaacttcagaccaatttctcttatgaatatcgatgcaaaaatcctcaataaaattctcgctaaccgaatccaagaacacattaaagcaatcatccatactgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagtgttggaaagatcaggaattcaaggcccatacctaaacatgataaaagcaatctacagcaaaccagtagccaacatcaaagtaaatggagagaagctggaagcaatcccactaaaatcggggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattctaccagagaactcctaaacctgataaacagcttcggtgaagtagctggatataaaattaactcaaacaagtcaatggcctttctctatacaaagaataaacaggctgagaaagaaattagggaaacaacacccttctcaatagtcacaaataatataaaatatcttggcgtgactctaactaaggaagtgaaagatctgtatgataaaaacttcaaatctctgaagaaagaaattaaagaagatctcagaagatggaaagatctcccatgctcatggattggcaggatcaacattgtaaaaatggctatcttgccaaaagcaatctacagactcaatgcaatccccatcaaaattccaactcaattcttcaacgaattagaaggagcaatttgcaaattcatctggaataacaaaaaacctaggatagcaaaaagtcttctcaaggataaaagaacttctggtggaatcaccgtgcctgacctaaagctttactacagagcaattgtgataaaaactgcatggtactggtatagagacagacaagtagaccaatggaatagaattgaagacccagaaatgaacccacacacctatggtcacttgatcttcgacaagggagctaaaaccatccagtggaagaaagacagcattttcaacaattggtgctggcacaactggttgttatcgtgcagaagaatgcaaatcgatccatacttatctccttgtactaaggtcaaatctaagtggatcaaggaacttcacataaaaccagagacactgaaacttatagaggagaaagtggggaaaagccttgaagatatgggcacaggggaaaaattccagagtcagttttccttagtagtgtggaccacagtaaacttcccatgctctgtccgatggtgcctttcacccatgagcacacaggcatggcagatggccccatatacctacatgcagataggcagtgctagttagagtcagtacactgcaacaaaaaggataagaggatgaccagacacaaagttgagaagatgtgtaggaagcatagcaagcatccagagagagagccagtggtgggcatgatctcaggacgttgtattcagtagctgcagagatggctcagcagtcaaaagcattggctactcttccagatgacccaatggcagctcacaactacctgtaatttcagcaccaggggatcctatcctggctcccatgggtactaaatgcatgtgctgcacagatatacatgcaggtaaaacatacatacatataaaagtaagtttaaaagtaaaactttagtacacattgtattcatgaactaaaaattatctaataaataaaacttttcaaagaaaaggaaggggcaagcaacggtctctgatttcctcgctgaagataagaggcattcatttcaagtgcctgtaatggtacagactgaagccaagatggtgggttttaatacagctgagaaagggtgggttgctttcccactgaaattgtggaccagatactctccaacctcaaaattgttcatggtttttgatcttggaccaaaggaaaaactacaaattcctctgtttggaacgccctccggaagagttcaaggaagccatcattatgagcgtggtcctcaccagtaccgtgagagtccaagctctgtcaaggttttctttataatttccccagtagggctttctcattcatcctgtgttattcagctaacccatctgaaatgtcagatcttaaagtgtgactgatattattccaagaactaaggaagaaagtgggtatcaggtgaccccacgaaatagctaagtgtttgctttaagcagatttggatgaaggtctagggaggggtaagggttgacctgaaataagaggttgtttcgtcacttaactatgagcagacctgttaaaagtcactatgtaatacagagttggacaaactactgagaaatttccccactttctgagtctgctcaaaggcctggaaacttataaagagattattttaaagaactttgggactttgcatttaagtctaaaccataaaaacccagatgcacagccatttctaaccctgtctagtacattcctgcagcacggaagcaactagagacagaagaaaaagagcctgagaatctctcagaacttagcaaacagggaatttaattcccttttcagtgctcaacctgaggcttgatactcttttcaatttgcttcacttgtccctacagtctgtatccctaaggttgtcctttctccatcttccttccttagaggtgacttgcctttaatgcaaaaacaaagatgaaaaaaatcatattttatgacggaaagtgacatgcacttatttaacacagttaatgttggaatctatacgacttatattgctatttgtcatgggaaggatggatgatattaggtgactaaattagaaggcagccaatgaaagctgggcacggtgatgcaggcttttatgttaattgagaagctagagccggggcatctcctaattgaggtcagcctgagctacattgcagatctctgcggcacggggcgtagggggagagataaatttaaaaatgtaaaaagaaacaacttgctatgacagatctacacaacaatcgaatatatatataaacaatgtcaagggaaataataataggataagctgttcaggactgccttcctgctgagaattacgtaaatgtaaccttttctggcttctcattcgaatatgcccagttaagattttcacattgatgcacctaaaaagaaaagctatgataaatatgagtgtccgagcataaatttccactcatctcacaggatctacggataccctgggtagttacaagaacacagagcaattcgggtttactttctaggagcacataccattcctaaccaagaattagccacaagtttggctttaactttattttaaatagtgatttttgatcaagtgttcactcagtgagtagtgtttcataagtaaagtatccaataaacaagtcaatgtatgagactataatattgatagctcgtgccactgtaagagtctacacaattacacaattagtacaacacagcattaagtcaaaatgatttcgaatctaaagtatttatgtgttagcataagctaaggcctcttctgtttgtttgtttgtttgtttgtttgtttgtttgtctgtctgttttaagtcttttattaactactttagaacaactaagggccaccttgaaacaacagaaaccacctgctcccattttttttcttttactgactttatttttgttgttttgaagcagggtctcatgtagcacaccaggcaagtgtgagctcactgtgtagcccttactcctcccactctacctcccaggtacgaggatgggtagaagtcaccacagcctgtctctcttcctcatgttctaaccaccaacaggaacctgggctctgaaatcacactttccgcagggcacaagacactgtggctattggtcccatctaagcagcaggaaaacagagtatcatctatgtggacgatgcgccctggggataggacagggttgtgagcagtacttgggtcatgggaccccatgctggaatggtgctattgctctgcaggcccatgccaggcagttccagccatctgcaggaccgcagggctggagtggcaggaacagacctttctgtcctcctcggacaatggtatggtgactgttgacagattaggtgtgagcacagtatgtgaagaaaactcttccagatgttcttattaaaatcctttttttaaaggttcattattttatgtgaagggatattttggctgcatatatgtctttaccacacgtatgtctgttgaccatggaagccagaaacccatcagatcctctggaactggagttacagatcgttgtatggccatgtgagtgctgggaactgaacctgggtcctctggaagagcagccggcatgcttaaccactgagccatctctcgagccttcctattaaattcttaaatgctcagagccatggaagattgaaaaattctaaattaaaaaaaaaatcaaacaaaacaaaaccaacagcaaggagagtagaagttgtcaaaaacaggaccgctcttatagtcactgactgctctctttatctccaggttcatcttagcgttcaaaagaattaaagatgtgaagcagagacattagacttgtggtagggatagaaacttctggtaatagcttttggtgacatcaatcaccgtgagaagagtcctggacagctggagaagacaatgaatggggggatgacagtttctagaggtaacaccgtatcgtcaagaattttgcagcagtctttcaagacacaatggcgcccaatcacacagttcttcccagtgtggacataagaaccaatctggaaggatggaccatgtagagactgccttatccagggatccaccctataatcagcatccaaacgctgacaccattgcatacactagcaagattttatcgaaaggacccagatgtagctgtctcttgtgagactatgccggggcctagcaaacacagaagtggatgcccacagtcagctaatggatggatcacagggctcccaatggaggagctagagaaagtacccaaggagctaaagggatctgcaaccctataggtggaacaacattttgaactaaccagtaccccggagctcttgactctagctgcatatgtatcaaaagatggcctagtcggccatcactggaaagagaggcccattggacacacaaactttatatgccccagaacaggggaacgccagggccaaaaagggggggtgggcgggtaggggagtgggggtgggtgggtatggaggacttttggtatagcattggaaatgtaaatgagctaaatacctaataaaaatggaaagaaaaaaaaaaaagaaccaatctgggcagccttgaccacacagtcttcctcaataaagacacgatccccaatatgcaggggaaagaatacaacacctttgctgaattgttttgaacagcagccttacgacactacggcttttcacaacacagtgacgtccaactcctacgtttgccaggtctccttggatgatacagtcattcattataatggtcttgccattgagaacaatgttctggcttccacacaaaccagactggagactaactttgttcccagacactgtctctatgtactcggagttgttacacagcagttctcccaactccatcactgtctcctctctgaacctcaggatcctgtcagtcacttgggctgacctggcctcttctaagtaggaattgtgctaaaatcctgaacttagacttactgtaagaagccagaagttcagacactcaagcaaagttggtccaaacctctcaggttggaaatataacaaaatgagggttattttttccaagatatgacatggcttttttcctgcttttacctaacatggaaatggaatgggcacaatacccctgtggcatgtcacagcttctacttttggttggaaaacaccaaccggtgaccatgaatatgacaaatcgaaagaaaaaacttagagtccagagacattccaagctgaggaagggagttgatgggaactcaatttcctaacctgaccaccagctaaccatagcttggatgcccagtggcctctgagtcagtaactcctcattccaaaataacacaaaaacattttggactagaagatcattgctaagtatattattaataatatttccagaaaaagtaaggataactcctttgtgtataaagtggtcctcatgcaaatccctttatctaggataatctggaatgaggcagcgtgggcagtttgctcccagatcggctacagcagttttcatcaacttcatttagaaaccgaggacaaaagtcagagctagcttcaacagagttggtaactcttgacaggaatttggaattgttaagggaaggaaacacactgagttttcccaagcgtttataaattgtgaacaggaagagtattttaaattttgtgaaaggctatttaatggtgtctccaacttaatttcttaaaagaaagtccttaaaaatgttgttttgtacccatagtggaacccccatcctcacacttaccaaagactctagcactgatatttgctgttttttaatttctgctttgtttcaatctgaaggtctccctgcattgtcctaaataacctagacttgtgatcctcctgccttaggctctcaagtaactgagcctacgggcactgtgatggtttgaatgacagtgttccccataggctcagctgtttgactacttggtccccaattggcaacaatgcttgggaatgcttaagagatgtgaccctgctggaggaagaatgtcactgggtgtgagctttgggtttcaaaagccacacaccattccaggtttgttctctctgcttcctgcaggtagctcctgatgtgagttctcagcttgctattccagcagccatctccgtggcctctgttcctctcacactgccagagatagagaaaggagagacctgacctgcactgcaatagtgaaaggtgccttcaacgccacacctcacccagttgaacttccaatttgtgaaagaaaagggcctagggagtgttctgttgccacggcaaatcatcatcccgctgcaaaggtgacttgaggggacaggggtagcagcagagtttggcagtgtcttccaactttcgcaaagatgcaggaaggagtaaaagagctgcggaatcttctcctgcagtttcacagatgtgccaaggccaggtgtggggcaggctcctacatggaggccttgaggggctatggaatagaattgtggaaataaagcctgccttgtgttggaaaccccatatttggagtgtccagagctgtgggatgtctgccaaagaaagctgtatgcaggaagtggaaccagcccaaggaagagatgtatattataggcaacaaatctgggagggaagagcaagctaagtccttttgacactgaacatgaaacagcaggatttgatgtttgtgctgcttggctcactcttgttttggtccagtagtttttcactccctttcagactgataatgtatattctgcaccactatacactggaagtatgtgacttgccttttgattttacagatggccatagttaagagactgtcttgagtctccaaagaggatttggacttccgacttctaaacagtgtcgagagtgaaagattatggggaaaattctggagttggactaaatgaaactgtactatgatgtggccacaagcctacacagctggggggtgtgatgtggtggtttaaatgtgaatgctctgcacaggctcagatgctggcactcttggtccccagctggcagcttgggtacctttaggatgtatggctttgctggaggaagtacaccactagaggtaggctttgaggtttcaaaagccacaccttattcctacttgtttcctctgctttctgcatgtaagtcaggatgtgagctctcagcttgctgctcctgtggccgagcctgcagtctctgctccatcatcatggactctaatactctagaactgcagtaccaaacaaaccatttcttctagacgtttctttggccatggtgttttattacaacaatagaaaagtaactgttacaggcacacacatggagtatggtaaaaaccttcttaactgataagttcaaaccaccaatattctaggacactgctaatgttttcgtgagatctctacagaatcgatttctacatatttagttcagaaacagacacaggaacctgtgctcattttctatttgtctgcattatgaatggatagcagattacaaaatcctacgagtcattaatgaaaaatataagaatgtcctcacctataacctagacatatcacttgccctcttatccataaataccaaagatgattgcacacattgatattccaaaattaggcagaggaagcaaatacttgagatctgtgttcaagcaagcctttgtagatgaatagatggaaccacgctcagcccagttggtgactggttctagttctcccagtgacaccagagtccttgaatggtcacatctcttatataagatgtcaccacagacatactttaaaccacatctgcattacttacaatacctaatacaaagcgaaggctatggcagatagttggactactgtgcagggaataatgatatgttttttttcaagtctgaacatgttcagtaaagacactgtttgtttgcttgcttgcttgtttgtttatggttgtggtcaagcagttaaggattatttttttaatcagagaagaaatcaaaaccaaagtccactcactagagaaactcactagagagaaaaaaaaaaggacactcactagagaaaagtaatggtgccctaaatgcagatgtattttccctttagtgttttctagcccttactggttgagtctggctgcagtacctatgaacatggaaggccagctatgtagtgacacaaaaaaactatgtgacttgttgagatgaagagcagaaaggaacaggataatgacatgagacaggactgagacgtaaccttcgtgtcgctgacctcctgacccatctctttgtggatgcttgttagccaaggagccagccaaactgactaatggtattcctggaagccaagaaacctgttggttggtacaataagctaaaagagtaggagtgtgtgtcactcagaactggctcacaacctatggatcacaacctatgttccactatgattgtgactgtatttctagggtaatagagaacctccaggatgttacggaagagccttggccttcatagagggtaattctggatcgtgctttggatgggcagggtgaatgaggaccgccttcagttatgctggtgtgttcttcccctgctgctccagccaccacctttttgccacagctctcactctaggctttatacattaatactccatatgaacactacttctacattatactcagggcctgaggcatgcttcctatgaaaacgttaatcaagcacaaatacatgtcttacaatttgcttttatgagtagcttcaaattttagttgatgggtcttttttaaaaagtaatactgcagctgctatttgatgacaatcaagctttccttcttccagactgttggcagactgaaaaggcatgtggcatgctgttgggaacacattcaatgggtgggaaagcctagggtagcactgttgaacttgaagctgaaaactatggctgtgtttgtcaggccttgaacatacagagaaaaaaagctgctgggccttttgatgaagatttgcctactgaggtaattcttggacaggagtcaaattactcagaagagaaataagttcatgaagagccaaataagtacatagagggttctccaaattcatcaattatacaacaatgagccccttagaatgagttatttcccagaggcaaactatgcgttgtttcatctttatttccagagtcccaggcacagtgcctggtgtatggtaggcattctataaacactcatgcaactgggctgaaccacactgcttcatgtcccctgcaatggtccctttcaccaggtaacagccacacttaaccttggctgcttggttatacaggaggagcatctccaacccccacaccccactccccaacctgatccactcccctaattcttattctattgctcactcgccttctcagccccacacaagctgtagttgacacttgcagagctcactgatataaacaatacagaccataaacaataaattccagggagggaaggactgtggacttttgttttccagtcatgcggtaaatattgtttttgttggctctcagtaaatatttgttaaaatactgaggcaggaacccataattttcatggtttcctctcatgctaataatattcagaaggttttaaataatatgaaataaattatccttcgcatactcacataataatgggaactagaaaagcaaaatgttttgtaaggcaagccatgcaggcaggaaacacacttgcaagcaggcacacacatacacatacacaccacacacagaaacacatatatacacaggcacattcagacacacatatacacactcagacacacatatacctacatacacacataccacacacacatacacaaaatatacacaaaccagatagacacataccctctcacatacaaacacaccacacacacacatacatacacactcacaaacacatacacacacaaggcataccatacacacacatacaccatacacacatatgcgcacatgcatatcatacactcacacacataccacacacatatacacacaaacatatacatatcacacacccacacacagatattgacatgcaaacacacacacaccgtacactctctcacacacattcattatagacagaagttactctttatcctggagaccacagagaaatgaaaatgtctgtggagaactatactgatttgtaggcatttcaaacactttctttaaaaagaacagacaacccattaagtttaacctgagggagtttgtttttcttattgctttttgtttttgacataaagttaaaaactcaaataccatcaacttccttatgcttgacccaatcactcagtcatccgtaaacagtttctccttggcgctgctctctgcagtcttggaatgagagaaaaaagacccctgttctgatctgagctgcagtactggagagtaaagaacgtggtgaataatgaggctcttttctggttacagagaaagagcagaaactgagactggtcacatttaatctaatacaggaacatttatagcaagccagaatacagtatccagttattcaagtcaacaacttaataagcaaaattccagaagaatgatcaagacagcagggagatccaagacagtgattgctctcattccgagggccttgtttatgaagtaaccaccttgttacagagcagacacagcacaaaacgatgcaagagagacagccacagcccctgctgtcaacaatacacaaacagggattccccaatccagccctgcaccccctcagcctgtaccagaaacagcagccctgagcagagcaataagggcgctcactttgacccaaaaggaataaccccacttcataatcagggtccttggggaccatgctctctgccaagttaggtatcaataagtaagaacaaattaataatcactccattgatacaaaagggagatctgaaatggtgggttaagcacggcactgacggcttccttccttccttccttccttacttccttccttccttcctttctttctttctttctttctttctttcttatttattaatcattttattcctttacatttcaaatgatatcccccttcttagtttcccctccacaactccccatcccatctcctctccgttttgcctctatgaggtgctcctccacccactcacctactcttgcctcaccatttctagcatccccctgccaggagaatgatcaagacaagcagagacctccacaggaccaagggtttcccttcccattaatgccagacaaggccctcctctgctacatatgcagctggagccatgggtccctccatgcgtgcaatttggctggtgtttttctccctgggatctctaggtggttcagtccagccacctagctcaaaatttttaacccagaattgtttctgtctaaagggaatgaagggacaaaaaatggagcagagactgaaggaaaggccacccagagaccactctacctagggattcatcccatctgcagacaccaaactcagacactattgttgatgtcaagaagagcttcgtggcaggagcctagtatggctgtacccttagaggctctgccagcacctaactaatacagatgcagatactcacagcaccattgggctgagcccagggacctcaatggaagagttaggggaagggctgaaggaacagaaagggattgcaccaccatagtaagaacaatactatcaactaaccgatggcttgctctcatttcccttcctcagctttgattgtttaagctttcaaggctgtcattccactatgtattacccagggaatgtaatatgattttatatacaatttaatctagcctcatcccagagcaaaactgcaaacaagaacaacaaatgagccgacaacagcaaggcacctagacaaaggctgaggaaggagggtcaccataattcggaggcatcagaagaaactagccaactctctgattcaaatagacaagtttctgggggtttacaaaggagaagagagacccatagaagaataagcaggctcttacaagctggacaaagctaagatccaagtcccaagggaatgaaatgtaaacaccaaaatgaacatctgggtcagagtcacatttccttctcttggtccaatagtacaagcctgaagatcatcgttattatacaagcctgggatctccgagaccctaagggctacagaaagctgcccagtcactgagaagcataaattatacaaaagatgaatttgtatgtgtgcatgcatgcgcatatgtgcacatgtgtgtgcatgtgcctgtgttattggtttatcataatgaaaagatagaatataaaaaggtgtttaccttgcccttacccaacatgagctggaggtgggttagaaggaaaagtctccaaatccagcttagttgtcacagagaggctaggttgcaaatgtgctgtgctctacaacagatgcaaaggcagttaatgcctcggtctggaagccttgacgccgggttgctcatcactgatcataaagggactgaaggcaactagagttatccaagagtccccaaactgtctacgtataatttcctgagtgctttgaccaattatctatctggtcgccacaggcagtggttccttgtaatgtcagaatcatcctgccagaagtgtgaactatggctttaatcccagaacttggggggtagaagttacagacctcttttgggttcaaggttgatctaatctatatagagttctacttcagcaagggctgcataatgaaaccctgtcccaaataacaaacaaaaaaagctaaggatgtatggagaggctccctgtaacagtggttctcaaccttcctaacatctctggcttacctatgagctctctatgatcttctatgcccaggacccaaacacagagaacggtgccacccatgatgggctacgtcttatctagccaacccacagaggcacatgcatagacaaacctgctctagagagttcttcactcagactctcttccctaggaattctagatcatttcaggttaaatgttaaagctagccattccaccttcataagtaaatctgccatacttctaacctttccttaagaccccacgaggctgcagccatagtgtattcttccttcccaaaagcatcagggtgggcctccagccaatgtataggaattccatgcaatttcaatttcaatttaaatctataacaagatgtgtggtagctgaaaaataagtccccatgtttcaaattaccaagatactgggattttttaaaatctgatttctgcctaacttcctaccattggaaaagctcagggacttttaatacagcaggagggcgggaaagtgagtgtcagccaatcaaagaacggaaaggaaaaaggagaagagaagacaggagaaagcgcaatgagcagagacctgcccctgagtcaagcagctctgaagtgaaaaccagaacaagaacagacagggaactaaaccatgacccatcagtgctctagaagtctgcactgtttccttcaggaggagaacttgatccaggcagttctctcctccaggatcctgttctccattctctcttcaacagttgtcaagtttaagtgaagagcttcagtgtttaaggaaagcatactaccctgttaaatttaaagttaaaataataagctccccatcttccagattgccttgaaaagacaaatgttttgtacctgtgcaggaactaacagggtctgtgcctgtttgccgacgtatcaagtggtctggacagatgtgactcaccaagagcagtaggggctctctttccagagaaccgtggccttagaggttgtgtggtataccgtgtacctgtggtgggtaatgctttttttttttttcattctgcttctatatttttttgacccatcttatagatcaaaacttctatattctgatgaacacaaccacatgtgcaagatgttccagatctttaatgctaagtaatctagctccattctagaatatctgcttgattatttcaatgctctgaagttcttcgtcttgtgtacttttgtccattattttctctgtcttcttctgttaatcagagacatgattaagtctttatctaaaaaccatcatatctatgccgtctgtgggattgttgtctctttaaatccaagattctagtcatgccttcctgttttatagcatatgttgaaatttttaatttaacattaaatgacatgggtataaagtcatgaggcaatgaataatatcttcctcataaatatgggggctaagttttcttctgacagaaaatatgtactgtgacaactttaattccccgttccctaggacccacatggtccctagccctagaacttgctaacatggtctttactgacagcctgcggctatataccaatgccatctccttcagcactgctggaagtcctatgcccttccccaacactatgtggatgcaaaagcctccagtcagcttttctacagtccagataatggtctgtgctctgtgctgggtttcttgaggtttcttggcctaagaaatctgcctatgtgtacagcctcatgctaatcaaagtggagaagggaaggtggaaactgaagagtcaaaggctagagtgtcatgcctgatggggcgagacgcaatcagaagagaacagcagagtgctggtgcagcaactgcttcacccactttccacctggatctacgcctttgcacaaagcgcatcctcctaggaagccggcttcctcacacaggaagaagagcagagctcctgctgcagagccctggatacaattccagggtgccgaatgcagccccattcctccttacaacaacctcagcagtgactcttagttcttgaacaagacgccatctgtacagtaggtaccattgttagacatttagaaagtgtctacaaccctaaagactttgcctgccaaccttttacacagactcggaagtgagaaggcacccatgactacaaatgtcggggagacatttgaatgtgacttctcaagctcttcacatgtgcttagtgaatctgtgtcttaaactcacttactcagagtggatcatgaggaatgtcgcctaagaatcactgtcatactgtaagggcctcttactttattctttaaagtgtaattgctaagtaatttaattacaccgatgtgtgtgtgtggttgtgttaaatactgttattttcctttcttttccatgatccttatcataacctaacagtatgcatgggaggtcacaggcacactgtgatgcctctcctaggaagtgaactcattcattcattcattcattcattcactcattcattcatttcatcgaccccccaagagatcagactccaaaactgggcatggatcctgagttaagcataaaatcaacggccaactaacatggcaggaatgtgtccagctaaggtgttctgcttcctaagcataaaaacgccaagtccgaattcaacccaatctcctccatttatttccctcttcttcacaggctatttctctaggtaactaagacaagagtgtataaaagacactgaagaagggagaaaaggaatagagggaagaaaagggaaaggggaagagaagaagaaaaagagtcagaaaacatcaaaggaagggaggaaaggaaaaatgaccagggggaagggcagggggcagggctaggagaaaagagaacatggaagaccaaagctcggaagtcaacagacagtgcagggacagctcagcactgcattctaaatatatacttacactgcattttaaatatatactcctagagttaaagggaaaaaaaaaccctaatttttctagatggaaactcaaaggtggccataatttctattatactgccataaactggggtgaggggaggggccaaggaaaaggagagagatattgtggggggagagagagagggggggagggagagggagagagagggagagacagacagagagagagagcactaaggcagtttagagcaggttccttgcagccggcttttcctgcagatagtagcagggcagacgttgtgtcctgtttgacccttcttcatagctctccagcttcctgcagacagagcacagcaaataacctgcagaggccacagggtccgtgcttagaggtaccagttaggccagagtgatgctgcatgccttaactgtaagcattccagacacagagagacaggctgcgtgttcaaagctggcttgcctatgtaggaaggtctcaaaagcagagaaaagaactgccccaatctgggtcatgtaatttcattaattttataggacagataccttaactcttgatctaaaaaaaaaatgaatgagactaaaatgtgcaaatgtttgtttttgctggctatgtccaatgaatatctaggttacagtatctgaaacagcaggatcatttcagtctgagagagttcctgaatttttacaagcatccctaccaccgccgcacgtgtgtgtatgtgtgtgtgtgtgtgtgtgtgtgtgtgtgtgtgtgtgttgcatatatgtgtgctcacacatgttctcttatgtgtatacatacaaaggacagaggttgatctcatgcctctccctcagtctgtattttactgaacccaggacttgccactgcggcagaaatagctcaccagcaaacccaggaatttgcttgtctctgcccccacaggattgggttacaatccagcactatcaagcctggatctgaacccaggtccatatgctggagcagcaatcactttaccccctgagcccagccctgttcctttctttcttaccttgaggttatcagagcaggaagccacaccccatcggcgctgtcttccacctgaaacccaagttcacagtgttactttcaaaatcagagagaaagctctcaacaatatgctgttagttttttgtgaggagaagtgtgagttcaactttgtattttttaattattatttttaaaatatgatttaaatattagcccgcagatcaaatgagtggacagttaaaggacaaggacatcaatgccagtgaattttcagtctgcttggctctcagtttgatgttccccacgtccgtgagtgcttgtcatgagtacactgaacagagactctgtactgtttaaccctttcatcttctgtttcaattcttggttctctcacttctttgatgacagcaacccaccttcctgacactgcacagttacaagggtcgctctcataatatgctcagtgaaggaactccactgatttcatgtatgtgtaaatacatccgaaaaaaagacaagctactggagcctggactatgtggtgtgttacaaaaaggaagtgagacattgtcctgaaaacaaggtggagaaggagagccagcctggaaaattgtctactgacctccacaggcacaccttgactttcatgcatagccccaactgatggtggtgatgatgatggtggtggtggtgatggtggtggtggtggtggtggtgatggtgatgatggtggtggtggtgataatgatgatgattttttaaatttttttgtgattttatgatcaaacgattctactagcactaagcagtgtaccttagtctttaaacttacatataacttgtactctcactatctggagttcgagaaatagatctgatagaggttgctttaatctaaaggaagacaccgttctgtgtgttagaggaaagaaactttatatccaagataaattccatgtatgccaattcatactaccactcaaagcatatgatagagacatggagacaataagaacaaccccaagctcagcctaaggagttctgggaactaaaaataactcatggtatctcttgagacaaaccccagtgttctgagtcactcgtctcctatctcagttttatatttaaccctctttcaaatggcattccagggatgagatgatgccattgctggcaggatgtgatgatgtcatcgttgctgttccgtgaggatgtgttagctgcctccccttgttgcacaattgctatgtaaccttatatgtaaatttgggatattctgaaaagtgttggaggagactgaaaattcataatcaagtaaataagatactgctgtagcttgtattctacttgttatgaacaacacaactaaggtctgtattgtgtgtgtgtatctgtgtctgtgtgtatgtttctctgtgtgtatgtttctctgtatgtatgtctctgtgtgtgtatgtatgtatgtgtatgtgtctgcccctgtgtgttgtatgcatgtagaacattcacattaatgtgtggatacatgctgtctgtgtacatgcagagaccagaacagaacaccccatgtcttctgtctccctctctttatgctttaagacacagtctctcactgtactgcaagcttgtcctttgggcagactgggtcatgcagccatgcctggatgtaaggtacctgatctgagatccttgtgcctgccgagcaagtctcctactcactgaaccatttatgtagacctgtgttttcaaaacaacttattttttttaatgaatcagtatttatttcaatttcaaaaataatgatctactacttattttgttctgggaatatcagaaaatgttttcttagttgagcaaactatcagttcactattattttatactttcaatgagccctgtaccttcattaacatgaagatttaatttgatttttaaacttaggcctccaccgtatgaataataaggtagtaacatttgtatgggtttggagaaaggagaatatacattattaactggcaaaatttcttccaagtaagcttagccatcaaaaaatgtgattttattatatggttaaacaaaaatgcacattatactgtggcaacaattgttcctgagtttaggctttctgctttatattttcctagcactataatttactataaatgataataaatctcttgtgacaaggcgctatattttattgtttgcttgaagaattgtgtgctcattcacatactggcttatcaaaaacactaagtaggtatttaaattttcagaaaattcatgctttgttcatcttgacatacatatgccctaacaaatgaagagacaaccacatggtcactactttacacagagggtcactactttacacagagtgtcacagtgtctgggaagccaatgaattgggggtatgtagaggtctggaaagatccccagggtccacgctcacctgttgtgtgatgttttctccacagccctgaccctgcatctgtgaaagggaagtagccttgtgaggttgggcaaaagtctcacagtgaacctatgcagccactcttgtgagagtgtcagccactgcaagcagagcatctcccaagttgtgagacaaggaaggtttccaattgggaaagttctggagttagacagtttctgtttctcttttgatgtgcacctcaggcataagtcgcctctcagcaaccttaaacagtgttcttgataaccttatgcatgaactgctttcatggtatggaattttccacttgttcctaccatgtcagtgcttaccaatttcaggtttggcagtacactggacttgtgatttttcagatcagagatgattaaccttcatcctcacacaaatgaacacaactcttataggtttcagagaggccgatgttgtggccaatcctgtcttcctctagaagaggtggtcaaagggaaacatgagtgtctgtactacatgaggaagccagccaccaagggggagcagctgtttcctgaagcttacagggcttctgggaaagttgtgggatgtggaaagctgtggaaagactgtggtcagaggctcccatgagtctgcgcactgagacccacccaccttgtatactctgaagggggtggtctcatgtttccgctgaatgatctccaaggtccctatgatctgctgtcttcacacacagtgcatattgcacagggttctgaaaaacaaaacactcaatagaaagcaaagatctgccattaaaaacaagtactcacagtagaagtagcttaaaatgataatatgcattctgacttagattcgccggtgcattttttacattttcaatttttacttccttttatgtcatcttttgtctctgagctgttataattttggtgattttttttcccacttaactttctgagcacactgttaaaatgactactggactattattcaaagccaagtgcctgaccacaccattattgacgatgcatttgctctactgatacccaaaacatgctcatcaagtggcatcaatacacgcagcacagaggttcttccagggatagtgggaggagcagctcagctctgcccttattgggttccaagtaatgaggcataaagaccaatgtcatctggctacagaaaagctctgagacgatcagtcaggaagacacagaaagagagtacctgggagctgcagaacagatgagggtgggcagcttggccagcaacatagagatgggagggagattttagtagaaatcaccattagataaacagtcttgcattaataaagggatgcaccttttaccgagaggaagaatgagcacaggaatctgtgggacactaataacttgaagtattctgcttagatcttagacctcatcacctggcaagtacagacacagtacagtctcattactttagaaaaggtaccatagggtccttgaaatctatgaatcaggcatgagagacctggtaagaacacggtgtcaccagcgatctgtccttgtgatgtgatctccataggtcatagcccccgaatcagaatgttaaaattctcagtataaattctttataactgttgacatttattgaatacaacacatcacagcaggagctgtgaagaaccataaggaatatgatgtcttccctcaggaatgttatattggttcaatatgtatttgttgtgctttgtgttattgtcctaaacacatagaattttgcaaattatacaaagaaaaattattagatatcattcacttaatcaagaaaaaaaacaaataaacattactagtctgcattggaaatgtaactgaaataaataccttaaaaaaaagtagaaataaaaataataatttaaataaataaataaataaaataaagttaaacacacacacaggaatgtgcatatatatagtgattaaaggacagaaaataccctacctaaatgaattaaaaatgaaagcaatagctcggtgcacctttcccaccaaagggatacaactatctcttgtgaggatatgccagtgcctggcaaatacagaagtggatgctcatagtcatctattggatggaacacagggcccccaatgaaggagcttgaaaaagtacctaaggagctgaagggatctgcaaccctataggaggaagaacaatatgaactaaccagtatcccccagagctcttgtctctagctgcatatgtagcacaggatggcctagtcagccatcaatgtgaggagaggctcttggtcttgcaaagattatatgccccagtacaggggaatgccaggagtgggtaggttgggatctgggcgtggggagggtataggggacttttggagaggaaactatgaaaggggataacatttgaaatataaatgaagaaaatatccaataaaaaatagtatacaatgcgttatagttggaaaaaaaccagtttcaacacagacgctacagagaaaaaaaataattgatcttgaatgtctgagttttcaactctgtgctattttttaaaagtgtttcttttattagacatattagcctatatcataactgtgtttttacgaagaaaacaagaatgttttgctcaatagatgccatgttctaaaaaaaagaaagaaagaagtagattggacctataaatagaaggtagagtaaaagcagggttcattttctggctcaggtaccccaggcccttcctcatgcttcccataggcttccattcctaaatcttggatgagtgctctgctttccattcgtaaggtctgggatgcgtgctctgctttccatttgtaatgtctgggatgccttctctgcttccctctttctcttccagcagcatccatgaggaacccaggtcagccaattgtatgttggtcacttccccatggtctctcaccatgcactcagctctctcctctcaggtaccacatgcagacacccccactgacagacagtgagtgcatagtccatgcatgggagcactcagcgctccatgttcaggctcacgacccattctacagcattggtaaaattcattcagagctttcagcgttctatggctccccagctcatacaactatgaacgtcatttatttattctcagaacacatttctggcttctgcaaacacatcagagtcttcttgcaagcaagctccaggtgactgctcatattccaccatatgttaacacaacactagaaataaactgcccaaaacactgtgaattatctttgttattcagaggtacacaagaataaatttctagctttccatttggttctttggaatgggtttagcaatctgagagaatttcacactgaaatattcttacacctaaaccttgaggaccctgacaattatttttaaaaattccatcagcccgtcagtcagtccgaaactttccttaaacatgtactagtgacattatccactttagaactagtcactttggtatgtgacagcttgagttacataagcactgtgttctccagtgtttggagaagcacaaacttaccaggtgtgaacacaaagcccccgagacagtttatttcatgcaatcgatcaataaacacaaatgcctccagactgatatgtggtgttgcaaagcaccatagttcctaagaccttaaagtatgtgttcttagccagatatagactattcatagaataatgtaaggttcaagctagttcccaaactttatataaggaatgcactgagtggtagatttgtttatactcagtgctatgtgaaacgttattcataacttctcagaaatcagcttccaataaataccttaagttatttaaaaacttttccaaagggcagtggtttctcaggaagctcctctgtggtctttcatatcttgaaactgatgaaaattttctacctgattccctccaaatcttcaaaactttcaaaaagattttgcctcataacgatcttctatatatcccagtctgtttaaaaacatcataaaaggctgttgggtcatgttttatcctaaagctacgcaggaagttttaaatgctacaagtattatatcagaatatcacaaaatattgatgtgaatgaaaaatagtacacattggcaaatgctggacctgacagaatggtttgtaatacaaaataagacaatagattttacaaatgggagagtgtgtgaaaacacatatatacaaagacacacagacacatgcacacatgacatggacactgacactgactgacactggtgacacacacactcaccgcagaactgtccagccactaagggcaactagattctgccacttggaaaacaatggctgataatgataatcgggtgataaagataatagtattaagctaaataagccagactcataaaaataatgtgatatttctctcacatacagaatctagactcatggtaactacttaaaaagaggaaggaaccattaaaagaggatgagatggtgagattttttggttttgtggtactggggcttgatcctgggattttatgctagatgtcttggttattttattgttgtgataagataccaccataaggtaacctacaaaagagtttgtaggggccttgtggcttcagagggtgagtccatgaccatcatgacagggatcaaggcaccaggtaagcaggggtggtactggggcaatagctgagagcttatatcttgatatggcaatcataaagcagagagctaagagagaatcttggaaaggtgtaaggctttaacacatctattccaacaagaccacacctcttaatacttctcaaacagttccaccaaactgggaaccaagcattccagtctgttagcctatgggggccattctcatccaaaccaccagataggataagtgctctaccactgagtctcatctccagccgatggagaagcattaaaaatgataagattaaaaatccactacatatacagttacactatcataatgaagcccagagttttgtaaagtgagcatagattagcaaaaataactagattaaaaataatagatagctgatagacagacagacagatagacagacagacagatagatctatgtaagacattctgtactgctaagagcacacatgaactaagaaaaagcagggaaccatcaacaatacagcagttggggactacaactgaggatgaaaaaacaagctcagcagaaggacatgagtgcacagagggaccaaaggagaagtcagggttggtgaacctgaactctaataccatcacagtaggatcaagtcaccacagatctaaacagactgtgatggggtggctgtggagaggtagtttggtggcaatttgcagtatgacaatgtaaacatgattatttggagatagtaaatctaaggtctctctgagtacctacatgtgtgtgccactgtggtgtatggtgtatggattttaacagcatctaaatcaatgtttctcaacctgtgagacatgacccttttgaagggtctcatatcagatgtttatattcataacagtagcaaaattacagttatgaagtagcaacaaaaataattttatggtgggggtctgtgaagaactgtactgaagggtcacagtattaggaaggttgagaaccactggtctaaagaaatgtgaggacaaaagagaagacagctttgctggaggggtctcttttaggtaagagagcatgcgtatgtccatgagtcaaaaaacagcacctagtagagaaagatgaattaagaagcacgagggaaagaacaagcatcattttacaggagacaggaggatgccctatccaaagtacaaggtgtctgtgcgaagtgttcaggatggtaattactagatacacgtggccactgggcagtcatagtgtaactgaggaaaggaacgtttcattttgattctttaaagtgtatttatttattcatcaagaggtttcactgagaagtcctgccctggaagttggtaggccctggattcaatacattgctgctaccttgatgtttcctgaactacacgtgtgtgtgtgtgtgtgtgtgtgtgtgtgtgtgtgtgtgagagagagagagagagagagagagagagagagagggagggagagagggagaggaagggagggagggagaggaagggagggagggagagacagagagggagagacagagagaacctaagatttccccgaactcttaccacttactgtggaccaaaaaaaaaaaaaaaaaaaaaaaggcttccagataccatttctgctcagcataagacctttttcctttcttggaaagttggctgtaaaagcatgagcaaagtaagtgtttggagctctggagtccacttgagattaagaccaggttttggggagtaaaatgagaacacatgagagacagatgctgtaccaccatcctgtgttcccccttctgacaactacttcagaagctggccaggaaaaatcgacttgactggtatgggagggactggcctggaaagtggtcaaagccagaatgggatcatttgactgcggcagtgcccggtcctactgcaaagtaagagtgcttcaatgtctatctgacgctggcaggaagtgtgcttgctcacctagtgggttggaaacaaactgatggaaacccaggaatcagctacatatggaaacagcagtacaaaatgggatcaagaaaaaccagcatagacgtgttaaaaatgtgatgaaaccagtccaagagatccgtttgggcaaaattagcatttattgtttacatggaagaaagaccttcatggtaggatatgttcagacattagtaagtccacgattagatgaaatttaatgctacagttgttaacttcctcacacaggcatgagtcactgagaaaattcccttgttatgagcctgccattcctagacgacacgctcaaaccttgccacacacagttaccgcagagatcattccattaacaacatgaaccgagacatggttcaaagccaatcactccacacccaaaggggagcgggcagaagcttcgaagtcaactctgcattcagggtacctagtttaaggaaagtgcattttcaactaagacaggctcataaaatacacttggtagcatctatgacgacaccctaaggcttgtctattgagggccactcacgacaagcccatggttaccgtgggtatcactttggtgtgggtagcctgctgccctctttcatatttattcataatggcagcttatcagtgaatggttttttaagagctttttacgatgtctgtggttggtcccattctcagcctaaacaagacagcacagtgttgggcatggaccttcccaacgtgggataaagctgatgtcacagcagagcacaccctgacgtgagcctctgggacccagccatcatcttaagtcatcttaagtcctggttgagggcattggttcatctgtgggtaagaagcaacatgtcatcccaaccacacaacttaactggtgacgatggaaataaatatatctttaagtccaaatttctcttctaatttagaccagtaaccattatcttttgacttcacgtttatcagagtataatatcaggaacagagtatcatgctagcgtggctgaggtgttttacatgtctctctggaagtgtgtttcaaaagtctaagagaacctgagataactatctaaagggcagacactgcatatagaatgagacgaaacgcaagtctggaagcaaagacaagggtactgtttttagaaaagccaaattcaacttcacacattcctgtgccacctctagctacagtcacgttatgtgaacatccttgcaccttaattcccatccctataaactgggaagaataatacctcctaggattacagtgaagctgaagtaagaggctgtatgtagagagccaggtgttggacttccctataaccatagcacctctggaccctacagccagaggagcctgggctatgtagccagcttgggctacgtaactaaactaaatcaacagtacaagtaaagagctttgtgaatgtgtgacatctagtccacgcaccttggagctttaaggagtattctagttacgttgatcaaataaaatctgaatcatgtgtttgaataacaaaagaaacaaagcaccaggcagcccttcccttgcttagcatctgatatgcctgtttaagcagaaagctgttttcttcttttcatatggtaatagctttgatctaggagataagataccttctctgaaagccttatttagtgtgctcagctttaaacttgtgactccccacaggcattcacacaaagggaatagtcccctgggctggtaaatgccgggtataagacacatacctaatccagagacccctagcattgcaagtccagggctcagaccacaggcacgtttccaagggtgaacagatgggactctgcctaaatttatcccacacctcaccaaaattctggggtgtgttcatgtatagttatcagctgtctcccactactttcatttacttccgttccttggaataaacactccatcccaatttgttcctcctaaacctgttgattagtccctccaaagtacacattttaataaatgagtatctcccttctagatttacataacctatcacatttcatattgcacttaattcaattggaaaacagggccagattctccctcattcgcaatacttttgacttgccacctgtaagagaaggctggggccttagcaacacttgtgctctctatcgccacctgctgttagcacaagcctagagtcagcggagaggactagcccagtttaacttgagagaatgtgtagggagtacctcattaagacagagtgtcctccctctcctcctctaccccagactacaggttcaagcaaggaaatgagcaggcaaatgttaaacaaaccacacagagtaattgccttctgaccaatacctttgcgtctgaaaatatcctaagaaaattagagaattcattataaaagaagaaaaaagcaggaaagcaatgaatgtaatttccatagcaaacatccatgcttccttccaacttctaactccctgtgagagggcacactccttaaaacttcatcagaagcaaataggtccaggaaaccaagccacggtccctgagggttttagaaaaatatttattactatttttcaaaaagactctggcatacgccccctgccccgcttttctgggagggagaggggtggaattcatttacatgactgaacctaggacacaccagaaacactgggaagccagttccccaaggatcctaggacaaatctccccgtttccagatgcccttatagggctagagtcatacttcctataatgctgacagcccagtgtatgtgtcgcacatgggttttggctttgagtcacgttccaccagtatgtttccctgagacttttgatttcctctttgagggctggcactgacttcctgcttgctcttataagaaaatgtctacaactgaaaactgaaaatctgcaagattccttccttaagtacacaaacactccaagtctggtcactttgctattgttctgctggattctctctctgtcttatcgctgatcaagtaacctttttagagggggggcaaaaaacattgtacaagactcaagcaaaagagctgagtacatcatctcacccatgcataccgtaagtggccaccttagtgaattcctcatctactgggagggttggttggggtagaatgttctcttgaagtcactaagtaaacccctgtttagaagtcaaaacaacaacttccttctccatacaatttcaaggatttgtttctcccatgctgtcaatcaaaaaggttgggctagggcagagttggctgaagttgtaagaagctgctacgttcgttttactgcccaggtgcacacaaacatttgctgagtcatttataaggatgtaagaagtcaggtcccatggcatgaaccaaggctggtgtgtcagtctttccttctggatttcctggcacttaatgacctgcatcataataaaaacatactttccagtctgtgaatgtcttgaatgtcctctgtcacacacccttctccttctgtcccatcttgtctgtatgatttgtggagaggtagtcttctgtcttcaccctttcaagtgttttgattataaagctccaagctacatttcaaatgcacagaatattctgagattttcatgagttggttgtatatttcaataatctagttcctcttagttaattattaaaaaccatccatttggaactaactatggagttactgagaatttgaggtgtgaattttatagtaaaacctagtattataatgctgacactttttaacagtagtgcaggatgataatatactctaaatggaaggtggaaggggggaaaggcaaagggagaaagggagaggcaagggaaggaagaagagaggtgaaaattaaagttaaaacacaacgcatctgtttcctgagaagttaaaggtggttaatcctcactgagagcaacgaaatcgagacttcttatcttcctgttctgagtgggcgtcggtcgggcttctctctgtgacttcccttagctttatgaatggccgttctaaaaacactgcccaagttactcaattataaaaagcccaaccacttacccctgtgactgagcctgccccctggatacagcaagccattggtggctctcaggtggacttgtggtttcagagactgctccaactctcctggctcccctcatcacattgcaggctagagagctcacctcagagcccacatcccaccccagatgagcctcacccttcccttcccttcccttcctcactcattccacctttctgaccattgctggtagatataattgggagtttaagacttgaaagatttcactgtggcttcccacatagtttggactttaaaaaaaaaaatatcatcaaagaagacagcaaaagtgcaaggccaagttgcctatactacacatgtggctactcacataacttgccatgttctttctttaaataggaagtctcgggcctcttctctttgaggaatgcttggaaagaacattgaataacaatgtcagaaatccttccagcactgcagaggctgctcacacttcaagccactcacacctttcgctgttgacatgtaactgcactgtacagcatgtggctggcttaacaaggtaattgtgtgcagatgatgtggtcagccacttgaagtggctaactcccttaccccctcccaccatcgccccccgccacccctgctaatcatccatggatggattgaaaaagttttaaaactggcccacttaaatgggctgttttcatgttataaatctatagtgtgttgtctccaaaattagtctttgccgatatactcagtttaaacttatagtcagaaacaccaactatgagaggaagccagtgacaaatgatgtagctttagggaaagcatgggatggtcccagaatctttctatgtccaatgagaattggagataaacacacacacacatacacacacacacacacacacacacacacacacacacacacacacgcaaagagagacagagagagagagaaagagagacagacagagagccaataaacaacacaggtcctaaatgaatgcacagtgtataaaattggtccttacagaaactaagtagcagttctaagaaacagagactagcttagatacattgtttacttttaacatcaacacacgagcaggggataaagctgtgctttccttgatttaacctccctccacgagcctgcaagctatttgagtagcaagaggcttcatcactaattgtagacacttggggaagtcagtaaaaatatattatgcactgatgcttagtttatagccggattataactagatacaaccgtctatggttttgctgttatgtaaacaagtgctttacttcaaaacagaacaaaccccaacaacatcgttagattatgggttttaggataagttaaaaaaaaaaaatccaagcctggacctcagtacagccatgtttaaaatatcccaactgaacccctactggcctccttatacctctttcttctcccactatattccctgacacttagcttctgaacacagccatttggtctgaactcataaacttatttttctagaaaagccatgcccagtcattccccttgcctccctggaccctgaagacaagttcttacataaagagtgctgaaaatctccctgggaacctacatccttggctttcatatctttcagccatcaaaatggttatctccagtgaccaaagatcaaatgcctgtatttcagatacaaaagttgcacataggaattctgggaggagaggaggcatttcaaatggctataagcacccttctcctctcagtagaagaacaccaagagactacagccccgtaaagaaaaaaaaaaatccaaaacaaagaaaaatattttttttaatttctaggggcccatggtatttgcctcttgagctatttgagtcttgagaagtttttatgtcagtagccagaactggcaaagagatttttaagaagaaaagatcagagaaataatcgtttatttctaagttatatttcatcaggaggggtgagaagatgatatggagaaagttttacttcttggtgttgtgctggaaacacagcgccttttttttttttcctggcgagctaaagtgtgccagctttttcagacggaggaatgtggagtgtcaaggggtcaggatcaatccggtgtgagttgatgaggcaggaaggtggggaggaatgtgaggaatgtccctgtttgtgtaggactccattcagttctttggcgagccggctcccgggagcgtataaaagccagcgccgcccgcctagtctcacacagctcttctctccaagaagactcagccagatccactccagctccgaccccaggagaccgacctcctccagacggcagcagccccagcccagccgacaaccccagacgccaccgcctggagcgtccagacaccaacctccgcccctgtccgaatccaggctccggccgcgcctctcgtcgcctctgcaccctgctgtgcatcctcctaccgcgtcccgatcatgctcgcctccgtcgcaggtcccatcagcctcgccttggtgctcctcgctctctgcacccgggtaagccccgggactgacggaagggacggagggagggcagagtgagctgcgatcacagactgacctccctccccttcctctccgcagcctgctatgggccaggactgcagcgcgcaatgtcagtgcgcagccgaagcagcgccgcactgccccgccggcgtgagcctggtgctggacggctgcggctgctgccgcgtctgcgccaagcagctgggagaactgtgtacggagcgtgacccctgcgacccacacaagggcctcttctgcgatttcggctcccccgccaaccgcaagatcggagtgtgcactggtaagaccctcagccccattccagccccctttgcagaggcctcaccttttggtgttggaccaccacctctctcaagtccagcgtgataccctctagaaaaagaaaagcccctatccgcagctgcttccaaccggccccctgcagtcctgaccctagctcgtcaccttgacatgtacagtgatatagctagctgttctgatccctgtgaccctacgcctgacctacaactttgtcttcctctcccgcagccaaagatggtgcaccctgtgtcttcggtgggtcggtgtaccgcagcggtgagtccttccaaagcagctgcaaataccaatgcacttgcctggatggggccgtgggctgcgtgcccctgtgcagcatggacgtgcgcctgcccagccctgactgccccttcccgagaagggtcaagctgcctgggaaatgctgcgaggagtgggtgtgtgacgagcccaaggaccgcacagcagttggccctgccctagctggtgagttgtcaccttcaaagttactgttattcattctccccaacttcagggccaatgcccaagtccaccaaattaaggggaaattgtcctatccggatgttttaccttgtgtttgtgtgttctgctctcacagcctaccgactggaagacacatttggcccagacccaactatgatgcgagccaactgcctggtccagaccacagagtggagcgcctgttctaagacctgtgggatgggcatctccacccgagttaccaatgacaataccttctgcagactggagaagcagagccgcctctgcatggtcaggccctgcgaagctgacctggaggaaaacattaaggtacatcctctgcccctagtcactccgttttacagaatgacagggaagagaaccgagctggctgtctcacctcccatgttattagaggcctgttgtctccagaaatatctaaccatggagctgtctggctagaatgagagatgctgtaacaacagctgccagttt

SEQ ID NO: 277 - DNA, 23305 bp, Mus musculus
caaaattaattttattcgagttaagacaaactaacatgtacattcttgtctctctttttttttttttgttaagtaggatgagttctgaacgtcgaaaagaaaagtctagagatgcagcaagatctcggcgaagcaaagagtctgaagttttttatgagcttgctcatcagttgccacttccccacaatgtgagctcacatcttgataaagcttctgttatgaggctcaccatcagttatttacgtgtgagaaaacttctggatgccggtgagttctacaaaaacataatggacctgaaaattagaaattaaaaacatctagaagttccttttagcaggagactacaatactttcttttaagagagtggtgtgtgtatgtgtccatgcacctgtgtgcacatattaatatgctcttatgaaggggcctatggaggccagaagagggtatcagatcccttgaagctagagttacaggtatttatgagccacctgatgtgggtgctggtgtccaaaatgtagtcctgttggttgcgcagcaagcattcttaaatgtggagctatctctctagacccataacgccgctctttaaaaaaaacatgaattaagttattattgcatgtgtatgggtgttttgccttcaacatttgcatgcctagtacttgtagaagccagaagaggattttttttggaaatgaagttacagacagttttcagtgctgggaattgaatccaggtcctcggaaagatcaactagtgctcttaactgcttagccatctttccagtactgccccaacacaatactttttttaaagtattttttaaaagtaattaagtctttccgtattctttactccttttatcaagctttgcttttcttagttgtaggaataatcctttttgtactgtaagttgttttggtttaccctttttttttaatcctttattttttaaacacataaataaaattcattaactttatagcccctggtactttgtttcattctgaagagttctcgattcttccacatgacagcaatttttttcttactagcttttaagcttcatttcatctattcatttcctcctgtctacctgtatctctttgtctctctctctctctctctgtctccctctccctctccttcttcctctcctccttctcctcttcctcctcctccttctcctccccacccccaccccccatagagtctcaccatgtaaccctggctgatctgtaccttgctgtgtaaactaggctgccttgaactcacagagacccatctgctgcttcctccttaggactgggtataaaggcataacctatctttaaaaaatatcacccttttttacacccttggtgatttgcttgtttgcaaatttgtttattttaaacaattatataaaacaactggaaagtatacagaaataaatatatgtattatagaaatttaaaagtatctgagataaagcctgactttgtttcttttcccgtgtgccctgcaggtggtctagacagtgaagatgagatgaaggcacagatggactgtttttatctgaaagccctagatggctttgtgatggtgctaacagatgacggcgacatggtttacatttctgataacgtgaacaaatacatggggttaactcaggtaaagtccccatatatgaagagcactaatgggtactttatggttatatgatatagatctaatttttttaatgtgtttgcagtttgaactaactggacacagtgtgtttgattttactcatccatgtgaccatgaggaaatgagagaaatgcttacacacagaaatggtgagaagaaagtctattgtttgatttaatatgacaggtgattttcagtcagatattgtttctaattttatttttttggtaatgtactgatttaagagagaatgttatttcacatttaatgttaatactgttctttgttaaagctgttattctacattttagaaaactcacaagtttttaaaactcattgaattaataagtagttacatgaattaataagtaattacatacacgagtagaaaaaaaggaaagataattaaaagaccaagacaattataagtagaaatgcagtattaaggcaagaagttataatacaaatgacaggtaataagattttcgatgatgactgaatacacagtgacagtttgggttcaggcttttttaatgtcctaaagaagcaggattggggggtggccaagattttaagagcacaaagatgctttaacttctaaggatgttttcaataacttgagactgtaattggaaggatgatgttgtgttggaccacatgtggttgtacacacctttaatcctagcacttaggaggcagatataggcagatctcttgatttccaggccagcctggtttatgtaactagtttcaagccaggtaaggctacagagtgagaccctgtctcaaaaagagaagtaagagaagggctgaagagatggctcagtggttagggccactgactgttcttcgggaggggggaccccacttcaaattcacatcctcatggcagctcacaatggtctgttactccaagatctgacacactcccatagacatgcaagcaaaattctgcacataaaataaaagtaaatttttttaaaaagttgcaagagagttctgtgaagtacttgttgaattacagagacttaacagttaatttttttaaaatagtaatttataaacagagtatactggtctctctttcttaattccctctgtcaggacctagtctctgttctttgaaagcagtcttattaagtcttgactactttgcattgtattgctattgaccctactgtattatgtattacatgcttaatagcattgcatctaattattgatctctgcatcactctaagtatacacactcggttctaaataatggatattttgtgtttgtttgttttttccctaatacttccattttatataccttaaaatgtatccatttgataaatgtccatgatttttttagatattcatagaaatggcctaaccaccatcatacctctaattttattttttaaaattgtcttgttttattgtatgtttgtttgttttgagacagggtttcactatgtaaccctggctggcttaggactccaagtagaccaagttgttcttgaactcatagagggctacctacctctgcctcccaaatgctgggattagaggcatgtaccattacactcagccattttagaaaatgtcattgcctcaaaaaagaagttctatatctatctaatccactttctctgagcatttcaaataagtaaaacatttgttttgaaccagactaagcaataaaaaaggaaatcaagatgttgtttcagagtcatctaaatgtaatctaattttttagttatgaggtttgacattaagattaaattagacgtgaattgattttcctctgctttatttctgtggcttttttgttgttgttctgggtgtcaaagccaggcctacatgtatgtactaagggagtcctcgtccattgagctacattcccagtccctattcctgtgactttaaattgtaaacaggtctcatatgtagctcaggtcggccatctccatcctcctccttcagcctccctagtgctgagagtattggtatgtaccatcatggctgatttctgtaacttctgatagaacattctgtctggctttcatactcagatgctatttacttacaaaaggtaagttggcatttttaaagttctgtaaacacgttgctgcttattcaaaattgagttatcacagttggtaaaagacatgaagtatttacacaagttcttttgaaggggacatacttgtatactgacagacatttatagggtacacttacaccattttcttattttctttacttggaccaaactcaccagcacagatgaataattaatcctgtgaagtgtggactctcctcccacagtccagggagtcactgccgtcttacacacactctccctggatggagctgtcagacctactgacatgctggagtaggtgaagagggagcaaatcatggttgtgttaatgctgagagccttgctttgatgctctcatcctaacaaatttctatgtttagctgtgacttaaaactcggtttcttgctttcgttaggcccagtgagaaaagggaaagaactaaacacacagcggagcttttttctcagaatgaagtgcaccctaacaagccgggggaggacgatgaacatcaagtcagcaacgtggaaggtacgcaagctgagcgtgcacttgattatagataaataaacctatacacatacatgctagtatcaagagctttcactaggagtgctgaaagtcagctgaccctagcacttgggaagcagaagatcatctgctacagatttgaaggcagccttgtcctcacagcaagttccaggccagccaggggaacacaagccttacctcagaaaacaaaacaaacaaaagagttttgcttagagttatgaggggaatggagaaagtgcttagtaattaagagcacttgcttgccaagtacctggctttggtgctcagcacccatgtgtcagttcactgtcacctgtaactccagttccaggaaatcatccagtatcctctcctgacctcatcaggcaccaggtacacacacagtgcacacacatacatgcagatagagcacttacccacataaaataaaaatcaatttcaaaatagacttacgagggaaaagtataattattcccttttgcatatttgcatttatattcagtatatgtaatctccattaaagacagtataataatctgacagtttgagatatataaacacaaattattggaaatacgatatttcttttttttaaaaaaatatatacatacatttatttatttatttatatgtgagtacactgtagctgtctccaaatgcaccagtagagggcgtcagatctcattacgggtggttgtgagccaccatgtggttgctggaaattgaactcaacgacctttggaagagcagtcggtgctcttacccactgagccatctctccagcccacaatatttctatactaagctaacttatcagttggctttgccaactagtatttaaatcctaatataagtataattttctatctcagtttcctttttttgttcagtgttgaaccatagtcaccagagcaaaatcaactataatgaccagattagtgaagaaggaaagatagtctagacttaatacaagacttaaatatttttcattgtgtgtgtgtgtgtgtgtgtgtgtgcacgtgtgtgttttagtgttttagttggttgcatgtaagcataccatgtgtttacagaggccaaaagaaggcatttgatccatattctggattataagtgatccctagtttctattttatgtgcatgaatgttttgcctccatgtatatcagggcatgcatgcctggtgcctgaagaaatgagaaggtgtcagatcctctggaaatagggttacaaatggttgtaagctgccttgtgagtgctaggaatcagatctaggtcctctgggaaaagcagtcagtaagcttaaccactgtctcatctctagcaccctaccttcacaatgttgtggggttgttttgttttgttttgttttgttttagaatacctcattatctcataatgtcttaactgctatgccatctttccagctccccttacctctttctattttaaaaaggtaactttattttcttactcatattcaggtgcttcactgcacgggccatattcatgtctatgataccaacagtaaccaacctcagtgtgggtacaagaaaccacccatgacgtgcttggtgctgatttgtgaacccattcctcatccgtcaaatattgaaattcctttagatagcaagacatttctcagtcgacacagcctcgatatgaaattttcttactgtgatgaaaggtaaatgaactattttatatttttaaaatttagattttttgtagccttttcatatcactataataaaaacttaattgatatgtccatgaagctaaatatgaagatgcatcctagaacccaaaaatgtaagattagcttttatactataaatactgtatttagctattatacaaaatctattaagatgaaattcttgactacatctagtggcatcctcctgtaatcttagctatgaggagactgagacaggaggagggtaatttccaagtcagaggtggatcacttgtcctacatgcaaaaggcactgacttcttgctgtggtactgcaagcagtgaacacaaaagtcatgaagttcttttgtttgagggaattttgcttaaattcagaaagtaagttttaaagataaatagtttatgtagagtaggcaacagttttggtctgtaacccacatgttcttcttgagcatcatcaactccacccttggttcctgtcaccatttccctaatctgttactacttgtgtgtaattgtcaacttgatgtttctgcctacaccattttcttaataatgaaataaatactcctgttactaaactactctactgctcccagacagcctaagttactgcacctcttgtgatccctaatgttgttgacacagcactgttgaaacctgactgtaactttactacatactacacttagtagtagtttgtagtaaatattataaatgtactgtcagctgggcgtggtggcgcacgcctttaatctcagcactcgggaggcagaggcaggtggatttctgagttcgaggccggtatggtctacaaagtgagttccaggacattcagggctacacagagaaaccctgtctcgaaaaaccaaaatataaaataaaataaatgcactgtctctcccatcgttctatctaccttgtgctcctgtcattaaattctttatttcattccctttggcctgaattgttaccataaactcctaagctgcatttctaccaacggatttgtacctttttacttgtacgtccactgtatccaaagggggcttcccaaggtgaggatcagattgtgcccttctcttagaaatacatcagttgcttcttgtagtactgtaagtgggaagatttatttgtcaaaagatagctgtacattctgggtgtggtgttgtatgtcagtgatcttaacacttgggaattgagacaaagctgacctaaaactacatatgaatgcctgcctgtctgtctcaaataaataaaatttaaaataggtatatattttaaaagctgaaagtaaaacagacttgtgcagttaaatctaaatgtattaaaatgtcaaggaaaggtatttacagtctagtcccttctcagttcaccaaattaatcaggagttgggagaatcaccgatctggatatggttccagccactcattacaaagagtttcatgttcttttttaatgtcttgtgcctttgcacacactgtaaaaggatgcctaagagcatcttaggcaacatcccttgcacatgcttctgtcagtgtttattctgctgctgtcttactggtccttttttctgcaagcagtatagcctgttattagaggcagatgttctgtagccaactgaaattctgacactggcacctagataacgatgagcacatcagtccttttatggtatcactttcctgtttgtttatttggttagtttttggttttttaagacagagtctacacagccctgggtgttctgaaacttaccctgtagaccaagatggcctccagctcacagagatccatccacctgtctataccaagagctgatgtctaaacttctaatatcaagactatccgcaaatagctgtttattgtacttagtaatgtaagatataatcatttggcacatatattttgagtatttactgtgttcatagaaatgatgattcttccccttaagatgtggacaaatgccatactatatagttgctttagaacacaagttttctaatctaataagaacaacctttgtaagaattggagaagcgactggtacagtgctcacagagtgtgcaaggcctggggatcagtactcagcatggaaacaactcattttctgggtctcttaccctcttttggtactgactttctatgtagttctctaaactttagtctgtttcctcttgcttcccccaacatacatgaaatcagtctgccaggaaactgtctggtatttctatcttgatttctcaatgtcctttaatagtcaacattcctcagtttgagaaatactggttgatatgtggttgagtcaaaacgtcctgagtctcagtatacaaaatcttcatttatctgatcctcttgcctgcatctcttgaattctttctctccacttgcctgtactagtcaggtttggtagcaggtgcctttacctgctggccctagatattagaaatgtcatgtaagattttcataattaggcagttttttccatatcttcattctgaggggttatggatgcaagaagttcctagaaagaaagagaaaaaattgaaccagaaagtctagcatgcagaagaccctaggatccatcactcagtaccagcacaagggggagggggtagggagggattttctttagtatttttgagtccctagattctgcccctattaccattcttgaatagaggggaaaacaaatatttttaaagcagtttcttttcatttgtagtgctgccgtctatgttaatgtgtcttggtccctttgtgaagaagtgctagtttatgttttaaaaaatctgttttgttggttttagagtaaatagcagatcttaaactgggacaaaacaaactatattatttaacaaactgtatgagcataccttgcttatgcctattctctgattaggtgttttctgttttgcttatattttggataaaagatgtaagtatcttttaccagcacctcagtttaaaaaagaaaaaaaaagtcccttgaattctaagcctagcagtctcacccttgcttcatgtttgttcccagaaaggctttagaggaaaacagttgcagttggcgtagtatatcaagcacagctttgccttcctcataaagtgtgtcttcatggcttcctgcaggctcatgcagaatcagcttgagtgccctccctaaaggaactgccagggaccagacaggctatggaattagattccagcccatactcgattagatgctgttctttcatctgaaataaattctcataaaattaatattaaagccaagtaaaaatatttatcctctaaaaaatgacaaaggttattcctttactttctacttagtatgaatatccttggcttaatgatagtggagcttttaaagtgaggccttgccaatgggcctaaaaattgtaaggtaaacaatttagctctatgaaaaatactgctagcaatttaaactgtatttgtgactgtctttggaacttttgtcatttcatttagcattatcaatatttaataatatcctgcgttaatagtaacagtatgtataataaaatattttttaaagataggtcattattttgagttgaaaggataagaatcaaggatgaatctaaatgacacagaaagtctggctattatactaaatatagaattgttaagggtgaattttaaatttattaagtgaggaataatgttttgttttgtaacagaattactgagttgatgggttatgagccggaagaacttttgggccgctcaatttatgaatattatcatgctttggattctgatcatctgaccaaaactcaccatgatagtaagtacaatagaagaactcaaggagggggctggagagatggctcagtggttaagagcactgactgctcttccagaggttctgagttcaaatcccagcaaccacatggtggcttacaaccatccatagtggagatctgacaccctcttctggtgtgtctgaagatagctacagtgtactcacatacataattaaaataaataaataaaactttttttaaaaattaaatttaaaaataaaaaaagaactcaagaagatagtctcactgcttaagtcctgcagtctctactgttctatctaactttctaaaattgccacccagtctccagactcttcataagacaaattgatcatgaaattactgttatgttacagctgttcacttaataatacataaaacttccctagaattttaaatacagaagtaaataaaagtcaaatattatagattatctccatacacatgtcatgaaatcaatggttggtcaatagaaggtagtcagagcatttgttccatgaatcagtgagtgaatgggatgagtattacacacatgtaatatctgacactcttgacatatgatgaagtctgagatctcaaagtaagctaaagttcatagtttctcacttgcttgtttaatctggacctaaaaatgacttccaaatatgatctgagggtattgaatatcactgtattagtatgagttgcccaaattatagtcagagcatggatactcacaatagcatcgtctttactgatttacagcattctcctcaatcagtaaatgatttagacttcatgaactgctggaaggctacagtatgatatccacttacagtcaaagttctgtagagtggtttggttgtatcattttcttgaatgtgtcctgtgcttagtctctagtctgacagtgtgaccatacctcattgaaggaactgcagctaccctgttcctcatttctggctttcattcttttacagtaagataggggttttattttggggtttatattcaggtgggtttgggcttctctatcagcttaaactgtcacaactattttaaataataaaagattatttaaatctttcctttttaaaaacaaaacagtgatccagccaggcatggtagcacataccagtacccctacctaccccgacacccccagcactccaaagacagaagcaggtgggtctctgagtttgaggccagcctggtctacatagggagttcagaacagccagggctacacagaaagaccttgtctttaaacaaaaaaacaaaatgtaacaatctacatttgacacttacttgattgaaaattcagctacattttctttgtggtgctttcttatccccagtgtttactaaaggacaagtcaccacaggacagtacaggatgcttgccaaaagaggtggatatgtctgggttgaaactcaagcaactgtcatatataatacgaagaactcccagccacagtgcattgtgtgtgtgaattatgttgtaaggtaagcttgggaggagacacttttgtgaggaaaagtggtaactctttggatttactgtgcctttattaagaagagataaaattacctagcaggggtagcgcacacctttaatcgcagcacttgggaggaggaggcagagacaggtagatctccatgagttcaaagccatcttggccaacagaataagtttcaggatagccagagctacacagaggaaccctgtcttgaaaagaaaaataaataaataaaaactgagttttgcttttacctttctttttctactggattatgatttataccccaacctaccttctgaagccaactgtgtcattgatcccacaaaataatatcatttatttatcagtctgtggatcaattttcctagttcagtttcttgaggccaaaaagattctaatgaagtttaaatgaccgcctttgtgacaggctgtgtcatatgacccgggactttattttatgtttatgaactctataagttattttagttcagttcctcttcattaccgaaacattctaatctgcttgccaggcagagctctctactgtggttagctcattttcttatgttccatgctctttaccctgcctcactggataggctttgctggcctggaactcactgtagatcagtccagccttgaattcacagcctacctactgtgtgggattgcagggctgcccagaagtctccagcacaactttcatagatgccaccaaacccaggttaccctactttggccatttttggggtcttaaaacttttagtttttgttgtttctttcagggggaaatttttagtgctaggatcaaacttaatgccttaccacttctaattgcaaagaatcctcttaatgccaaagagttcttttgtgatttttgcctttctataaaactatttttcttgttttcctcatgattgttacttgatcccaagttttgctcattagcctttctctgaaacatcctttcttcattttatcagtgatcatagtatattgaaattgtttgcttatctatttcacactgaattataaactacttgaagacaagagtttatgcttttgtctttgtactcttagtgcatttcatttattgaatatgtaatatgttatctagagtaccttgatgccagacatgatgctgagtggtttttcatcatttctctttcttcttccctatcctataaatgacatcactatattatttccaccaagaaaatatgatacccctcataaagactgtggccattattgtatctaagattacccatagaccatgccttgcgtattaatgctgaacagttattttgtgcctatttcattgtagcatcagcacagaagtccttcctgcttatgtccttcatgcactttaactgcacatgttcttgtcaccgcctctcttctcaatgttgtttcaatttaaataagttgaatagttagtaaattttgtttacatttttatcttcatattggtgttttaaaacaataaatatttctcaatagtacaacacttgcttagggctcaatcctcagcactgggggcgtgggggagaaatgttgcaagtatacatgaaagattattcatctcaggggtgttaaaatgcttttactatataaatcatattttaagagacacggtcattccatagtccccctactgtcattgtttctagtgctcgtttataaatactaatctctccttttttgacagtggtattattcagcacgacttgattttctcccttcaacaaacagaatctgtgctcaaaccagttgaatcttcagatatgaagatgactcagctgttcaccaaagttgaatcagaggatacaagctgcctttttgataagcttaagaaggagcctgatgctctcactctgctggctccagctgccggcgacaccatcatctctctggattttggcagcgatggtcagtgcttagttactctgtccaccactccagtccctgctcagctgctccatgcctccgcagcctcagctcttggctcatccattcacgtgatgctcacatgttttgtttttaatagtctcctcaaaagtattgtgtctaatatttgtttctgaaatatcacagccttcctgcttttatttttatgttttttttgggaattgtagctcagagtatcctgaaggtatttcttgatgccgtgttaatttcctctcagccacctcactgcaccattcagtagagttaaattgcagtacatgtagttgggtaaatgttaaaggcattgtacaaagcaactgtaccatcaaagcaaacatgaaaaatgaaaattgttacttcaaattaagatatatataaaaaggttgaaggtatatgtattactcctatcagtggtggactataacagataacttacacttacttagtggtcattgtataatatctataaactttcaagtaaagaaactgattgaatcacaactcttctaaaaatcagaaaatcatctatgaatgttaaaatcctgatgtcctcttgattgacaaacgctttcctctgcagacacagaaactgaagatcaacaacttgaagatgttccattatataatgatgtaatgtttccctcttctaatgaaaaattaaatataaacctggcaatgtctcctttaccttcatcggaaactccaaagccacttcgaagtagtgctgatcctgcactgaatcaagaggttgcattaaaattagaatcaagtccagagtcactgggactttcttttaccatgccccagattcaagatcagccagcaagtccttctgatggaagcactagacaaagttcacctgaggttggtaccatgatctaagaaaaggttaggaataaatgcctgaaattgatagaactcaaaactcatcatatctaggttggaccagggcagaaagtgtcaaaaacgctgtttccaaatacagagcaattccatctctgaactttctactattaagactgtacttaggagcagaacagcttagatcttaagttagtgaagcacaaataagtattgattctccattaaactgttagggattaaagctgccaagtgtaagttaaacagtatggaatctcaaaaccaaggttgagaatgtattcttttctctgatgctttgcccagcacaaaagtgtgtgattcattttgtcactgattttataaagtaaatgtagtgaaaaatgaagaaaagtaaagttttatgctcagtctagctaccatattcattactgaaattcttgaactcctagcacaatagagtatcctctaaaatatccagtagaataggcattttaagattatggtgaaaatatcatctaattaattggatgattatgtaccattgtgggatctgaattgtttggtgccgggcatggtggcgcacgcctttaatcccagcactcgggaggcagaggcaggcggatttctgtgttcgaggccagcctggtctacagagtgagttccaggacagccagggctacacagagaaaccctatctccaaaaaaacaaaacaaaacaaaaaagttagaactgaattgtttggtgaatgttattatgtagaataaaaaaatctggggtgagggtagacaacatttgtggctggtcttattttggttctattttattttattttatttttgagacagggttttgctatgtcacccttttaggcctggcactcactctgcagaccaggctggcctcaaacttagagagattctaatgcctgtgcttcttgagcgagtgctgggattagagatgtgcaccaccacatcaactaaacacattttttcattgtaatttttagttagctaaaactctatgtaatatttgtgtgtctgaaacttcttaacaaacagagacttcttcaggaaaacgtaaacactcctaacttttcccagcctaacagtcccagtgaatattgctttgatgtggatagcgatatggtcaatgtattcaagttggaactggtggaaaaactgtttgctgaagacacagaggcaaagaatccattttcaactcaggtatgcttattaccttgcttgttttgtactttaagtgactgggtttaacttgttattccttttacaagactggtcattataaagcctcttgtatttattgtttgaaaggacactgatttagatttggagatgctggctccctatatcccaatggatgatgatttccagttacgttcctttgatcagttgtcaccattagagagcaattctccaagccctccaagtatgagcacagttactgggttccagcagacccagttacagaaacctaccatcactgccactgccaccacaactgccaccactgatgaatcaaaaacagagacgaaggacaataaagaagatattaaaatactgattgcatctccatcttctacccaagtacctcaagaaacgaccactgctaaggcatcagcatacagtggcactcacagtcggacagcctcaccagacagagcaggaaagagagtcatagaacagacagacaaagctcatccaaggagccttaacctgtctgccactttgaatcaaaggtatttgtatggaacataattctgcatgttctagtatatatgcaatgttaaatgatttctaaacatagagccaactttctgacatacgctttaaggaacatcgtaaagttcatttcatgcattgtctgaattaaaacaaacactcaaaagccagtttctaagttacggtctaacttctctctctcaaacaatcctatcaactgtctaaatataggaggtcagagatgttttccaacatctgtctgtcatttataaattgaatctctaaaaataaagtccagccagtaagttctataaatgccaggaatctcttcatgctgctgttaagaatgggaaatagctgtcttccctgcttagatctttctaacctgggacttttgtaaattaacctgaagaaaaacccttcagccacatggttctttttcatcccagattgcagctggtgatcttgagttctcattggtaaatatggatatttgtaggccttctttctgaaatcttgtgtataattgtaagaagaaaaagaaagcttttattagatctaccaagagtcctaacgtgacttgcagtattgttttgatagaatgaagcaatgcttgagcaaatatttagaatttctgtatataatatgtaatagtatttgacatgttttaaagcaaggaaaatccttttcactaattggtgagtagaagaaaaaggactccttttgtattatatctagacagagcaagctgtggctgatagcagaaggaaggactgcagggagccatgttcccctatcctacttgaagcactgggacaggcctgcctttttcttgagtcaaaaaaaaaaaaaaaggagtagggctttagatgaatttagtattttcagttggatatagtaatatattcctttagtcttggctctcaggcagctaagtcaggagaattacaagcttaaaaccaagactcggtgtagtggtgtgcacacacacaaaataaatagatgtacaaccagaggtgatacttacatgataaactgacatatttcgtgaacataacatgcttgtataaaaatttaaaaccagcttgtctatacactgcatggcttgtaagccacattcacagaggagttaatcatgtatgactgtgactcagccatttacctggctttctattgaaagaccaacacaaacagcaaacttagtgacttcagaaagtggttccttgttgcatgctattaatttcagatacagcagttagacatattgatcagtactgaggtcaaagtagcagattacaaaggtcactgaggagacaagaatgtgaaggctgggcttgtatttccatagctaaaatgaattaacattgggacttagaacaaactaccaaactgccatcgatttctcatttataaagtggttacagagtacctgtcatatcatccctgagtggtaaagtgaggttaaaatgaacataaatcttgtttggttgttgttcctgtttttgaggcaaggtctcactatgtagtcaaagctagctttaaaattaaaatatagccaggctggattcaaacagggattataggtgtgtctagctgaaacatttataagttgaaaatactatacagaaatgaatcatcttgtatttcagtagtccccaaaatataagtccactgaacaacagtggttttatatatttttttcttttccagaaatactgttcctgaggaagaattaaacccaaagacaatagcttcgcagaatgctcagaggaagcgaaaaatggaacatgatggctccctttttcaagcagcaggaattgtaagtatcagtggtgcattgtattccaaatgaatactaaaaataaagctctactttcaaagctatcattgggcttcttttttaacttacatttaatgactaaattctggtgttagaaaccaaacatgacagacaaatgtagaggaaataccctcagtgtccctccactctcattcgtttctctgtgagttctttttcctccttatagaggcactggggctggagacatgggtcagcaggcaagagtgctgattgctcttctgaagactctaggttcaaatcccagttcgcaaaatgtggatcacagccctctctctgtaatgccagttgcagcaaatctaatatgttcttctggcctctgctggcatacatgcaggcaaaattacccatatacataaaaataaatctaaagtatttttaaaagaagcactgtgttttagagatagttgaggctagcctattgccagaacagagtgagtggaaagtattataaaacatattaacaatgtcttaatatgttttatggataggattgttaatgggtaagaaataacctttgtcattgctattataagaataaatgaaagattatttaagagaaaaaatttttagaggattgtttaagaaactggctttttggttgctattaaatatatactgattacaaagttttttattgtaaagaaaatgcaacatactaaatattaacttcattctttttagggaacattattgcagcaaccaggtgactgtgcacctactatgtcactttcctggaaacgagtgaaaggattcatatctagtgaacagaatggaacggagcaaaagactattattttaataccctccggttagtgtattctttctgctcttagccaacacaaagaaaagtttgaatataaaaaaattttttttcgagtttttctccaagggacagtggttttggttccttagaacgattaagaagtgaagtggtggatgagcctttagtgcctttagtcccagcactcgggagccagaggcaggtggatctctgagtttgaggccagctggtctacaaagtgagatccagaccaacaaggactacaaatacatagtaaaacgctgcctcaaagagaaataaaggaaaggagatgtgcggtgcattttgtctgctgcctgcattcagggattaggcatttcagagcacactttgtgttaacattctgacagcagacataaacttgattacacttacttatttacatagcttagggtttgcccaggggactaaagcccttctagaaaatttattttacccagtacctactgcataataagtgtttaatcaatttaatgatactaggcatctccttgtttttcagatttagcatgcagactgctggggcagtcaatggatgagagtggattaccacagctgaccagttacgattgtgaagttaatgctcccatacaaggcagcagaaacctactgcagggtgaagaattactcagagctttggatcaagttaactgagcgtttcctaatctcattccttttgattgttaatgtttttgttcagttgttgttgtttgttgggtttttgtttctgttggttatttttggacactggtggctcagcagtctatttatattttctatatctaattttagaagcctggctacaatactgcacaaactcagatagtttagttttcatcccctttctacttaattttcattaatgctctttttaatatgttcttttaatgccagatcacagcacattcacagctcctcagcatttcaccattgcattgctgtagtgtcatttaaaatgcacctttttatttatttatttttggtgagggagtttgtcccttattgaattatttttaatgaaatgccaatataattttttaagaaagcagtaaattctcatcatgatcataggcagttgaaaactttttactcatttttttcatgttttacatgaaaataatgctttgtcagcagtacatggtagccacaattgcacaatatattttctttaaaaaaccagcagttactcatgcaatatattctgcatttataaaactagtttttaagaaattttttttggcctatggaattgttaagcctggatcatgaagctgttgatcttataatgattcttaaactgtatggtttctttatatgggtaaagccatttacatgatataaagaaatatgcttatatctggaaggtatgtggcatttatttggataaaattctcaattcagagaagttatctggtgtttcttgactttaccaactcaaaacagtccctctgtagttgtggaagcttatgctaatattgtgtaattgattatgaaacataaatgttctgcccaccctgttggtataaagacattttgagcatactgtaaacaaacaaacaaaaaatcatgctttgttagtaaaattgcctagtatgttgatttgttgaaaatatgatgtttggttttatgcactttgtcgctattaacatccttttttcatatagatttcaataagtgagtaattttagaagcattattttaggaatatagagttgtcatagtaaacatcttgttttttctatgtatactgtataaatttttcgttcccttgctctttgtggttgggtctaacactaactgtactgttttgttatatcaaataaacatcttctgtggaccaggccccctgggtcagcgcttacgtttaaataacatttgtctcaacatttctagctcataaaacgatttctcaaaaatttaagttctttataaaaattagattgtacatttctacattcattttattgccattttctaatgtatgatgtgtccctaaatgtcatgttaaataatgacatcataatattgcattgtaaagagaatttttttttagaattttgccattataaatgtatgagtctattaaaatataaagtacaaaccttcagtatttgcagtatgaatggagtaagtgaaacagttcatgaaacatgatcatactgttttgagggctcaggctcctgcgtgcatgtctaatctgttcccattagcaggtgaaggaagctagggctgaaacaagagttttccgcgctctcagggagctatgtggcatgtcagaatcttaggtctcagaacataccttgtttggttttgatattggtttggtttgattctggtacatggcacattaatatgcagatacattatatagataatcatatattacctgatgtttctttactttgccagctttaaaaaagtatcttatgcaattgtgaattttagaaacttccaaataaacaccacaaaccttccagcttatatgcatatctttctagttcatgtatcactttgttttagtattttaaaaactttgtttttagatacttgattctttttctctgtttttctagtaatatatctgttctgctttcatagtctaagtttaaaaaaatcagtctagaaagatataaaggtaaaatgtggaatttgggtgtgcacttaggaagcagagctagggtaatcaggaattccagcccagctttggcgacaaagtgggtccaggccgctgggggctgcatgcgtgttttgtgtaaaagaagagatggagaaggaggttagtgtgtccctacacctagagataacagtcttttagaacccattggtgtgacaatgaggatcaaacccaggcttcacatggatacgaggcaagcatgccatcactgtgccaaactccagcccagaaacctatctttactccttacataaccagtgagagcctagtcctggggttaaatcctaggccaagtgagtttaacttagggagctgttcttaatcttaggatgaaccagtgattggttacaaatatgtagcaatttggaacagtgtagtaatattaattcaaagtacaccatgagccaacgtgcatccacatttaagtatagacagctctagaggtgacattttaaagtggctgtataatattcacagttcacaaaatttaaaaattatgtttaacaaattagctttagttgaaaacttgaagtttatgtacagtttccaaatatttgtaaatctgttatatgtatagaagtgacttatgagcagtggttcagaagggaacttttagggaagaaaagaaagaagttgcctggattccaggcagtcagccactccttcctagtacactagactccacatacagtcagctgctccttcctagtgttgcccaccatgttgagtttctctgcagtgcttttatatatagccctgctctggtaccacaagtactactctccggcaagtatatctatgccgccctgttctctggtgctgctatgactgcgtgactagtaattactctcccttgaccaaagtatggcaaaaggaattaacatattttgtttgttctgtgtcactggcatagaactgaaaatgacgacccattaccaatggctggctcttgctgaagtgctttacaaagtctgaagctaaatgacatggatgtctgaattctacatgccagacttaatgctagctagcattttgcatgttaggctaattcataatctctctatcactttatacattctagattctggccatcagtgactttagagccctaaccatcagtccacagaacatactggtttccccattgccgactgtttaaagagcacagaggactacacaatgagagcagaaaatggagggccgggtgtcacttaagagtgaggtgacacatgtggaagaggagtggcaagatacaaataagagtgtttttaagctatttaatgggctttgagtttgaactaaaactttacttctctgaatatagagacattgaagtgactggaggtgtaaggtatgacaaagcatttgacatataagaggcttacataaagatgcgtgcagctttctcagagctgttggaattaacagcataacagacacggttaaactttaggattaccattccgaatcttacttcctcctctaagcctcggtaagaggtgtgaaaagtccaaagttctaaggcaagaatgtcaagcaaagagttggggaaaagaaaaatgaggggcaggtgggggattctctttctttaaagtttaattcaataaaaccttaagcatgttgctagctgggatttaaaaaaacaaaaaagtaagaacaaacaaacaaaaactgttatggtgtttcaagtctgcccaccttgagcttatttctttcctttaacgtagctttgaacctgttgtccaggatcgtttgcgagttagagcaatctgtagcatatgatcctacattgtctctggtcagataaaagcgacatttcaccacacccgttcctctgaacgcctcctggagctttgtgttcacacccttcagccgtttgggaatatttttttatgcttacctgtcatgagtggatttgatccaaggcgctgctcagacacccgatctccgcttactatgtaatttcctttattcggtcttggccgcattccggaacgcagagaaaggcaggtgcctgagagcggtagagcgagcctgaccgtctctggcccgcggacaaccc

SEQ ID NO: 278 - DNA, 51620 bp, Mus musculus
ggaagtaaaaatatgatttttgatattctctttatggtcccgaacatattattattcagaatattaagaataaatatactgaaaatttttcacaagagaaggtgcattcattcttgcacacacatcattatccattttaaaagttcttgaacattttatagaatttcttgaatttagatatttttagttttaatattatcacactttaccttaagtataattgttcatgatccaaatactttaccctaatggaagaaaattctgtaaaatttcacttcatgtaactactaaatccagagtcaaaactaaatacagaagaatgccagaaaattaatcacttaaacagaagttcctctagtttaactttatacacgagatgcaaacaaccactctaagatagcatagtgggcatttttcaggctcttagctggaagcatatactaatgtcatacaagcatgggcctgatccccatgaaagcagaggcagctgattgaaaagcagttagaaatgaacatgaacatctgaacaagagctataagcatttatagtaataagattatcacaaacatttaaacacttctttctgactttgagacatgggttattaaagttataagaattaacaaaccattgtccccagtcttgactaagatcagagcccatagacttccaaagacttcagtttaagctgcataagcagattctaaggcagagtgcctgtgatcacactcatcattgaaaaatacactacatggttgcctgcttgtttatatggtcattttctgtttcctgctcctcagtgcaggctttatggcaaaccttaacctgtcttctcagtgctacagagagaccacacatgatacaaatcaacatttcagaaagtgtttgtaaaacactacagtagggactaggatgatggctcggtcagaaaagtgcttgtcagttgagcatgcatttagagttcaaaattccagcatccacataaagaagctgcatatggaagctgttaccagttgtctcaacactgggcaggcagggtctgctgcatccttagatttctctggctaatgaggctagctgaattagggagaaagacactcaacattaaactcatgctgacatatacatgtgcatctatgagggccatttatacttgaacattcattcacacatatacacacaaaacatgcaagcacattcataaacagcaaaataaaattaatcaagttgtacttagtagcttgagctatttgcccttccacctttctggtcttgataagacttaacatttattttagttaaaatgtggacactatatataataaatataaacagaaaacaataaaagcccatgtttcctacagaacttattatttagagccattattagtcatgttagtgataaatcttcatttttctttggaaatatggccaggagtagatttcttgtgtctgctggataactcacacctatgcacatatgaacatcactaagtggactcagtgggttaaataaataaacaaacaaataaatataacaagggcgttaatttggtattgatatgtattaggaggggtcttggaggtatgaagagatagaggaagatggatatcaagatatattgcacgtgtatgaaatttcaaaataataaaaactatcatttttaataaaaaagtttcttgaatatttccttaaccccaccattcttttttcttgtttcttgcaacttgtctaattcaccaaacagtacagtaatggatatgcggtaaaaagttaagttgagtcctgctttacagagcataatactgaaattctcccacagtggctggagtcctctgtgctggtgcattatgctctatgtttgtttagataagaataactgtgtagatttcctctagtttttttctttttttttatctctattatcagtattctctttgtttgaaacatcattattctcctatcccccgttttctcccctctagaaaattcaaaggcacttgattagtagcatacttttattaaggaagccttttctagtgtaataaatacagactagtataactctcaattgttaatctacatccttctgtttagagcctgtctgggcagctttgtggatcaatattatagttctagttgcagtcttgattgggtagtaaaatcaactactgcaagatgtcaaaaattaaaggaatgtaaacagggtgataaaggagttgattcttgatcttaggtattctgagtagtctcagggtcattttgatttgcattttactgatgactaaggatggtgaacaattttttaggtgcctcttgaccatttgagattcctcagttgaggattctttgtttagttctgtatcccattttaaaataggattatttatttctctggtgtctaacttcttgagttctttgtttatattggatattagtcctttatcatatatagtgttggtacaaatctttttttccaatctgtaggttgccattttgtcctgttgacagtgtcctttgtcttacagaagcttttcaattatatgagtgtgcccttccccctagccttgagcaggctggctcagacctggcttgccacagccagctggtattgtcctgtcacatttgtggctttcctccaagatagcactacctgctgagaaactgaacctgttttcctgacactatcttgacaaacaacaagatcctggcgtggtgggtgatgggtcacccctccctcctttataaactcagactcataagtaaacatcagccttgattagaaagttttgtcttggcttattatttctctagctgccttttccatgcaaaccccatctttcctttcaggaattcagtaacccatggcctctggttctttctgctttaagactatgcaacaagtggtctgaaagcagaaagaaggactggggatacactgttttggtggggcttcacagaaaacagaagaaaatgtatccttgcatggtaagcaacacacagtattagtgttagggcaacaaatttcatcttttgaagactgttgatcacaaggatgcaaaaaggatgcaggctagactgagtcagtgtcagcccaactctgatatcagctataggttgacagttgaaaatgggatttgaaaattctaaacaggcttttgtccgcaatcaagaagtgtatgaggtgggaggagtagggcttaaaataataaaataaaatgaaataaaatgagtaaaataaaaaaaaaaagaagggggatgctagatatacaaatgacatgagaaagaaagaacaagagagaaggaaaatggatgttggcgctctccctgggacagaaggaaatctggagacatcctgctttctctctggcccctccaggaaacattcttagttctggttacgtcaaattctttaccctctctgtattgtctgtgtttggtgcaccaatctgtccacatatgagttcatgtctgtttttgtttcgatgtctgaatgactattgttcaatgattcatgttgaaagaaaaaatggttaaacatttatctgctgactatccatctcttgattcagtctcaagtttcatagcagaggctgattaaagttgcctcatacccttagccaggagtcaagcacagcaagagaggccctgctaaaaagctacttttaaaaggagtctgcagctccttggtcctaaggcaagtaagctgatagttgggttttttcacgagaaaattctctgcaattgtgattattgggttcagcaaatgacaaagtgctttttattttgaaattatagctagaaaaggtaaaaacttttttttttcttttccattttttattatgtatttagctcatttacatttccaatgctataccaaaagtcccacatagccacccacccccactcccctacccacccactccccctttttggccctggcgttcccctgtactggggcatataaagtttgcgtgtccaatgggcctctctttccagtgatggccgactaggccatcttttgatacatatgcagctaaagacaagagctccggggtactggttagttcataatgttgttccacctatagggttgcagatccctttagctccttgggaactttctctagctcctccattgggagccctgtgatccatccattagctgactgtgagcattcacttctgtgtttgctaggccccggcatagtctcacaagagacagctacatctgggtcctttctataaaatcttgctagtgtatgcaatggtgtcagcgtttggatgctgattatggggtggatccctggatatggcagtctctacatggtccatcctttcatctcagctccaaactttgtctctgtaactccttccaagggtgttttgttcccaattctaaggaggggcatagtgtccacacttcagtcttcatttttcttgagtttcatgtgtttaggaaattgtatcttatatcttgggtatcctaggttttgggctattatccacttatcagtgaatacatattgtgtgagttcctttgtgaatgtgttacctcactcaggatgatgccctccaggtccatctatttgtctaggaatttcataaattcattctttttaatagctgagtagtactccattgtgtagatgtaccacattttctgtatccattcctctgttgaggggcatctgggttctttccagcttctggctattataaataaggctgctatgaacatagtggagcatgtgtccttcttaccagttggggcatcttctggatatatgcccaggagaggtattgctgaattctccggtagtactatgtccaattttctgaggaaccacaagactgatttccagagtggttgtacaagcctgcaatcccaccaacaatggagaagtgttcctctttctccacatccacgccagcatctgctgtcacctgaatttttgatcttagccattctgactggtgtgaggtggaatctcagggttgttttgatttgcatttccctgatgattaaggatgttgaacattttttcaggtgtttctctgccattcggtattcctcaggtgagaattctttgttcagttctgagccccattttttaatggggttttttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcaattctcgatcttacagtacaagccattgctgttctattcaggaatttttcccctgtgcccatatcttcaaggcttttccccactttctcctctataagtttcagtgtctctggttttatgtgaagttccttgatccactaagatttgaccttagtacaaggagataagtatggatcgattcagattcttctacatgataacaaccagttgtgccagcaccaattgttgaaaacgctgtctttcttccactggatggttttagctcccttgtcgaagatcaagtgaccataggtgtgtgggttcatttctgggtcttcaattctattccattggtctacttgtctgtctctataccagtaccatgcagtttttatcacaattgctctgtagtaaagctttaggtcaggcatggtgattccaccagaggttcttttatccttgagaagagtttttgctatcttaggttttttgttattccagatgaatttgcagattgctctttctaatttgttgaagaattgagttggaattttgatggggattgcattgaatctgtagattgcttttggcatgatagccatttttacaatgttgatcctgccaatccatgagcatgggagatctttccatcttctgagaccttcttcaatttctttcttcagagacttgaagtttttatcatacagatctttcacttccttaagtcaaaccaagatattttatattatttgtgactattgagaaggatgttgtttccctaatttctttctcagcctgtatattctttgtgtagagaaaggccatttacttgtttgagttaattttatatccagctacttcaccgaagctgtttatcaggtttaggagttctctggtggaatttttagggtcactcatatatactatcatatcatctgcaaaaagtgatattttgacttcctcttttccaatttgtatccccttgatctccttttgttgtagaattgctctggctaatatttcaagtactatgttgaaaaggtagggagaaagtgggcagccttgtctagttcctgattttagtgggattgcttccagcttctctccatttactttgatgttggctactggtttgctgtagattgcttttatcatgtttaggtatgggccttgaattcctgatctttccaagacttttatcatgaatgggtgttggatcttgtcaaatgtttttttctgcgtctaacgagatgatcatgtggtttttgttttgagtttgtttatatactggattacattgatggattttcgtatattaaaccatccctgcatccctggaataaagcctacttggtcaggatggatgattgctttaatgtgttcttggattcggttagcgggaattttattaaaaatttttgcattgatattcataagagaagttggtctgaagttctctatctttgttggatctttctgtggtttaggtatcagagtaatagtggcttcataaaatgagttgggtagagtacctcctacttctattttgtgaaatagtttgtgcagaactggaattagatcttctttgaaggtctgatagaactctgcactaaacccgtctggtcctgggctttttttggctgggagactattaataactgcttctatttctttaggggatatgggactgtttagaagttcaactggatcctgattcaactttggtacctggtatatgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctctagtgagtctagctaagggtttatctatcttgttgattttctcaaagaaccaactcctcatttgtttaattctttgaatagttcttcttgtttccacttggttgatttcacccctgagtttgattatttcctgccatctactcctcttgggtgaatttgcttcctttttttctagagcttttagatgtgttgtcaagctgctagtatgtgctctctcccgtttctccttggaggcactcagagctatgagtttccctcttagaaatgctttcattgtgtcccaaaggtttgggtacgttgtggcttcattttcattaaactctaaaaagtctttaatttctttctttattccttccttgaccaaggtatcattgagaagagtattgttcagtttccacgtgaatgttggctttccattatttatgttgttattgaagatcagtcttaggccatggtggtctgataggatacatgggacaatttcaatatttttgtatctgttgaggcctgttttgtgaccaattatatggtcaattttggagaaggtcccgtgaggttctgagaagaaggtatatccttttgttttaggataaaatgttctctagatatctgtcaagtccatttgtttcataacttctgttagtttcactgtgtccctgtttagtttctgtttccacaatctgtccattgatgaaagtggtgtgttgaagtctcccactattattgtgtgaggagcaatgtgtgctttgagctttactaaagtgtctttaatgaatgtggctgcccttgcatttggagcgtagatattcagaattgagagttcctcttggaggattttacttttgaggagtatgaagtgtccctccttgtcttttttgataactttgggttggatgtcgattttatccgatattagaatggctactccagcctgttttttcagaccatttgcttggaaaattgttttccagcctttcactctgaggtagtgtctgtctttttccctgagatgggtttcctgtaagcagcagaatgttgggtcctgtttgtgtagccagtctgttattctatgtctttttattgggtaattgagtccattgatattaagagatattaaggaaaagtaattgttgcttcctattatttttgttgttagagttggcattctgttcttgtggctgtcttctttttggtttgttgagggattactttcttgtttgttctagggcgtgatttccgtccttgtattgcttcttttctgttattatcctttgaagggctggattcgtggaaagatattgtgtgaatttggttttgttgtggaatactttggtttctccatctatggtaattgagagtttggctgggtatattagccttggctggcgtttgtgttctcttaatgtctgtataacatctgtccaggctcttctggctttcatagtctctggtgaaaagtctggtgtaattctgataggccttcctttatatgttacttgacctttctcccttactgcttttaatactctatctttatttagtgcatttgttgttctgattattatgtgtcgggaggaatttcttttctggtccagtctatttggagttctgtaggcttcttgtatgatcattggcatctctttctttatgtttgggaagttttcttcaattattttgttgaagatattagctggccctttaagttgaaaatcttcattctcatcaattcctattatccgtaggtttggtcttctcattgtgtcctggatttcctggatgttttgagttaggatccttttgcattttgtattttctttgactgttgtgtcgatgttctctatggaatcttctgcacctgagattctctcttccatttcttgtattctgttgctgatgctcgcatctatggttccagatctctttcctaggttttctatctccagcgttgcctcactttgggttttctttattgtgtctacttccctttttagttctagtatggttttgttcatttccatcacctgtttggatgtgttttcctgtttttctttaaggacttctacctgtttggttgtgttttcctgcttttctttaagggcctgtaactctttagcagtgctctcctgtaattctttaagtgacttatgaaagtccttcttgatgtcctctatcatcatcatgagaaatgtttttaaatctgggtctagattttcggttgtgttggagtgcccaggactaggtgaggtgggagtgctgagttctgatgatggtgagtggtcttgatttctgttagtaggagacttacgtttgcctttagccatctggttatctctgaagctagctgttatagttgtctcttttaagagcttgttcttcaggtgactctgttagcctctataagcagtctgggagggtagctgtctccttagtttgagtgggcagagtattctctgcaggcaagctctcttcttgcagggaaggtacccagatatctggtgttcgaactggactcctggcaggagttgtgttccactcactagaggtcttaggatcccgtggggaatcctgtgtgggccactgagggtgtcgggcaactccgctggcaaggtatctcggggctcgagtggagcggaaggggcttgtgccccaggtcaggcccgggtagtctgcttccctatgtaccgcagtctcaggttctgcgcgattggattggggcaggggctgtgttccactcaccagaggtcttaggatcccgtggggaatcctgtgtgggcccttgcaggtgtcgggcgcctctgctggcaaggtacctcggggctcgagtggagtgcaaggggcttgtgccccaggtcaggcctgggtggtccgcttccctatttaccgcagtctcaggttctgcgcgattggattggggcaggggctgtgttccactcaccagaggttttaggatcccgtggggaatcctgtgtgggcccttgcgggtgttgggcgagactccaggtaaaaactttttgattggtctaaatttatatgattcatgtagctgcttcatttggtttccgattggtcttaaaggtgtaaatatgctctgcatgtcttggtcttagactattaacttataagttattgagtatgattaaaaaggtgtaacattggtaacaagaaagttagcttaaaactggaaactcagggttggagtcattctaaacagcaacaggtggaatgaacctgcccaggaaactagacctctaaagatacttctaaattgggataatattttatgtaattcttattctagaaacttataaaggataagatttaaaacaatgtttctttaatgaagcattaaaagttgcactgtcatgtattcatataaacgaattggcagccaaacttcataacatgaaagtgatgatttttgtattgattttaaagagaataaattgtttaaaattgggttttgctctccaaaaattgtggttataccttaatattgcaaaagaaacttaaaaaaattatagttaaaattgccagtgttccactgactgcagtttgcagtttgatctcaagtttaggatttttaactcacccatatattgtaattaggatgactacaaaagtaatcatcttatgagagcgctaatgtagcttacagcagcaattcgggaatacaaagcaaagccagacttatctggatatattcatctttgtgcagaaattggaccctcgtacaatgagtttggctagggttgctgccttgcagaggactggagtacaagcaatgctttcacagcactaaggttataaggaatgttttaagcacaaatcatcttaagaaagactgtccaaaaattggaggcatagacagtcgaattggtcccctggaatctgtcctcactgcaggagagataatctttgggccaggactcagtcagtatgctcagattaagaactatttacatttgagttaatgcaaagctcaaagcagcctcagtgaagcttgtgtggtgtttcttttgttttgcaaaccttgccttttagaagtttttgggaccttgactctccttgcctttggggacttattttaagccaaaacaacactattacagatctatccaggggttgttcaaaataaactttaatcttaagatttatgaaagttcagtgaggttgtggaacttctaagagcattacaatctcgcctgcctactccatatagaattattatggatttggaagattgtttttttcctttacatcctgataattgtaaagggtttgcttttagtgagcttgtgttcattagaaagttttgcctcttggtatggctaatagccttacattatgtaagaaagttttttggtgtttgtttgtttgtttgttttttctttttctttttttctttttttgtctctgcttcaatacaagaagctaggactttgaatctttcagtgtgtattgtttcttatatggaaagtattttattagctaatgcctctgaagggaagggaagtttattacaaatctttcctcttaaacaactagtgataaagttttggggagtagctgttgctccagaaaagattcaggggcaatatctttttaatacttagggcctcggttatatcctaaaaaattgtggcacagaaaattcaagaaagaaaagatgatttgtgtacttcaaattgtttttaaaggcttccaggtgttaattggctaagacctcaccttaagctcaccacaggaggacttaagcctttgttgaatgttattaagggagatacaaattaattggtgaaaaacaaaaagctttgcagaaagtagaggaagcttttgtaatcaattgttatcaattgtaatcaatagtaatcaaatattagcagtgtattctagttactcttattcactgtgcccacaacaattctttggcaaaagagagcattaacgtgaaaacatctttcttcatcttcaagtaaagttttaacatccttttatgaatttgttgtggtgttaataaagaattgtaagataaaatcatgaagatatttttgaaaaaaaaatcttaaaaacctgataagacatctgttccttgtttcaaacagcaattaaattggttattgcagaatattgatatttggcctattgtataccaatctttttaggtaaagttgataatcattatccaaaaggtaagttgttaaaactgcttctatgcctgcttttttattttctgtaaatttatgcatgcatgtataccatgaaaaatacatctactgtatttataaacagcccttctaaaggaaatacagggacaaagagtggagcagagtctgaaggaaaagtcatcgggagactgccccacttagggatccatcccatctgcagacaccaacctcagacactactgaggatgccaagaagtgtttgctgactggagcttggtagactgtttcctgagactttcttccagcagctgagtaaaacagatggggatgcacacagccaaccatagaactgagcactgggaacactatggaagagttaggggtaagactgaaggagttgaaggggtttgtaaccccataagaagaagaacaacaatatcaaccagaccccccacccccaaactcccagggactaaaccatcaagaaaagaatgctagggcagtgaggcaggtttgggtgggtggacaggggaggttcttaatagaagcatgggggagaggatgggacagggggtttgtggaggcgaaaccaggaaataggataacatttgaaatgtgaataaataaaataaccttaaaaaaaggagttaatgattctaggagttctgtcttcagatagttaacataagtaatttatctctaaatagaagcattattttgaataaggctttatattaaagttatgctgtatatatatttatgagtttaatttcaataagcatcatctttccaattatcatctttttacatttaggtcagggatggtgattccccaagaggttcttttattgttgagaagagtttttgctatcctagtttttttgttatttcagatgaatttgcaaattgcccattctaactctgtgaagaaagaagtttgaattttgataggaattgcattgaatctgtagattgcttttggcaagatagccattttgactatattaatcctgccaatacacgagaatgggagatttttcatcttttgagttcttctttgatttctttctttagagacttgaagttcttatcatacagatctttgacttctttagttagtcacaccgaggtgtttttaaatatttgtttctattgtgaagggtgttgtttctttaatttctttctctgcctgtttatcctttgtgtagagaaaggccactgatttgtttgagttaattttatatccagatactgaagctgtttatcaggtttaggagttctctggtggaacttttaggttacttatatatactatcttgtcatctgcaaatgacttcttcctttccaatttgtatccccctgatctccttttgttttctaattgctctggctaggaattcaaatactatattgaataggtagggataaagtgggcagccttgtccagtccctgattttagtgggattgcttctagtttctcaccatttagtttgatgttggctactggtttgctgtatattgcttttattatgtttaggtatgatccttgaattcctgatctttccaagacttttatcatgaagaggtgttggattttgccaaatgctttctcagcacccaaggagatgatcatgtggcttttgtctttgagtttgtttatgtagtggattacattgatgaatttccatatattaaactatccctgcatccctgggatgaagcctactttttcatgatgaatgatcattttaatgtgttcttgcattcagtttgtgaggattttattgagtatgtggcatccatattcataagggaaattggtgtgaagttctctttctttgttgggtgtttatgtagtttcggtatcagagtaattatggcttgatagaatgaattggttagagtaacttctctttctattttgtaaaataatttgaggagaattggaattaagtcttctttgaaggtctgatagaactctgtactaaacccatctggtcctgtgattattattattactattattattattactattattattttagttgggagactattaatgactgcttcaatttctttagggcaaatggaactgtttagatcattaatttgatcctgttttaattttggtacctggtatctgtctaggaaattgtccatttaattcagattttctatttttgttgagtatagccttttgtggatgttttggaatttcaggttctgttgttatgtctcctttttcatttctgattttgttaattaggacactgtcactgtgccctctagtgagtctggctaagggtttatctatattgttgattttctcaaagaaccagctcctggtttggctgattctttgaatagttcttttcttttccacttggttgatttcagccctaagtttgattatttcctgccatctcctcctcttgggtgaatttgctttcttttgttctagagcttttaggtgtgctgtcaggctgctagtgtatgttctctctagtttatttttggagtcactcagggctataagatttcctcttaggagtgctttcattgtgtcccattagtttgggtatgttgtggcttcattttcattaaactctaaaaagtctttaatgtctttctttatttcttccttgaccaagttatcattgagtagagtgtttttcagctttcatatgaatgttggctttctcttatttatgttgttattgtagataagctttagacttggtgatctgataggatacatgagataatttcaatatttttatatctgttgacgcctgttttatgaccaattatatggtcaattttggagaaggtaccatgaggtgctgagaagaaggtatatcattttgttttaggataaaatgttctgtagatttctgttaaaatcatttgtttcataacttctgttagtttcaatgtgtctctgtttagtttctgtttccaggatcttttgaatgatgagaatagtgtgttgaaatctcccattattcttgtgtgaggtgcaatgtgttctttgaactttactaaagtttccttaatgaatgtggatgcccttttatttgcagcatagatattcagaattgagagttcatttttggaagattttacctttgattattatgaggtgctcctctttgtcttttttgaaaactttggggtggaagttgattttattcgatattagaatggctactccagcgtgtttctttggaccatttgcttggaaaactgttttccagtcttttactctgaggtagtgtctgtctttgtccctggggtggtttcctgtatgcagaaaaatgttgggtcctgtttatgtagctagtctgttagtctatgtctttttattctggaattgagtccattgatattaagaggtattaaggaaaagcaattattgcttcctattattttcgtttttagaggtggggttctgttcttttgctgtcttcttttaggtttgttggaggcttactttcttgctttttctagggcataacttccatccttatcttttagttttccctttattatcctttcaaagcctggaaatgtgtaaagatattgtgtgaatttggttttgtcatggaataccttggtttctccatctatggtaattgaaagttttgctgggtacagtagcctgggctggtatttttgttctcttaggttctgtatatcatctgtccaggatcttctgactttcatagactctggtgagaagtctggtgtaattctaataggtctgcatttatatgttacttgacctttttcccttattgttcttaatattctgtctttatttagtgcatttgttgttctgattattatgtgtcaggaggaatttcttttctggtccagtgtatttgagagttctgtaggcttcttgtatgttcatgggcatctcttgctttaggttaggaaagttttcttctataattttgttgaagatatttactggccctttaagttgaaaatcttcattctcatctgtacctattatcctcagcttttgtcttctttttgtgtcctggatttcctggatgttttgagttaggatctttttgcattttccattttctttgattgttgtgccgatgttctctatggaatcttctgcacctgagcttctctcttctatctcttgtattctgtggctgatgcttgaatctatggttcctgatttctttcctaggatttctatctcctgagtagtctcccttttggttttctttattgtttctacttccgtttttaagtctttgattgttttgttcaatttcatcacttgtttggctgtgttttcttgtaattctttaagggatttttgtgtttcctctttaaagacttctacctgtttagcagtgttttcctgtaattctttaaggacttctacctgtttagcagtgttctcctgtatttcttttagtgagttattaatgcccttcttaaaatcctctaccagcatcatgagatttgattttaaatctgtgtctttcttttcaggtgtgtttgggtatccatgactcgttatggtgggcatagtgggttctgatgatttccagtggtctaggtttctgttagtaagattcttaagtttgcctttcaccatctggtaatctcttgtgttagatgttctggctgtctctggctggaagttgttcctcctgtgattctgttagcctctgtcagcactccttggagcccaactctctcctgagtcccagcggttagagcagtctctgcaggcaaactctcctcctgcagggaagatgcccagaattctggagctcagatccacctcttgagtcccgaggtcagagccctccctggaagaagactctcctctggcaaggaaggtgcccagatttctgggtctcagctctgcctcctggctaaggatgaaggcctgaagggatcctttctaagaagctcttttgcttctgccacccaggtgctctcctgtgtagactggtttcagtgatcccaagatcctgggtgtgctagtgcctgcccaattcacacccaagatggcatggggctggccctgatggaaagaatcccagccggttggtgggtgttgtttctttgtccctgttcctgctggtacaagatcctttgggattctttggaacagatattgtattccattctctccagtgatcccaagatccagtgtgtgctagggcgcctatggcgtagagagtcctctggggaccttgggaccctctgtcattagcgctgaagatgacaatgtactcttaattaaaagatatatcaaccttctccagtatcttataaaatattcatatattcactgaaagtactttataaggaacacatatttataatctacactgaattaaatgagttttactatatctgctttgtaaacagtcccttctgtttatctatttattatttctctgtcttattttttaaatttgattaatgcagacatctgtgtacctctctgtaaataattccacattctgatattaattacaatgtaaacttagcttaatctgatggaagatttactatcagtaagttaaagatctgtgacaatgagaatgacatttgagaagtgctgtcattcaagaattagaattgttagcaatcctattcctattgaggtatatagcttcatagagagacatctttcatttccaggaaactgtcattgatttttaacccaaagtaagtcttttgcccatgttttgtttgtttgtttgtttaatttcacagaagtggcagccagcatgcactctgtatgctgtcagtcctcttggtgttgcggattaacttatgttgttttatcaatagttgattcttcacccacttctaagtgttattccattatttgattgtatcagtttgtttatatagtttctgtggattgaaactcaggctgtttccagtgtttgtatatttgtgtagagctgcaatcacccacttcacagaaaaaggcatattaataatgaacaaaatgtaagcattttaaattttatatggagtaaaggatggaggggaagcagtgagggaggtagaggaaagaaacgttactttaacaacctcatttttaactccattgtgaaacagcactgttttatttcattttttagtgaaatgaaattaaaaagaaaagcatatgtttatagttaacaagaagctcctgcccctggcaaactaaggtcacatctttcaaacacctcaggaatagaagcagataaagtttacactggtagccaaggcagagatggacatgagaacccagaaggtcagagttaccactattgcttgaatcaacaggattatgtctaagaacgaatgagcaaatctaggtagtaagaaaatgatcccttgtattctaaaagggaaagtcaatttaatttttttaaatacttttcatgaatggagagacattaaaagagatgctggtgctcctttccccttctccctctctgtcactatctattcttccctccatccctcttttcctctccttctaccttattgaagtaatcagcagacttccttggttttctgaaaaataaaaacacagatttaccagaacttgcatgatcactaagcaagtttaaacttaagaaaatttacctttggggctggggagatagctaaacataggcacaattgttcctctctcagaggacccaggtttgattccaggcacccacatgacagcacataactgcatgtaactcaagtatcatggtatctcaagccttctgttctgcacatgcaccaggcacactatgcatatgtaggtatgcagagaaacttgaatataaacataaagtaaatctttgtaagaacaatctaacctgactatcatgactatgaaacacaggctaagaataaatattatgtgattttccaggccacacatacttttctcttttcaagtttgaatgtgaatgaaacctttttgtcaaaaaatgtaacattgttacaaatgatatttgtatgccttgccattgagtaaacaccctgctgtaatttttcagattataaagtctttttaagataccaaggaagtcagtgagttctgtacatgtctgtagtcatgcaaaacaatttagctattgtatctgtgtcttgagaactgctagcaattctctctattcaactagaatcaaccgaaatatcaggtcactagttttctcacatctctttaaaaactggcaatggcccaggcccagtgaactcataatgcccctgcctactaatgatgtatcctttgacattgttttactttaaaatctaaaagcagtctccatagccactgcttctttactgcagtgaggggatatgctatctagacccctagctgcaatttgggatttcattatggaggtcatatactacagtgtggcagttgggttaaatttggcaatagtaatcggtttctcaacacacaggaaccaaaaattcattcaaaaatcaatgtgcaatcatgaggtgtttttgcctatgagctatcatgtttgttcactgcagcctaggttgtaatcacataacatttgtaatttgcaatgtgcaagcacttgcactgtgtaataccagcaaacactctcccaaaccttcagtgcagactcaggactgcagtgtgttctgaattaagtgtgttactgtccatacacacttctgcaattagaggaacaatttcattagctgtcaaagatttctttacatgaaatcaaagtaacggctgcagtattgtacatcaatgctttgttaatacttataggttgttagtgttggctaaaagtttataaatataaattgcaatgtcagggttaactacaacaaatgtaagattgaaatctaaatactatacagataaaaataatctaaaagaaacatttaatttttatataattaacagttagtatcctatttaggggagagaatgggccacattaaaaaacatatcaagtcacatatatatctttcaagtactttgttagaattcttcataggtgaaaatctatatggcttagaccctttcttttttataaaaatgaaaatcttttgtgtagcttttacttatgctaatatttaagcatgcaaatactacatgcaataaagaaaagtcatggtcataaattaatagaagtatttacttttaatgatgattctgagtaaagggattctttttaaattcagatttgtactgtcatggtgacatcagctctctcatattcaaatcacatgtaatactagttgatttatacttcaacagtgattaggaactttttcaaagtttgttgattattggctcattctgaggaatggagaggatacaggatagtttggtaaaaggaatataagtgaatgctatttatgattgattttattgatgattaatatcccaataattttaatttggccatttaataattaataattaacttgacatcttccttataatactgatgagaaataaaataatacatattttaaatattaagctatatgttacaaaattgaggttgttaattcattaagaaaaaaaatgctgatttgggctcacagattgaaggttttcatccatggtttagaaaaaaagaaaacctactcacctcatggtgagacagcaaaatgaagacgagatcttctgcagtttcaatactaacttcaggccatccccagtgacagggcaccttccatgagtccctaatgaagttagaatcactttccaacaactctcagagcctttcttgatgagttatccaagccactacaaattgaaacaaagaaaaaaaaaagtgttgtaatcacctatctgttatggaactgttgtccatacccataactccagaatatgggaggaagtggcaagagactcagaagttcaaagccaaccatagctacagagtcagcttggattacatgacagccctgtctcaaagaaataaaaggcatacaaaacaagtaatgaaataaagactatctaaaatgactttggaaatctctgaggatcatgtcagagaaaattttattaataataaaaaaataaatgctttaaatatgatgcttaacagaatagactggtttccattatgttacacatttaactggttgtttcatttggtggctttattaataaacttttaaaaatgcccacatatcccttctgagaatttaatatttcattcatataaagtaaaatcttaagtcattagtcacatttctattttattttagttgcaacaaaactaaaatgctacaataaattgacattttgataaaactccatttatgaaaacctccactagattactgaatctatagcaaaaaggttatcattcttgtaaaattgtctatcatttttcatctctctgtcaaatatcaatttagtacgttaagcttattaaaagttctgaacatcataattttaaaaagtctccaaaagagtacatatcatttattaatcaatgcttataaacttatcatatatgcctaaaataatccactgaaaaagtcaggtcagtgaaaaaactctttgagaaatttgttgataaatcaataatgttttcattatggataaatcaaatgcattaataatctagatgaaatggaaattttcaggcaaaaaatttggttcatataattgcacattttaatttctatgtttacttttcactaaaccaaactttaatgtaatataaaatatggaacaaaacgctatcaaaatgattggaatttacatcatcaacatttcaacattgttttgtaactgctcttgtaatcatgctactatttttctccatcgattcactataatttacaatctgttttattctttatcatctggacctttgttatattagtaagatagttttagaatgcattaataaacctgtaatttccaagctttcctttaaagtcatagaaatagggcatgctttcctataccattttccctatgtttcactgtacagccttcatttgatcttggctgactgccatgccttactggcaataatatttacaatttgaaatatgtgcccacccccggcattctattggatgtgataattgatcacatatctatatgtgatatttggaaatcatggttgtattaaagtacaaaaaagtcatattactttgtttttatgtttcttttgcttaactttctgtgtgtgtgtgtgtgtgtgtgtgtgtgtgtggtggggcacaaagagtgttagaggtcttaagccagactcctgtgaccaagttgactagtaagtcaactggccagaactgatatcttcacacttgtataaaaaaaaaaaaaaaaaaaaaaaaaaaaaaaaaaaaaaaaacaacaacaaaggactagatttgtataaagaaatatttttttttttttgtcacaattactccttagtacagcttaaggtcaggaatggtgattccaccagaggttcttttattgttgagaatagtttttgctatcctagggttttgggttttttttttgttttgttttggtttttaattccagatgaatttgcaaattaccttttctttttttttttctcctttttttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccattgggagccctatgatccatccattagctgactgtgagcatccacttctgtgtttgctgggccccggcatagtctcacaagagacagctacatctgcgtcctttcaataaaatcttgctagtgtatgcaatagtgtcagcgtttggatgctgattatggggtggatccctggctatggcagtctctacatggtccatcctttcatctcagctccaaactccgtctctgtaactccttccatgggtgttttgttcccaaatctaaggaggggcatagtgtccacacttcagtcttcattctccttgagtttcatgtgtttagcaaattatatcttatatcttgggtatcctaggtttggggctaatatccacttatcagtgaatacatattgtgtgagtttctttgtgaatgtgttacctcactcaggatgatgccctccaggttcatccatttggctaggaatttcataaattcattctttttaatagctgagtagtactccattgtgtagatgtaccacattttctgtatccattcctctgttgaggggcatctaggttctttccagcttctggctattataaataaggctgctatgaacatagtggagcatgtgtccttcttacctgttggggcatcttctggatatatgcccaggagaggtattgctggatcctccggtagtactatgtccagttttctgaggaaccgccagactgatttccagagtggttgtacaagcctgcactcccaccaacaatggaggagtgttcctctttctccacatcctcgccagcatctgctgtcacctgaatttttgatcttagccattctgactggtgtgaggtggaatctcagggttgttttgatttgcatttccctgatgattaaggatgttgaacattttttcaagtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcgattctcgatcttacagcacaagccattgctgttctgttcaggaatttttcccctgtgcccatatcttcaaggcttttccccactttctcctctataagtttcagtgtctctggttttatgtgaagttccttgatccactaagatttgaccttagtacaaggagataagtatggatcgattcgcattcttctacacgataacaaccagttgtgccagcaccaattgttgaaaatgctgtctttcttccactggatggttttagctcccttgtcgaagatcaagtgaccataggtgtgtgggttcatttctggatcttcaattctattccattggtctacttgtctgtctctataccagtaccatgcagtttttatcacaattgctctgtagtaaagctttaggtctggcatggtgattccgccagaagttcttttatccttgagaagactttttgctatcctaggttttttgttattccagacaaatttgcaaattgctccttccaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagatttgaagtttttatcatacagatctttcacctccttagttagagtcacgccaagatattttatattatttgtgactatagagaagggtgttgtttccctaatttctttctcagcctgtttattctttgtatagagaaaggccattgacttgtttgagtttattttatatccagctacttcaccgaagctgtttatcaggtttaggagttctctggtagaatttttagggtcacttatatatactatcatatcatctgcaaaaagtgatattttgacttcctcttttccaatttgtatccccttgatctccttttgttgtcgaattgctctggctaatactttaagtactatgttgaaaaggtagggagaaagtgggcagccatgtctagtccctgattttagtgggattgcttccagcttctctccatttactttgatgttggctactggtttgctgtagattgcttttatcatgtttaggtatgggccttgaattcctgatctttccaaaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttaacgagaattttattgaggatttttgcatcgatattcataagagaaattggtctgaagttctctatctttgttggatctttctgtggtttaggtatcagagtaatagtggcttcataaaatgagttgggtagagtaccttctacttctattttgtgaaatagtttgtgcagaattggaattagatcttctttgaaggtctgatagaactctgcactaaacccatctggtcctgggctttttttggttgggagactattaataactgcttctatttctttaggtgatatgggactgtttagatggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccttttagtgagtctagctaagggtttatctatcttgttgattttctcaaagaaccaactcctcgtttggttaattctttgaatagttcttcttgtttccacttggttgatttcacccctgagtttgattatttcctgccatctactcctcttgggtgaatttgcttcctttttttctagggcttttagatgtgttgtcaagctgctagtatgtgctgtctcccgtttcttcttggaggcactcagcgctatgagtttccctcttagaaatgctttcattgtgtcccataggtttgggtacgttgtggcttcattttcattaaactctaaaaagtctttaatttctttctttattccttccttgaccaaggtatcattgagaagagtgttattcagtttccacgtgaatgttggctttccattatttatgttgttattgaagatcagtcttaggccatggtggtctgataggatacatgggacaatttcaatatttttgtatctattgaggcctgttttgtgaccaattatatggtcaattttggagaaggtcccgtgaggtgctgagaagaaggtatatccttttgttttaggataaaatgttctgtagatatctgtcaggtccatttgtttcataacttctgttagtttcactgtgtccctgtttagtttctgtttccacgatctgtcctttgaagaaagtggtgtgttgaagtctcccactattattgtgtgaggtgcaatgtatgctttgagctttactaaagtgtctctaatgaatgtggctgcccttgcatttggagcgtagatattcagaattgagagttcctcttggaggattttacctttgatgagtatgaagtgtccctccttgtcttttttgataactttgggttggaagtcgattttatccgatattaaaatggctactccagcttgtttcttcagtccatttgcttggaaaattgttttccagcctttcactctgaggtagtgtctgtctttttccctgagatgggtttcctgtaagcagcagaatgttgggtcctgtttgtgtagccagtctgttagtctatgtctttttattggggaattgagtccattgatattaagagatattaaggaaaagtaattgttgctcccttttatttttgttgttagagttggcattctgttcttgtggctgtcttctttttggtttgttgaatgattactttcttggttgttctagggcgtgatttccgtccttgtattgcttcttttctgttattatcctttgaagggctggattcgtggaaagatattgtgtgaacttggttttgtcgtggaatactttggtttctccatctatggtaattgagagtttggccgggtatagtagcctgggctggcatttgtgttctcttagtgtctgtataacatctgtccaggctcttctggctttcatagtctctggtgaaaagtctggtgtaattctgataggccttcctttatatgttacttgacctttctcccttactgcttttaatattctatctttatttagtgcatttgttgttctgattattatgtgtcgggaggaatttcttttctggtccagtctatttggagttctgtatgcttcttgtatgatcatgggcatctctttttttatgtttgggaagttttcttctattattttgttgaagatattagctggccctttaagttgaaaatcttcattctcatcaattcctattatccgtaggtttggtcttctcattgtgtcctggattacctggatgttttgagttaggatccttttgcattttgtattttctttgactgttgtgtcgatgttctctatggaatcttctgcacctgagattctctcttccatttcttgtattctgttgctgatgctcgcatctatggttccagatctctttcctagggtttctatctccagcgttgcctcgctttgggttttctttattgtgtctacttccccttttagttctagtatggttttgttcatttccatcacctgtttggctgtgttttcctgcttttctttaagagcctgtaactctttagcagtgctctcctgtaaatctttaagtgacttatgaaagtcctttttgatgtcctctatcatcatcatgagaaatgtttttaaatctgggtctagattttcggttgtgttggggtgcccaggactaggtggggtgggagtgctgcgttctgatgatggtgagtggtcttgatttctgttagtaggattcttacgtttgcctttcgccatctggtaatctctgaagctagctgttttagttgtcactgttaagagcttgttcttcaggtgactctgttagcctctatgagcagacctggagggtagcactctccttagtttcagtgggcagagtattctctgcaggcaagctctcttcttgcaaggcaggtacccagatatctggtgttcgaaccagactcctggcagaagttgtgttccactcactagaggtcttaggatcacgtgtggaatcctgtgtgggcccttgcgggtgtcaggcgactcagctggcaaggtagccggggctcgagtggagtggaaggggtttgtgccccagttcaagcccgggtagcctgcttccctatgtaccgcagtctcaagttccacgcgattggattggggtaggcgctgtgttccactcaccagaggtcttagggtcccgtggggagtcccgtgtgggcccttgcgggtgttgggcaagactctgctgtcaaggtagcccggggctcgagtctcgagtcgagcggaagggacttgtgccccagatcaggcccgggtagcctgcttccctatgtaccgcagtctcaagttccgtgcgattggattggggcaggcactgtgatccactcaccagaggtcttagggtcccgtggggagtcccgtgtggacccttgcgggtgttgggcaagactctgctgtcaaggtagcccggggctcgagtctcgagtcgagcggaagggacttgtgccccagatcaggcccgggtagcctgcttccctatgtaccgcagtctcaagttccgcgcgattggattggggcaggcactgtgatccactcaccagaggtcttagggtcccgtggggagtcccgtgtggacccttgcgggtgttgggcaagactctgctgtcaaggtagcccggggctcgagtctcgagtcgagcggaagggacttgtgccccgcaaattaccttttctaactcagtgaagaattgagttggaattttgatggggattgcattgattctgtagattgctttcgggaagatagccatttttactatattgatcctgacaacccatgagcatgggagatcgttctatcttctgagatcttctttgatttctttcttcagagacttgaagttcttatcatacagatctttcacttccttagttagagtcatgccaaggtattttatattatttgtgactattgtgaagggtgctgtttccttaacttctttctcagcctgtttatcctttgtgtacagaaaggccaccaatttgattgcattaaatttatatctagctaattcatggaagttgtttgtcaggtttaggagttctctggtagaatttttggggtcacttacatatactatcatatcatctgcaaatagtgatattttgacttcttcctttccaatttgtattcctttgatctcctgttgtctaattgctctggctaggacttcaaatactatattgaataggtagggagaaattgggtagccttgtctagttcctgattttagtgggattgcttccagtttctcaccatttagtttgatgttggctacttgtttgctatggcagatgccaacaagagccggatgacaggagcctgatatagatgtctcctgggggcctttgtcagtttctggcgaatacaaaagtggatgcttacaatcatccataggacagagcacaaggcccccaatgaaggagcctgagaaagtacccaaggagctgaaggggactgaagccccataagaggaacatcaatatgaactaaccagtacccccagatattcttgggactaaaccaccaatcaaagaaaacacatggtgggacttgtgactctagctttatatgtagaagaggatggcctacttggtcatcaatgggagaagaggccctaggtcttgtaaaggttctatgccccagtgtaggggaacaccaggactgagaatgggagtggatgggctggggagcaggggtaggaaggaggggataggggatttttggaggggaaactaggaaagaggataacatttgaaatgtacataaagaaaatatcgaataaaaaaaagaatttttttggattcccactttgaataaagtctttgttggtgccaggtggagtatgtttccctccttctaactaaaccatgaaatgaaatacttccaagtcacacacctcaacaatttccaacataatccttttagtgggcactggggtgctcactatttcacatggcaggaggtgaggggtgggatgtaggtggtgaaggcggggtaagcaaaatgaaacaatcaaagtctcagggaaaagtgtgctttagtttatcataaagaattgggaaaaaaatcactgtatttaagtagattcctttaatacacacagtgcttccagccacatcaaataccatctgaattgttactatctgaaagctcagtggtctgggaatccctacaagtgttcccaggcgagaaaaacctcgccctttactaaaagcaaggcaatgtatgtccagttaccaaagatccacctttaaaatctctctcctaggggcctttggtcctgtgaaggctctatgccccagtataggggaatgcctgggccaggaaccagaagtgagtgagttggtgagcagggggaggggggaggacatagggggagagagttttcagagtggaaaccaaaaagggggataacatttgaaatataaataaaataactaataaaaatatctctcctaaggtctcatcttggaggcttggttaattcacagaattctatcataaataattaatagtacagttagatatttgactaaatgtataccagagtcacattctttttttgttgttgttttttgttttttgtattttacatagatctaccagaagagggagcagtctgtgggtgcttgatcctacttcatcaaacctttgaacactagctatggttttaagtaattgtgcctttggcatcttcgagttttatgttgtttttattaaaataaaacataaacaaaagtaataattctaactttaattaatggacaatgagagtttatggaatgaactacctttaattctttttcctgaagaaattaaatgagcatttgtgtacttggagtagagtcctggaggaaatagaaacataattaggagaggggacttcacatgaaaggattagcaattgcttttctacaatttgccaaaaccattgtgaccatttacccattaaaaagatcaagattttttccatgttttatctcttgcttttacattatcttaataaatagagtgtataatttgccagtgcccagtgtaaaattattttaatacagtaagttgaagattgaatagttatgaatttttactatcatttacagtatacattatattatcttaactgaccacctcaaaaatgtgtcaacatttacaacctaaacaataagggaactacttcaatgtagtttgtgacatgattcgactgtgcctatggacgatactagcgaaaacaagtgtgtgggaatcttttttgaggaaacattagaaaatgtctactcactggagatgggacctcatgagaaaaataggaaacaaacaacaaacacttcgacccaagtgtgctttggtcaaccaatgattttaattgggattaattacagtgacatgagcaactaatggctggcaacaacacttgaggaatggaatctttttatctaaataattattaactgcctagaaaccctgggaaagggtgcttctgtgcaccctgtccatggcagaaagtgatgaacctaattctgattaggtcttcttcaggtaattacagctccttataactcaagagggtcaggacaatgtctagagtgtcacattctacactataataattggtattattttatttattcatgtcttttaattaatatttgcccagtaaggctggagtgggtaagtgggtgggtgggtgggtgggtgggggagcatcctcattgaggttgggggatgggaaatgggataggggttttctggaggggagatctggaaaggggtaacatttgaaatgtaaataaagaaaataatccattaaaagaaagaaaaaatgaattattagataaagtttagagtatatgtataataagataatattgaatcatgaaaagaaataaagtcttgtcatttgtaacagtgtgaaagaatacagagattataactatgtaaaatacgatataagaaagcaaataccatatgatcttacctgtgaaatttgaacatgctcatactttaatactgactaacgctgcacaatagccagaaaattagttgaagaacttattagaggaagaaagtctgtcaattaaattaaattagattaaataaaaggagtaagttttagttttacattgtactagatagtgagtataatcagcaattatgaacaataaataaaaagatttgtttgctcttatcacattgaaatgataatggttaatatgataaatatgctacttctcttgattttatcattatataacatatgcatgaactaaaacatgtcatttctccaaatgtataattttggaaaatcaaattatttttcaaaatataaaattatttaaattaaaaaatattagactgtgaacatatgtgaactaagaaactggaaccacagattaacatgtggtgcacctgtaaatattaaatgcagaactgattctttgccagggctatggtgaagggaggtttgttaagtctgtaccatggcagccctgtgaacatgatacccgaactaagaggaactagtgtttctttgtagcctgactcatctcccttcaagactcacatagccgaaagcgctgctacatggctgaatggtctttcttggtgtctcttttaagccacacatacttctcggctcactcaatcttgggatagaggcttggacagagtggacattggccagggctgttactggaattagggctcttcagggccaggttggtgggaagatgttgtggtgtggtttgtcagggtatatgtgtgtgtgtgtgtgtgtgtgtgtgtgtgtgtgtgtgtgtgtgtgtgcttacctttgaagctatccctatttgaacttccagttccttcttcctcatggtctaaatgagcgctgcatttcacactgagctctactttcttctgcagcacatggggcgcctcgtgaaggtaacagaagtattggattgctccatgatggtaacccacaatgcacagatgggttaagctgcgacagtcccatgcagcccacagagctcatcatactgatgtgagagacaacattattttgtgtgttacactaacttctctccttcagcacagttttgacaaaagcaaccagatatttttaatgacggcactgaaacaccttcttaaatacctaatgccagaaaggtcttcccaaagttaacagaaactatttttcatcggtgtatatgattataaacatgaatgagcatggcattaggattttaatttctttaacagtgggagtattaattttggcaaggtggtaatgttctgctcagcagtttccaccggagaatgacttcaaattcccaagttttcctccagctttcaagttgtcttgacaactaagagtattccaggtccaggaggctaggctaggctactgagaggactacagttcctctatgcctgaaccttttagatgacagactttgtcttttcctgcttatatctgggctggtagaaagcttgcctgcacagagaggctagggagaggctacccctcacagccaggacgtgatggaaagtagcactaagggccaatgatttgcctgatccctaccctaaaccccagggaaagcactagcaaaaaatacatctgcacttacatttctttgtacccccccccccctttttttggaaaaaaaatcaagacatcatattttttgaaaacctttcaaactttaacttttctcattttggttcctcttccatgacacatattttcttgtccaatgatgtagaagtatctggacatttctaggtcatgggaggtgagtagtctgtcatctatcacttagaatggaggaatggatttatatcatttacatttgtcctaggaaaatttattgctgtttattttagatatagagcctttaatcaaccatactagaagaaaaaaatgacatattttctattttatcttaaaaacatttcaaattgttgtcatataaacaacatatatataacaatataaaataggaagaaatattatttaacccaggaataaataatcaaggaatatggaagtgttctatattgtaacataagttgaaatatatttcagcatttcttaaaataagcttaagattcgccttgcacagtgtatcctccttgtagcttgtcatccctgtacacaaaggctgtcacatgcctcttgtgaagaggggagtttatttagctgacactttcgagatttaagaacatatcatgtgtggcaggcaattcaggtgtggtgagggtccatggcaaatgggatgtggacaatggtggcaatgttgctcaggttaggtgattctatcttcagtcaggaagtagataaaagagaaaacaaggcaggaggacttctgtttgatccactttcacaagagaactgaaaggattgggtggcaactacattgtgaaagcatacaatggatacaggctttctccgggtctcctcttttaaggccttgaaaattcccagaacactaacctctggagcaaacatctaacacattaccttgtgaaggttatagtgtatctgaagcatctcactgaaatgtgtgtgttgggaactttggtaaagggtttcattgacttagcttctggcttcctatgtgggcaatgaagacatcagtattagagaaatgggggttttagtgccaattaaaaaatatttcgtgttctaaaaaattacaagtaaccttgaattgacacatggcatttcaaagcaagtgttaacacaattttttaaaagaggacaataaaatgaataaataaaatgcagagagcacagactgtttatgacttccctcaggcagtacactgacaaatgatagagtttggattagacctccatccacattgtgcactcctatttcctgatacaaccagcaggccttgctagaagacagtcttggactgtcttagtcagggtttctattccttcacaaacatcatgacaaagaagcaagttggggaggaaaaggttaattcggcttacacttccatactgctgttcatcaccaaaggaagtcaggactggaactcaagcaggtcagggagcaggagctgatgcagaggccatggagggatgttcattactggcttgcttctcctggcttgctcagcctgctctcttatagaaccaagactaccagcccagagatggtcccaccctcaaggggcctttcccccttgataactaattgagaaaatgccttacagttggatctcatggaggcatttcctcaactgaagctcctttctctgtgtcaagttaacacaaaactaaccagtacaattgatcccttgtcaacttgacacacaaacacatcactaataagcctcaatccttacattcttattcatcaccaagatctaaataactttaaaagtcccacagtctttacatattcttaacatttcaatctctcttaaagtccaaagtctttacaactaaaagtctgttaactgtgggttccactaaaatagtttcttccttcaagagggaaaagcatcagggtacagtcacaatgaaaagcaaaaatcaatctccaactattcaatgtatgggatccaactcacgatcttctgggttcctccaagggcttgggtcacttctccagccatgccctttgtagcacacatgttgtcttttaggctccagccgcctgtactccactgctgctgctcttggtggtcatctcatggtactggcatctccaaaacactgcacagggaaaggagcttcagttgagaaaacacctccatgagatccagctgtaaggcattttctcaattagtgatcaagttgggagggtcccttgtgagtggtaccatctttgggctgatattcttggattctataagagagcaggctgagcaagccaggagaagcaagccagtaaagaacatctctccatggtctctgcatcagctcctgctttctgacctgcttgagttccagttctgacttcctttggtgatgaacagcaatatggaagtgtaagccaaataaaccctttcctccccaacttgcttcttggtcatgatgtttgtgcaggaatagaaaccctgactaagacatggaccacagcagtctggttggaggattccatcaattgatggctttgagcaaatcagtgagggttttgtgcagtctctttcattgtcttttcaaatgaaaatgccatgtcttaacttactatgggtatcttctgcagtactatcaggagagctcaaaagttctgtgagggccagtggtaaaatgcctggaaacatttcataagggttttctcctcccctcttctttcttcatttctcttctcttctcttctcttctcttctcttctcttctcttctcttctcttctcttctcttctcttctcttctcttctctcttctcttctctcttctcttctctcttctcttctctcttctcttctctcttctctcctctcttctctcttctcttctctcttctctcctctcttctcttctctcttctctcctctcttctctcctctcttctctcctctcttctctcctctctcctctcctctctcctctcctctctcctctcctctctcctctcctctctcctctcctctctcctctcctctctcctctcctctctcctctcctctctcctctcctctctcctctcctctctcctctcctctctcctctcttctctctctctctctctctttctccctttctccctattctctctcactctctccttcctttaaagatataatagatgacaatatcttaaaatgatattctgttaccattatatcaatgtatgaacctcataacttctgtttataatggtttatcctccctatgtgtgttctctatttacccacaaaaaataggacaataatagaatatacttgagttcttagtatgggaatccacttttctttccttcctatcatatgagtatgatccttaattgttttaaaacaaataccacccttattgttttaaagcttcaattaacataatgaaaatcaagatatataattctgtctttaccatttttcctttcgtttcttttagcattcttttataattgaatcatttgtgttttgctgaatgatttttgaggttgcttccatattttgagcacaaatctatcagtaatacaaacgttacagcaaatatctgtttaaacttgcacttgctatttaatttgatagtattttcttttgttatgtctaatatagttaattttaaattaattttttgagaattttatatgtgaagactgtgtttatttcatttctattcttccctttctccttctcccatgtcagcaccccttccaaatacactcctctcaaaattacaagctctttatcataaacaaatatcaaaagtttcctttctgtgttatgattattctattttatttgagaaattctttctttatttaataatgcaaagatacctttcttgactgagtgtgatagcacatgcctgcaatcttaaactatgctagttgagataaaatgaatttaagtacaaggcctgtgtgggttacacatgtgaacctgtctctaatagacaaggcaaacaaatctctttaatataatctcactttaagagtcttcaatagaatcagtgtaacatttatgttttttcattttgaagacaatttcttttaagacaattttttgagtggtctaatgcaggatttttatgcaaattatcagaattgtttcacattgagtattgaactttcaaacacaagcatagaacatacacatacatatactacacatacatatagacacacatacatagaacggacaaacaagcagtataacacacacacacacacacacacacacacacacacacacacacacaaagacagagagacagagagacagagacaaagagaaaggcttgtttgctgggtttcaatccctgaacctgaaatagcttttagtgacaaccagagattttgtttatgtaagttaatgaatggggctttattgcagcacacatggacagtgttggtttctgcttcttcccacactgaaggattttggttgcttttggcttgattaggcaggagttactatgtgatgctctctactgtgaagacatcaccaatcagctaggaggtgaccttgtgaactttggagcaaatacaattcaacacatgagaaatacttggatgacctaacatctaattgacatggtgctctttatagatggaacctctgagaaaagatgagggtggaggacccataactctagaaaatccaatttttttttttttggaagtgctaccctgccaaaccttgccagctatggttccaacagtgtcaaggaaaatgacttttcctaatacctaggagataagaagcctctgctcatgacttgtcttctttcaactttttccaaaatcaaaatcatgaaatcttgcacacttttatttggaattacttggtcttcctgaggtctgtcctaatcaatctaagcaaaggattgatacatagatagactttgggtttatagacagactttgacttgtttggtctttttttaaaaaatatttttattaggtattttcctcatttacatttccaatgctatcccaaaagtcctccatacccacccacccccactcccctacccacccactccccctttttggccctggcattcccctgtactggggcatataaagtttgcaagtccaatgggcctctctttccagtgatggccaactaggccatcttttgatacatatgcagctagagtcaagagctccggggtactggttagttcataatgttgttccacctatagggttgcagatccctttagctccttgggtattttctctagctcctccattgggggccctgtgatccatccaatagctgactgtgagcatccacttctgtatttgctaggccccggcatagtctcacaagagacagctatatctgggtcctttcagcaaaatcttgctagtgtatgcaatggtgtcagtgttaggaagctgattatgggatggatccccggatatggcagtctctagatggtccatccttttgtcacagctccaaactttgtctctgtaactccttccatgggtgttttgttcccaattctaagaaggggcaaagtgtccacactttggtcttcgttcttcttgagtttcatgcgtttagcaaagtgtatcttatatcttgggtatcctaagtttgatcttcttaatgtaaaaattatgaattgtatatttgaaaaaataaaatctttttatatattatgaaaatttaccatcttaatttattaaaaataattaccacatatgtgaaagtcttgtgcctacataaaatagtggagtgggactcattggttctaggtttataatcagggcactcattcattcactccatcaaaagatgtgtgtttctctgtattgttctttccctaccttctttgttgtgaacatctgtggtaggtataccatctggtcttagaaaggctgccatgttgccaggagataactgagacccttcatctggcacatccttaaggagtcatctcagatttcatccaaagcagtcagttttgttgaaagccctgtcaactggaagattatttgcctagacttagaaaccctgaacttcaagacacaacatggcataatgttcgtaggctgggttttatttataaacttactcttctatttataaaaagaataagttggaacagctttagaaaggttcaaaaacataataaagaccatagaaaatgaccaggtatgctcagccttttgaattaaaattctaatgattgaagtataattctagcagacttgaatctagaagcaaaaatgatttcttgtattgaaaatctggaaatagcaatgaactaaaataaatatgttggagaagttagtaaaataggtggaaataggttctcagaatatggtacaaaggttgtgtccttaggagatactatggcctttgaatgtactttttaattaaggcaatatcataatgaatttagtaccttgaatacatttggggttttgagataatatctttattggttttacttcaaaagtagattgattgtggctttcataatttttcatggtcataaaagtaataatttctgaattgcacaacaaaccaaatcaagccaaagtctgacattttcttggtaagaaattgttaacattagagtagatttttgtgaggttatcttgtttatgtagaggatggagtttaacttcaggtgcttttataaaccactctattattttttgagactggatatctcaatgaacttccagcttaccaaattgactaggttgaatggccagggaaccccagagaccttctattgctgtctctccagcactgaattatcggcttggtctgccatgcctggctttttccatgggtgttggaaatctcagcttgggttctcatgcttagatgcagtagcatatttactgactgacccatctccccagccccatctttgcatagtttcaaattttcagttaagtggaaatttgacttagagtaaatgtatgaggataacagcacagagaatggtcatttctttgttctatacttgcattttagttaaaaaaatataaacagaatttcttttcttcacagtttattatctataaagatagggagcagctcagttttataataagttaaaggtgtttattatgttactgtaacataaatgacaaagtgaaagcaatgcaatgaggaagatagatttcccaaaggttgctatgagccttagttgttatttttgtggctttaatagtggaaagcactgactcccaggacttaagcaggaagccatgatcactgagtattcatgaaatgccaaaacagagctacttctgtctaagggaattatattcatcttggaagggtccagaaacatagtgatgccaggtttatgccacaaaatgaagatcaattacaatgtatgttttaccaaattaaatagctttagaaatgtttagaaaacagttgcaacatataaagttgctaatgctcaaagtagcacagagtgtcacaaagaaaaaattgtctttggaaaaagaaaggggaaattgtgggttaaatagtaaaaagacgaggagaaagaaaatgggtctgtatttctttagatgatttttctcttggtttgtgtttctttaattctaaccctgtagcttggattagcaaactgagccaagggtatactttaaataaatcttgagaagcctgaagtagaacaggaaatctggtcagatagagcaaggcaatttgctccacatgtgggagcaatgttcagcttggaaatagacagtctgtgagctgaattgttacaatcagaaaagatattaatttaaagtagaaatcaaatccatcttctgggatttgatgagtggatgatttttcttacatgttccctttcaaataatttttttacaactgcaggtggtcttgatttttacatatttagaatatataatatacatactaatatttatctatatgattagtatttttatataatatataatatatctgcaatatattcagatgcatcccaaatcattctataaaatcttgaatgagctagagagaaggctgcctttgcaagaggagaaatgtgtcttgaatgtttttgattccttgctcagccattctgttggccatctggacctcagccactgttcatgtctcaaaacacacacctactacttccttcctggcacaagcttaatctgactctgcagaacattgcttcctttatataataacgtcgagggcagacagtctttttacttcattttatttttccatatcaagaaatgtgtttcaccttggatttgaccctgcatgcttcctgccattcactttttgttttagtcaaatgaatgttcctttttgcagagccagctctttctaaagtaaggattcctgtttggtttcagggttatatttttcttaaacatctcatttattaaaatactatgtaacagtagagtacgctgacaaaatcatacatttttaaatctataaatcctttagaaaaagcaattcaattcttccaagtgaacaatctcttagaaaggatagctgtgcagcacagcttgatgcaacattttatttactgctttcctgcttttctttaaaattgaatcacctacatacaattatccttgtatttatttggttacgaggcactagctggattattgacaagattcataggaaaacaaaacaaaaacaaaatacccctgcaaccttttaaaccacaggccactagtgaagtgagaagtaagaaaagtgtctaaacttcaaaataaaatggttagttaaaatgtcctctgtgagcctgccactgcctctcacctctgatgtcagtttttcattgtacaaagattgcacttgcatgtctaagaaagtagcagttggtggaggaaggtttggttatgggattgctctggcaaggattttgaggtaaaagataggtcattcagttctagttacctgatttctctgaacttcaacaacacttgttctacatgaccagttcattacttaaagtgttaaggtctcagcaaggccttttctctgacggttcacgtgcagagtgcaagagtaaaatttctggagctgagatcaatatacccaatgaatttgtgggtctggtaggtggactttgtagtctttgacaggctgaattctgtagctgagagtctaattcaggactatcttgagagaacaacaataagcatggcatgctgtttcatgataattccaagatggcaggttcaagttgctatgtctcctcaaagttagtgtggtatatacactctgtcacttctgccaacattcactagggacaataaaagtcacaaaatcaagcccaaagccaatgtaagagaacaatttgttgacagaattcaatcaatcactacagtaggaatgtttaatttaccatggatactcaaaaaaaagaaagaagaaaaatttccacagaattattctttatccaaattacaacaaatacatattaaatttaacggtacttactatgaatatagattgttatgtatttatttcaaataaaacaaattctatttgggggctggagagatagatcagttattatgttcactacacaaggatgaagacctgagtttagatccctacaaagtcaggtatgcctataattgcaaattgtagcagcagagagaataagataggtggatccttggagcgtctatctgcttagatagtctagctgaaatgataaattccagacttagtaaaaacaaacaaacaagcaaacaaacaaacaaacataaacaaaagaaaacaacaactctgtttctagaaatatcgtgacctgggctggtgggatttcttggagattaagagtatatactgctcttgctgacctgattttgatttccagtcataatatctaaagattcataaccacctggacctctaactccagagatttctgaaaccccttgtctctgttaatgtgtggattcatggccacacactccccctattcctacacactctcacacaaacaaatgatttaaaaaatagctaaaataaaccttataaaaacattgtaagtgccaagtgaggatgacatctgatgtcaacttctggtgtctatacacaaatgcacatatgtgcacacaaacacatagacaaacacactcatatacacatacaacatatatttcaaagattctcaaatctaggtccccattgtaattaagtcttactagtctctttaagtctaaaagaaattgtagttgtattactaaatttgcctttcattaagcattttaggctatatgcagattttagaatataggtagagtatgtttatagttggacaagttgaagagtttctggaagagttaggatttgagaaaaaaggaaagaagagagataagagataactatagttgttggtatgtattatagattgggaaagaatttgcacaaatggtgaaaagaaagaaatattgagaaccaagaagataccaaaattggtaccgaaattaagatcattaaatgaagcaaggcagatgcagaaacaggaatctcctgtcaatgatgtattttttaataataacattatggatgtttcaaatatgtttacaagaactagttatttaagcaaataattcaatattttctatttgctcatatgctttacttattgtttataaaatcattggttacttaatattttattttgttgtaattctccccactctttttctctgtatctccccctatccctctcctccttgctttcctcctccctctcttcccacctctcactttgtgtgtgtactatgtgttcattcattatatatgtgcttatgtgcatgcatgctggggacagatgtcatgtcttgctcatgacagtatctctcactgaacctggagctcactaaattaaccaagctgtatgggcaatgagttccaagaatcctcctgtctctgcctacccaattcttgtactgcctgtcgagcgtttaaaagcgttctgatccaaactcacttctttgtgtttacaggccaaatgcgttattggcagatccatctatacactaaccacttttagatagaaagcattaataagatccatactaatctttgggtttattttcaggagattagttggatattatatattacaaataaaagggtttctcaaatcctccctattttcagtgttttctgtacaatttgtctagttataatcaaattttcaaaaaaactcccctaatatcaattgacaaaacatttaatcctaaggtactacacacacacacacacacacacacacacacacacacacacacacacacactcacacatacatgtgcattcttaattgtaggagtgtatttatgtcagacagtagagtttttaatttcactttaattaagcattattctataaaattgtcatttaatttgaatatggactttagccaactatttctttctttttttttttttacaatcacaaaagaactcaaatgatatgtactcaatgataagtggttattagcccagaaacttagtacacccgagatataagatacaatttgcaaaacacatgaaactgaagaagaacgaagaccaaagtgtggacactttgccccttcttagaattgggaacagaacacccatggaagaagttacagagacaaagtttggagctgagacaaaaagatggaccatctagagactgccacatccgggtatccatcccataatcagcttcctaacactgacaccattgcatacactagcaagattttgctgaaaggacccagatatggctgtctcttgtgagactaggccggggtctagcaaacacataagtagatgctcacagtcagctattggatggagcttagggcccccaatggaggagctagacaaagtatccaaggagctaaagaaatgcgcaaccctgtaggtgcaacaacattatgaactaaccagtaccccggagctcttgactctagctgcatatgtatcaaaagatggcctagttggccatcactggaaagagaggcccattggacatgcaaactttatatgccccagtacaggggaatgccagggccaaaaaaatgggaatgggtgggtagggaagttgtggggggagggtatgggggacttttgggatagcattctaaatgtaattgaggaaaatacgtaataataaaaaatattaaaaaaaaaacaaaaaccaaaaaaaaaaaaaataaaaactatttcttcataggctagctaatgacagctgagaaagcttttatgccctttaggctggaatgaaagacttgcttcagccattaattctactgatgaaagggtggagactttccctgtaataatattcttctctcagcagttcatcccagtaatgctggaagacctctaccccaaacacttcttaaagcacatctgtaggtctatatatggggtggctacccctgaatgtgccctacaacttctttcatttgaaaacacgtttgcatttctctatgttgaaaatatcctgcttaacccagatggatggttttagggcaatggatgtatctttctatctcttggacatgctctagattaaaattctgctgatgctgtaactgtaaatataggttttacggtgatatgtagaagaataagccactaattgagacaacattcataacacaaatacagctcccttctgaaatatgtgatcattctactgttaggaaacatattctacagataattaggaaggcattatgggaaagaataaatgtattagacctgcattgcatttatttatttaagaaagagtttatattcataaattttaatttaaatgtcttaggacagaattctttaactagaaaatactgaaaaactgttaatgttatttagtttggagattcttccaatagttgctaatgcactgcccagtttttacttttaaaataattgcccctctctcagtagcacaattgtctcccacatatttacttcatagatgttttgtccccaaggaaatagcttaggtgacaatcatctcaagcatgatgaacttggtttattttgtagatttcagttcatctgctatgtacatcctggagcacacatacccttaggttcaaatatatttacactctttgtccttggatactggtattgtatttagaggttgtacagcctttagaacatgaggcctagctggcatatggaggccactatagttgggccttaagagttattgtctggatttctttctggccagaatgctctgcttcctgagcaagctctctgcttctgtatcccatctgtggccagcaatctcctgcttaaatggttcatcagccatacctccagcaatgaaagactatgcaccctatactataaacccaaataaaccctttctcctccttgtttctgtatggcattttgttaaggcaatgggaaaaatcaactaacaaacatacttccccaagatcatattttgtatttccaaaagtcccattcatctgtgtatttaatatacattgtaagagataaaatggaacccatatacacatcttactctataagaaattttactgttgttggggaataggctaagtattcaaataactctgacttaagaaattagaagagggcagggaagacgcagaagggctggctgaaccatgtaaacctatggcagggaatgggttgagttagatcatcaggctgaatgttacagatttcctaggcagactagagtagcaggaaagacagagaaacacaaggaagttactgaatgctgtataagtgcatagagagtgtcccagctgtgagcaaagataaagaggaattcctgaaggtaatgcatgagcagcacccagactgcaaaataacaacagtgtctcattcaaatctaaaatcaggttaatttcccccctagacctcaagacacactaaaagagttaccaacatataacgtgaatgcggatctgaatagttacagtgctactaacctaacccaagcatcataataaagctggtcttgacaatggaatttatttctgtaccttagttatgaaatcgtgaaggtgactctatatgaagggccttcttcacatgagagcacaaatctaccctgtatggaacaaagacatgattggaaaatggctagcagtacaggtgaaacataatatagcagtgttttcttcatgactttgggataggcaagtatttctcctgcagggtccagggctggtaaaatggctcaggaattaagaattggtgctgctgttggagcgaacctgcgtttgcctctcaacactgacttggtggctcatgacctcctgtaattcctactccagagcactggttgccctctctgtatatacacacaaacattcaggcacttacaccatatgtacattaaaggcttccctggataccaggcatcatataatgtaatatacagatatatgcaggcactgacatttacacagaagaggaaaataagtaagcctttaaaataaattaatacattgacacaagttctatttattaaagtactaaacacaggaaatgtagcattacacatctccaggagaagagatgtaaagatgtcttgatagaggttatagagagaagatgtgaggttatggcagtatggagtaactgtcacctctacaacatgtactcacttggaaattcagaggtaggttagcatacattttaaggtagttccttactttccacatacatggataattacagcatgcggaatagaatactagcaaaagaaaatcatctttgcagaaacatgtcaattccagtgctttaggctacaagtagctaatactcaagccaagccagtgtggcttaaacatccatttgttatctcccataacaagaaaatggagtgattggtcaggaacagggaggaacagacactatttattcttttgttcaacaggtaaagaggtcattctttagtctgtcccttctctttgctcaataacaactgtacttttcaaatctcacaaattagcacctaaagataatttttcttttgatcacaaaagaaaaccactgcaacccctgtcctcagctctaaattcagccctgccttccttgaatgatgagcaagcattgcttgaactgtctcttactacactagtcactgctacagggatctattttcaacgttgcttagaataagcaccagtcacttcctaaggttgctgctgatgagaaggtggggaccccatgtaaaaccagacgctacagtttcagatggaacaaagatgtgggagattatgtgttggccaagtacacagcagtatctgccacaatagagtagaaatgccacaacctgccatggctttacaagggactgcttcagtcataaaccaaagtgccattttgacattcatttgatgtggataagttgtgcctttctgttgacaaatagacgttgcaataataaataaaaacatgaactgtatcaaagaaaagcttatatagtaaattggaaatgcaagattattgaaggcttatgcttaatatgatgaatatttaggccattcttatattaaatgtgataattgccttaccaaatttcttatcatctttatttaagttcctcttcaaatatttcaaaaatatgcaatcacttttaacagatttaactcaattctctctatgatttttcaatgacacataaagtgttccatgtagacatgatctccatctttactatactatactattactatatcacctgtcctttatcagaaactggactgttttagatgtaaaagccctatttcctgaatgctagggacactaattatgaattaatattcccaaactacaaatttgcatctattctgtgtgtacaacgctaaagaaaaaccttgtgactctatacctgagaatgttcagtgtggctctctttctgatatgtctgcttcccattctttgctattctaggaaacaaagattcatgtcaccagggactttggggtctgactacagaagagcagctggataatggaaagagacaggtaatggttggaacaatctgatttggtctttgagacattccagatatagagacagaaatttgaggtgaggactctcaaaggagccgatgcaaaggcaggggaattagataatccacttcaaaacaaagtgtgcttgtacaaactgcaccacactcagtagggcaatactttttgagtttacaattagtaaattcctactctaggatgcaaaacaggtatctgtcctgggactgaattttgagattctgacagtctatcaatgatatattgtttaaaggactcttcttattttcacaaatgccaaatgctggtgatcctttttcagaagccaacaccgcatgtttcctgacatgtctcaactgtcaggcaatatccacttcaatagtcttctgaaagtctttctccatctggtcctcattaagctttagtagccaaagaaagacttcttccttctagaaactagagaccaatggggatccattagaaaaaaataaaaaaacctgtttctctttttatcccaccccctagatttccttttgtgtgtacaagactggaagttcttagcgtacctccatgcccacttacctcaagttctggggctagctcctttgcaaccagactgtaagtaatttcagcatcccatcagagagaatcttagggggagggtgtttgatctgagagaggtgggagaagctagaggctctcttcccccagggtccagaccttgccgtcctccactcacaaaggcacagtgcacgcccacaaaagatcctggcttgctgcaagtcgactcccacaggccagaactgggtggaggtggaggtgggggtggtaaaggagggctctggcatcacgtgcctgtgcaggcacctcaataaatgccgagtgctgaggagcggcggaagcgcctggcgccagggctctgcaagctgaagcaggaggtccccggggagtttttcctttgtcccacctcaccctagatctctggaacaccgggagcccaactctgagagctgctttcaggggcactttgctaactttgaagcccgtgcccactgctcctcccaggtttgctttgagtcgcagagctaggggctcgcgtccccaggggtcagccagctcctcactctgac

SEQ ID NO: 279 - DNA, 13255 bp, Mus musculus
acgaaatctttatccatataagggaaaatgctcctatagctgggtgattaagccatcagaagttatctttggcccaagggtgattgtagtgggggttatcttgagatagggtcttatagtgtaaaccaggctagtcttgcctctgccttccaagttctgggattaaaggtgtgtgctaccacgcccagctcaccattatttcaagggcttatctaggctactcctgttcagaagcccagacctgtttgtttgacatggggctcaactttgtcttcgttcacactgtttgtctatgctcttctatctcaaccctccatcctatttcttcaacccccttcctggagataccaccctctagacaagagtgcccaaaagttcaggtaaatagctatcagcaaggatgtgaaccatccctcagtgacaagacctttctctgaggactgtaggtgtcaccttggctcctagccatctctaggtgaactggctctggtgcttaggagctctagggaacccaccttctggtgtaaactttagccttttccccatgtgtctaactctgactgaaatgacaacaggccatcttcatcttctgttcttgccacctcatctttgagctggagtccggtgcctttggccatgaccaggatgaaggtgggcagttggctgtctctcacagattaaatcctctttaccaatggaaaaatgaggtccacatggcccttttctgaaaataaggaaacaaaagcctatctggcatgattcctcaaacacagcactagctaaccaggatggcagcgcagtcaccatttcttaatggagagtgtctgaatttgtgtcagcaaataaaaggaggccctcttgattggggtctaggctatgaattccagtggttgcttgcattcttttttttttttttaagattttttattttttaattttaagatttttaaatttttatttattatatgtaagtacactgtacttacattttaagatttatttatttattatatgtaaattacatgtaatttatatatattatattatatgtaagtacactgtaatatatatattatatatattatatgtaagtacactgtagctgtcttcagacattccagaatatatatatattatatatattatatgtaagtacactgtagctgtcttcagacattccagaagagggagtcagatctcattacagatggttgtgagccaccatgtggttgctgggatttgaactctggaccttcggaagaggtcttacccactgagccatctcaccagccccggttgcttgcattcttatgtgacatttaccctaacccattttgttagctgggcagtggttgtacatgcctttaatcccaacacttgggaggcaggggcaggtggatctgagttcaaaaacagcctgatctacagaggacattgctatggaaaagtgctggggatgagggggtgggccttttgtaaaccctgccctatacaccttgttttgcatatgccctgggacagatcactggctttggggggtggagggtgcttttgttgtttgctcagtatttccctgagaaatttccagacacgaatagcctccaccctttgaaataaccaccatcccttcctgcctctctaatcattctactagagccctacaagagttcaaccctctcctattgtgtctgagctgtgttgagagtctcaaggacagggaatactttggggtgaggctctttcatttcagacctaattaacaaaacatgctagagaggccaggattggtagtagaaaacctgggttgcatctcacctctactactggaactatacaacactgagtgtgtcacttagcttttctgtaaaacaaaagtgcagtctgggttaccaggagaactaagaacatggagcctaagaacatggagcagctggctcacaaaagcatccagttaacaagtcttcacacagccaggtcacagtagtttgttacatgaaggcttctgtggctatagagagacggctgtcttctgcagtctaaaagtgttttgttttcctgaaaatttccaggttgatcttatcatagtttatgaggctttttgctttctcccaggattttaatgactcctggccttgtcttttatcagctgtcactcacacaaaccagtcttccctcaggctggtcatgcagagctctcaatggctttttaaaattactgtattttacttatttggtggtgcagagcacacatgtgctacagtgcacagatgtgggggttaggataactcgaagggatcaagtttctccttctaccacatgggtcctggggatggaactcaggtcttcaggcttggcagcaggaaccttgacctgatgggccatcttacaaactgacctatttccttttttaaaattttacttaatcagcagaattactgaatagttttcctgcagtcttaggttgcagtctctgttatttacctggagttatttactccattgccaggggcaccctgacagtgaatactgtatgcctggaattacaatagccacccacaggtactccaaaggaaaaatgggttacacagttttacattgtcctaacagatgtactaagtcatctgtatctagtagcaaagtcttttatgtgtacatcatctgaattctgaatcctgtctcagttctcatgaggcatctatcaatcacacacactggtggacagataggcagacttaagacctagaaagcttgaatggctcactctaatgatacactttagggctttagtccaagtgttctggctcacagattgctggatttatctggaaaaggaaaacaggacaataaatcaagtttcaccaaggcagaaaagttggttttttatttttaagatttatttattatatgtaagcacactgtagctgtcttcagacattccagaagagggagtcagatctcattacagatggttgtgagccaccatgtgggtgctgggatttaaactcgggacctctggaagatcagtaagtgctcttaaccattgagccatgtctccagcccagaaaagtttacttttgtatagtacattttatgcaccatttgagatgttaaattttttaaaaagatttatttattattatatctaagtacactgtagctgtcttcagacacactagaagagggcatcagatcttattaaggatggttgtgagctaccatgtggttgctgggatttgaactcatgacctttggaagagcagacagtgcttacccgctgaaccatctctccagcccaagatgttaaatttttatttgtagtttatgtttgttgaggaggtgcacatgtgccatgactcatgtgtggaggtcagaaaataggttgtaggagtctgttctcttcccactatgtgagtcccagggataaaactgattatcaagccaggtagcaagtgccttttctttgtttgtttgtttgtttttcgagccagggtttctctgtgtagccctggctgtcctggaactcactttgtagaccaggctggtctcgaactcagaaatccgcctgcctctgcctcccgagtgctgggattaaagacgtgcgccaccacacccggcctgcaagtgccttttcttgatgagaaaccagccccaggatttttctttgggttgaagatagtattgagacaagatcacatacagcccagattggccttgaattgaccatagcccaggatgacctctgcctcctgatcttcctgcctccatccaggtgctggagtgtcaagtatgcaccacaaagccaggctgtttctggacacttgggttttttgttgttgtttttgagacatgatctggtgagatcacaggtctggctaacctagaacttgctgggtagtccaggaacttactgggtagaccaggctggtcacctccctcctgagtgctaggattaaaataatgcaccagcactcccagcctaatatcctatagctatctcgtttgctctttgatccctattactctgtggtattctgtgtgattcttagctgtggctctcattgtcacagcttgaagtgccccctttcccttcccttaacaaagatgcttattaattcatttttcctgtcttaatctttaccagaaaaacttgcccaggccaaagaagagaatgtgggcttacatcagacactggaccagacactaaacgaacttaactgtatataaactaaaccagaagagtactgttttaacaccaactccactccagagagtgtgccctgtcttcctcttttgtaagaagttccgcttattaccaggtttccaccttgcaggaaatgccaagcagataatgaattcatgaccaaatattttgtgttagacaagctttgagcaccagttaagtttaattctttccttttccattcaaatggcaccagcttctctgattattcttattcttaaattgcatttattcctaaaataggcagggaatttcacactgagtatagttgcttaagtctgagggcatttggttcttgggaattagtcagccccacactttgaagcacaggctcaagtatctaatcttagctggttgctgttggggaagttttgtgaggctaggggttgtcacaagaaaatatgtggaaattttccacccagagcaaaaattaagtctcctatgggaagttataaagcacaactagattagcctgatcatactgagtctgctccacacggccctgtgcagaacagattgtctttaagcattccaagcgagaatgctggggtgatcattgttgcccatgtgccttctgactgagctttaatgctgttccatgttacatctttccttcactccagaattgttctctgaggagcaagcgtcttattccaggacttttctgctgtggtctaatgatatacccagcagggaatatggcagagtccaacccttttcagccagggctatacggcgaaactctgtctcaaataataaaaaggcttagttgccttcaatacattgagcattgtactaataccaagtgttgggcaacaaaaggtctctccagcagcaaagtagtgatagaaaaagaaattggcttaacttcatctccattgttcagggaacaacaaatggaagcttgactttgccaagacttgaattccttcgggaatgacactaataaaagaccaagacctcctgattgaactggatgtggagtgctctgtaggctgcacattttttggctttgtagttttcctttctcagttaacatctcacactgaaacattccacattccccagcagtgcggggccaactcaagtttacagtcctgactgaaagtcaccctgcttctagcttatctgaaccctgcccctcactcctatttattaagcatcacactaccagggagatgaactttgagcaaactgcaattgataaaatctactctgttctttatgttcttgctattgtatcatacgtaatagtatcactttttctacattttggtcaaataaatttttgcataaataatgtgtctggatttattcttttagttgacagttttgtaggtatatataatgcattctagttattccacatacacattcttatctctttcccattcctatgtatcctacctccatcaataccagtctctcagtgtagaacattcactggagcctggcaggattccactggcaggtacacaactgaaagcagtgactactccaccttttctgaatctatcatcaaactagttctgaaggatgggacccccaactccctcctctatcaacacctagctattgattgaacaactttggttcaacaaatgttagcagaatgttaaggtgactgtgccaatagctcaacaagtaacttctttttgccttacactgtgactccatgatacaaagacagttatctccatacttcaggttgggagcacatggcctctgttactcagaatgtctggccctttgttattactaatccttcctaaactagactgagccaaatgggaaggattttaatagatggtgcagtggttctcagtgggtggtgacccctttggggtttaaccccttttcaaaggggttgcctatcagatatttacattacaattcataacagcaaaactagctatgtagtagcaatgaaaattttatggttggggggtcacaaaatggggaactgtattaaagcattaatcacactaagctgtatcacagcattaggaaggttgagaactactgagatggtaggagaaaggtttatgctgtcctagttaggagaaacctaaggcctgttgggatcaggctttttctgcattgcacacacaagccaagcagaaaatagaagagtgaaagtgaggctggatccacatgataaaaacaaacttaacttgatcagaaatggaaataaacagcagtatcaggaaactggttaaacatctatttccaaaaatactatggctggttggttttagaggcaggaaggcaaggtaagtaaatatcactgaaccaggatagggcctggcaggatggctcagggttaaagtgctttctgtgcaagactgaccaccagaattggattcttgccttggtataaggtgagaatcaacttccaaaagatgtcctttcagggctggagatatggctcaagagtgaaaatcactcgctgctcctgcatagaccaatactgagcagcttgcaacaccacctgtaactccagtttcagagaatccagaactgcttctggcctcaaaagggcacttgtgcttataatacatatacagataagcaggtatacacactagaaataaaagttgtcctcctgactccgtacattcaccatggcatgcatatacctctgctcacacatgagatcatctgggatggtagctgttacaaaaaagaagtgattcttcctgtttggctatgcagtagggacacggagcaagagcctgtcactatagtttcaccaccactaccacagttgctttagtgttttgcttcaaaatcttaccttcaagaggatttggaaaaatcctgccaggccctatccgggtaagggattgaagaaaatgagtagtttttgttcaggtgtagtgttgcaagctagcctaggctggagaacttgactccaaaaaagaatcaagtggggtggtacaaagtcccagcactcaggaggtagagagacaggcagatctaagtttcaggccagccagagataaaattctctcctttaagaccctgtctcacgctggagagatggctcagtggctaagaacattgactgcttttccagaggtcctgagttcaattcccagcaaccacacagtggctcacaaccatctataatgggatctgatgatctctccggtgtgcctgaagacagctacagtttactcatatacatacaataaataaataaatatatctttaaaaaaagatcctatctcaaaagagctttcaaaacattaatgcaaagtgcaaaacattttaaaccaaatttaattaggagcttccctattccaagtggacattgaggttagatggtaaagacaatgtcttcaaatggtagaatcctctcctaagtgccatactaaccactcatactgatactaccccatcaaagcttcatataggtcttgtctccctcctcatcccactaagttggattctaattaaactcagataattttggtcacctttgtgcctcagcacttaaagtgtcagctttatttaacactacaatgggagaattggagccaataaggctaatctcaggtgtgactattgctaattgaaaactttccccagtatccctggtgaggacttagaatatagtcaggtttgacaagctttgacagactctaagaaggctgaaatatcaaaaaggatccagtgtttgctgacttgtcccagttttgaggagcccccccaggatataaagtaaccatcaagaatgagcataccagagtggactctaatgcaaaccataaggtggagagtaattgaggaagacacctgacaaagccaacctctagcctacacacacgaatgcacagacatatacacatacacatatatacacacaaatgcccagcaatacacaaaaagacagatataaataaaatcaggacccgagagagattataaaaagtgccaaaaattatttcagcttcacttataacttagaacaagatagtctggataatgaccagaaagcaattaaacacgggcaatggatgggtaattttttttaacactatttgctcatttattttgtgtgtatgggtctgggtacatggtgcatgtcattagaatgtttacagaggtcagaaaacagcttatagaaattaagcctcaggctagagagatggctcagaggttaagagcactgactgctcttccagaggtcctaagatcaaatcccagcaaccacatggtagcttacaaccatctgtaatgagatctgatgccctcttctggggtgtctgaagatagctaaagtgtacatatatatatatatatatatatatatatatataagaaagaaaggaagaaacagagaaagagaggaaggaaggaaggaaggaaggaaggaaggaaggaaggaaggaaggaaggaaggaaggaaggaaggaaggaaggaagaaattgagcctcttcttctaccacttagttttttaataaaaacttcagtatatttaataaaaatactgactgatggttaaggtgagggtaagggttagaccagtgtcttagttagggttttactgctgtgaacagacaccatgaccaaggcaagtcttataaaaacaacatttaattgaggctggcttacaggttcagtccattatcaccaaggtgggatccaagcatggcagtatccaggcaggcatggcacaagcagagctgagagttctacacgttcatccaaaggctgctagtggaagactgacttccaggaactagggtgagggtcttatgcccacacccacagtgacacacctactccaaccaggtcacacctattccaacaaggccacacctccaaatggtgccactccctggtccaagaatatacagaccatcacaaccagctttattaaatattaaataccgaccaaaagatagactttggtaaggaacattcccaggaatttcccacctgagaatggccccagccatgtgttgctggggcttatacggacaaaactacaggccaccatactttccaatgaggtgttcttttccaagaactacaactcctggcattccacggaagttacctaactcctggggcaggaggtgtttacagggtattacaactacatttgatagcaagcacctttaatccacagagccacctcacttatccttggatgaaaaatttagaattatccccaagaagatattagaaaccacaggaaaaatcatccagaaaatgacaatcagatggaaagaatctggcagaacacaaatattgaactacaaacaaaaatctacagatgtctgcagtggtggtgatgattcaatagagaggcaactcacatgaagagagtaccaagaaaaaaaatctatcagaggcaatcaagagaagcaactaccacagattctgaggcctagaaagtggacatcagttctaatggaaacttcccaagcagagatgaatacaataagctaaataaaactgagaagaggaaaggcacagtctagcttcctgcatgcccttggatgaatctctgcctttctaatactccagagtaacttaaaagttgctactgagaaataggaaacatagatgaaatctttaaatctttttttttttttttttttggtttttcgaggcagcgtttctctgtgtagccctggctgtcctggaattcactttgtagaccaggctggtctcgaactcagatatccgcctgcctctgcctcccaagtgctgggattaaaggcgtgaaccaccacgcccggctacatagatgaaatcttaagtcccccccccccctaagggcctccaaccactaggttccacccaaagaacactctccttaatggctggacctaacccccatgcctcaacagtgtaaaaaccccaagctctggacttgaaaacccaccaatccccaccctagaaagttccaccatggaaagctctgccccacaaagccatttaaatcctatcctctgttcagtcctttgctgcttctctccagagcaggggcaactacccttctgggttctttcctcccaatttatctcttgtgtgaggtttattgtgcagagtcattttgcagtattccttggctcccaactgccaggatacctttctctccggagctggggaaatattccccagccaaagcagagctgtaacacttccgctggggaagcctttcacctcagagctgtaacacacaaatcctagctattactcagtggtggtctgaggctcagcatcaaagcacttgcttggcatgcacaaggcctctttgttcttacaggtaccaatctgcaccccaggggcacctgctgaggtttccaggcttatatgccagggacatgcagtaaggtagtaaaagatagtttatttgatacaaaaagggtatttgggctggagagatggatcagcagttaagagtactgactcattttccagaggtcccaagtcccagcaaccacatggtgactcataaccgtctgtaataggatctgatgccctcttctggtgtgcatgaaaacagtgtttatatatactcatatataaaataaataaatcttaaattaaaagcgatagtgttcctgacaatgagtgtaggcttatgaacagagaatgggcacccctcaaaagcactgggtgacaagactcatgaccagctcctcctgtatttgtacacagtggccttattattatttttttttttgtacatggtatttgttacagatagtccaggtagaaaagagcttccagtccttccctggcaactggcattttgtatgtcatcctatcgagctgtgtgttgtcatcttacatagtgaaaggtttttaatttgggcttccacggggatactgagacagattataagagttattaacaccatagacagacaagcagcagcaggtcaggagttctaagagttcagaccctgtggccagaggcaggtagacaacagcatgtcaggaactcagaattcaggtccgtgtagcagaatagagtgggctttcttacaggttttacaaaaaggcagcggttccatgccatgtagttgaatagtccactgtaagaacttgcagttgggctgattcccagctggcataatgtagggaaagtggggagggacccatttagttaacgtttcctctagggaagaagcattagataacttggtgtgtgttagcttgaagcctgcatgcataatcagctttgagaattgggagacactgggctggcaggatgttcagagggtaagagcactgactgctcttccaaagatcctgagttcaaatcccagcaaccatgtggtggctcacaaccacccataataagatctggctcatctttttttttttttttatgtataataaataaatctttgggccagagagagcacgaggggggccaaccgaaagcagggttgacaggagcaagcagaggacctaaaattcaattcccaacaaccacatgaaggctcacaaccatatgtacagctacagtgtattcatatactaaaataaataaatctttaaaaaaagagaatggggagacacatctgaagacaggcttgacctgagttggtctgccagtaagtacttcacctcctgagctatctcctcagccctcatatatattatacacatgtaatattttaattacatgtatttacttaagatgtgcttgcctgtggtggtaaaaaaacaatttgtggaagttggttctcttcttccaccatttgtcttcattaggatctaacttttgttatcaggtttgacagcaagcatctttatccacagggccatttctagtgttgatctttcttatttttattatgttttaatgtatatgaagccaccatgtggttgctgggaatcaaactccagacctctggaagagcaaacagtgatctaaaccctgagccatctctccagctccttagtgttaatcttgatgctgcttcccacagatttatatcttaggggtggggtggaggttccaaaggacaacttgcaggagttggatctctttccagtaagtatgcccaggaattgaatacaatcctcagatttagcaacaaatgacttactttactggctgagccatgtagtcagcaactcagatctttttttttttaatttatttattatatgtaagtacactgtagctgtctttagacaccccagaagagggcatcagatctcattactgatgattgtgagccaccatgtaattcaggacctctggaagatcagtaagtgctcttaaacactgagccatctatccacccccccccactccttttttctttttaagatttgagtacactgtagttgtcttcagacacaccaaaagggggcactggattccattacagatggttatgaggcaccatgtggttgctgggtattgaactcaaggcctctggaagagtagtcttaaccgctgagccatctctccagccctcagatgtttatcttaatgtggctttattttattttgtcactgttctcccgttactccgggactacacctcaacatattaaaaaacagaagggaaaaaaaaatgctactctgaaacctaggaaagtcacttcacctgtcttcagtatacttaccataaaacgaggaaaagattacctaccaagccgggctggtgtggggtgaaggaccttgacttatttttaagtatagatagcacccgcaagcacagaaaagaaaacaaaacaaaacaaaacaaaaaacgctgccattacttggaaatgataacatagccctaccggcgctgaagccctgggatcgctcacggcaatggccggcttgcctgtacagcacctaagtaagtccaatggtgggcgccaaggccgaggagcgagtctgcagcacatcttaacccgcgccacttttgcaccgccgaaaatcctcctcagaagcattaccacaggtacttcctgcgcttcgcctcagcgccggctgcggctacggctgctgctgcgcaggcagagaaggcgggaaacac

SEQ ID NO: 280 - DNA, 7318 bp, Mus musculus
actgaggtggggccacctgcggtgcagctttcctacttggctggcttcttttgaagtgtcaactgccctgagattctgctacctgctgagaagctgaacctgtcttcctgagacattcctgaataagcaacagcctgtcatgtgctgacggcatggtgacaaaggaccaaggatggactggccgggtgggggtgggggggatggggagggcgggggcgggatgggtcttcccccttataagcacagtctcttaaactcgcgggtcttgatcagagaaaaatttgtcttggcttcatcattcttttcttgccatctagtttctttttcagccccagcctgccttccagaaatacccggttcatgtaggccgagggccggcctcctactacagattggcgccatgaatgggaacctgggaacggcgggaaacactgagggatcgctgtcttgtgtggagctccatgagaaggaaagaataagaagatcgtattgggcacagtgagcaacaggtatttttgctaactgtactcatagacgggtcgtctaatgggaaagcagcctatgtaattggatcacatgcatattctcttgagttttcctccacttcaacacaaataattgaattacatgctgtagccactgtttttgaaatgttgaatattcaaggtttcattttgcatactgatagccaatatatagcttatagtttgcaattgtgtgaagttattcttctttttgacactggtaattctcaaattttgcaattatttatgcaactacaactcaatttaagagaatgtattgttccttattttataggacatttaaaactcatactggattgtctggacagaccacttatgacaatgccatagcagatttgtataccaggcagatagtaggccttacacaggaaaatttggctataaaatcttattctttacatcatcaaaatagtaatagcttgagacaataatttgatatttttagagaatgtccatgtcaaattgtcaagacttgtcctcaatgtcctaaatttctgtctatatcaaataatgctgttaatcttcgagtactttcacctaatcaattattgcaagtggatggcactcatatttctgattttggaaaattaaagtatgtacatggaacttgacaccttttcaggctatctaatatcaactgctttaatgggagaagcaactaaaaatgtaattagtcattgcctgcattgtttttttatgcttggtgttccaaatcagatttaagcagaaaatggaactggctattacagtcaagcatttgagaagttttgtagataatttaatattacccacattgccgggattctttatagttctaacggacaaggtattgtggaactttaaaacattattttcataaaaaacaaaaaagggggaattatatccccatacacattatttgaaccatgctttttatttaaaaaattttaaaatttggaagagaaggaactctctgctgagtgtctatggcaccctacaactaggcatacttattatgcctaggtgaaatggaaggatccactacttgacatatggtatgatcctgattagatatttaatatggggaggaggacatgtttccccacacacacacaggatgccgcaggagtgtgctagctgccagagtggttggtgtgacatgctgatgctaggacaaagaatgatactgacctgtgagcttgctgagtgccctgaaaatggagacagaaaaattgtagtggttatatgttcttggcactattttgcttgcctatatcccagattggacaagttgccttccttcaagcttttagactttgttggacagagaacatggagactgtggaaactgacttagaaaatttttcaaatggagaagttataatgattccttcacctctttggttgtgttttcttttaattctttaagggctttttgtttcctctttgagggattctacctgtttacctatgttctcctgtatttatttttctttatttaatatttatttatttaatgtatatgagcagcctgtttttacacaccagaagagggcattaaatccaattacagatagttgtgagccaccatgtggttgctgggaattgaaatcatgacctttggaagagcagaaaatgcttttaatgactgagccatctcttcagctctgttctcctgcatttctttaagggaattacttatgtccgtcttaaagtcctctatcatcatcatgagacatgattttatatcagaatcttgctcttttggtgtcttcaggtatccagggctctctgtggtctgagaactgggttctgatgatgctaattagccttggtttctgttgcttatgtttttgcccttgcctcttgctatctggctatctctggtgtaagctggttatgctgtttctgaatatgccttgctctcttgcatgcccgtgagtcaatactcctgtgagaccagttttctcttggagggatttgggtatggagagctatggcacagggtcagctttagagtgcagatgacaatgggaatgatcatatccctggctgttccttggttcctgtgtcctgatggctctggcagggttcctcttgggccaggaatttgagcagaagttgaggtctcacttttgctctcaggtgtgtcagcactcttgggagaccagctctcttccagtgagatttgggtattgagagctgtggcacagggtcacttctggacagtgataaaaactggaaggtgggactgtatttctattagcagattttagcaacaggctgagatggtataatggaaaggaagaaaaaggggatcctctttaataaatatttattttatatataagtgtgtgcctgagtgtatgtatgtttagcacatgtgtgcagtagcccttggaagaggatgtgagagcaagactttttcagtgactgaatgtaagaggtgaagaaacgggcaggcagaagtgttgcctgtggtctctgacttaagtggcaggggaatgagatgcctttcttaaactgagtcagaaatttataaggtatgcatcaatacagtgagctcagtgttttagaattatattattttgcctcaaatattaacaaaccaaccaaccaaaccaaaccaaatcactacccaaacaactttctataatgtatccctaaattatgtgtctattcttggtagaaaaaaaagtcaagccaatcaaacttttgaacaatctctaatcaaattatattgtaaaattatttctgggacatgtgattctgattttatgaaactagggtgagaaagccagcataactatgggagtatgccatggtgccatactatggcagggcatagccagggacagttctgagaggggatgaggtcatctcgcccttgcttcataaacacagggagcagagaggaatctgtgggtcttgtgacctcgttccacttaactctttttcagagccttggcttcaggagcacaaagatggcctctgaatacaatgacacatttgtaaacgaccttaatagaatgcattttggtaaagaaagaatgaagagcaagtaaacagcgaaaatctggacacataattgttccaatcatttggatgattgcaacatagatgagtagagattcagagtaaaatatggttaagggaagttcaatctgaagaggcaagaagtgttgcaggaacatagtatttatactataatattatgttatattattatagtatattaaaacagaattgatctttgagaaaaaacaggggagactgtgtctttatgaatctgggatttatacttacatagtaatttccagctctatccatttttctgaaatgtcatgattttatttttctttatgggtggttatataaaatttgcaaatgcaacacattttccttgcctattcatctgctgattgacatatagtcattgcatatagtgctaaagtctgcatggttgtacaaaaacatcagcgataggatataatggctttcaagtgggtgtataccaaggagtgattcacctgggtcatatggtcttcatgtttcaaattcaccaatgtcaatccccaccaagcatgagtaaaggtccctctttctttacatcctcaccagcatttggtgttgtgtgatgtaagccatatttttgctaacttggtctcatggaagaattgtaagaataacctgcaatgtgtgaatctattcttctcaaactcctttcttcctctccttaactcctttccatcaatatgcttgagacccctaggttgtgcctctgaatgatgggctaaaatgtatctttaacatactttgctttttgttctctgaaaaaaagtcaatagtctatagcttcaacaattctttcttaagatgaatgaaatgcacataggtagaaggggtttcatgagacaagaggtgtttcagttatattgaaatataaccaggtggtatctgatttaaaaaacaaaacaaaacaaaacaaaacaaaacaaaacagtatcttcctgggcccagaataaagacagttgctgccaaacatgacaagaggagtttgttttgtaggacccacaatttggaaggagagaacccattcccacaaattttcttctgatctccacattcacatgactgcacatacatacatgcacctatacccctttattaaaccataacccttattatgataaagatgagttgtgggttttgagttaattatgccattaacttatattgataataccaagagctagttccttttttttttcctgtaaatgttgttgattttctcttttatattttatcctaggtacttaattagagacttgaatttcttcaggcaatttgaagtatcatttcagaaatcttctacatcagaaaaaatacacaaatagagatcaaaataaaaccagttttatttatcactatgataagttaataaaattataaatattaatattggtagcttttcacagaatgggtgtgcttaaagtattttttagaccctcttgaagttacttttgagttcatgatgacatgggatatgctttaaaaactcaaaaatatcttttttattcatgttatctttcaaaattttgttatagctgctgatgaggaccttttgttctttaagatacaaattgtggtacctacaataatacaaactagaacaagagcgcccaaaacagacagcacaatagtagcaacactaactcctgataaacttggactttcatcagggtcaggctctgcctgaggggtgaacagtgccacttgtgcgatgttggatggtcccgaactcaaactgcttttgtcgacactttcaatggcaatgaatatgtacgttgcattttcttctgtgatattttctggtttaaaggcaaaggtttcctcggagttggcttcttttggtgtaaggttagttgtatcaacccgaggagagttattaaaattgtctctcagttcaatgatgtttttgcttgttcttatgatatactgttgaactgacaaaaatgttatgtgtgggttagttactgcatcacaccatattaaatttctttctagttgttctcacaaatactaagtcatacatcaacagtcttattcatttttctgtaaaagctgagttctgaaatttatttgtttatttatttatttattttggtgtttcgaggcagggttcaacgctatatcccagctgtcctggaactcactgtgtagaccaggctggcctcaaactcagaaataagctgcctttgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgccaagtcctgggattaaaggcatgtgccactattgcccccactgagttctgactttaaaagacagctatgcagggaaagtaagacctgtttcataacatcctaaaattcctacttgactgagttgtcagtcataagtgctctcctctagctgacctatctgttcttgcttcatcccatctctcacttaggtcaaacccagaggggtccttgttcttacctcttccaacatcataatcatctcctggggccgtccatgttagactgatctcttccccatcgagtgtggcctggaggtctgtgattcgatttggtgggtatacatcaggcaatggaccaattggaacattggacatcacaaaggcacctccagatgctgtcctgctgaaatcctccaagactggctgagtagcctcagtcgtttcgggtctgggtgggttcccttgaatttctcctgcatttaaaattctctatttaaattggatggaactgtaaactttatagaactcagtcagtcagctttctgaccctccttgtctttccttctttctattttcattcccatggttgtatttttatgatatgctacaatcataaatattccatttgtgggaaaattcatcctccagaattattactaggatgttatcaaatcaaattggacaataacttgctttgaaatgaaaagttcatggaatgaggatgttatgtaatttgttatatgaattaacagaacaaaacagatccaaagtcaaacaggctggcatgaaacctaggctagcctcaaatgtacttatgtagacaactatgaccttgaaatccgtatcctccttcctgcctctgttccctaagtcctgggatcacaggcatgtgtcaccaggcttccctaacatatgccttaagaaaactattgctttatttctcaagttatttctgactagaaatgtgtctggggaaggcaaagctagttgtatccttaacactcgcatggcttccttccctccaagctgacagtgctaagaaacaggtctctcaacttctccattgcttagctccccaccctccacataaggagtgaggaaagcaaagccaaaaaacatggatgcctgtggaactcagaggacagactgcccactggtctgcacttctgttcctagcacaatgaccatttcctctgtcagtagctgaaaggtagatacattttggtgatagtcaaaggatgttccacagtaacaaatactagctgataggttttcagcatctattggttgctaggttttgattaggaaagaattgtgtaataatctcacaatagaaatgtttgtagttacattttgaactgtttgtagcctccaccatatgaaatc

SEQ ID NO: 281 - DNA, 6739 bp, Mus musculus
agtgcagcagcgtcaccgggaacacgaacaccaggtgctggtagagtgtcagccccaggcaaggcagaagctgctttacggaaggcgagaagtccgggtggatcttgtagcgtcgcaggatggggacccagggatacaggacgtccagcaccacgaacggtaggcagaagcccacgtaagtgatgatagaaaaggtgactgggaagatgggtgagcgcgtgaacgcctcccttgtccttatggtgtcccagaggggctgcaggagcagctggctggaacagcccaggtcttggagctccgaaccgttgtagcagcccatgctgagactatgtcccacaattgtggtctccccagccccgccgacttttcttaagactgtggccactccccccagtgacgtcacccttccgtctccttcccacctccctttccctgctaaagaattttgcttaaataacccgaattttgttcctgtctatgtcctggtttatagctgcatcaaatctccccttcacgcaagcagcggcccttaaagccctttcccagacgtaaagaactgtttgcttgcctttcagctgatgtactaatgacacaggagagagcgattctgccttgggacagttcacccgccatcaccgctaaaaactaatgagttcttcgctctcagaaggcgctgtttctcaaccaaagcagaattccctgggttttaaaatatctgtttttgactgtttaaagacttattctacaccttgggggactctgagtgtgcgtacctcacgccacagtgctggtactgggtccgttgcagacagggattgagtcctgtaggagagggaacctggcatcctccaaaaaagagcagtcaggctcgcagccttttggcgcggacgactctcccgctctggtgcccttaaagcccgcggtgtcaagagcagagatcagatcctgcaagacagcggtcaagagggcagcactgccagcctttgctctgggttggagaacggaggcttaacacccgtaaaggctcactcgattgggccaaaccgcaaaggccagtggagaagaagatctgagcaatctcatagcctcccggaacatgtctcatctcccctgccatttccttagaggtccctcaggctccgacttttaccaaccctcagttgttccctactcctcaactcctggataccctttcagacactgggactgatcgtccagggactgagcacaggaggtcagtactatatccaaggagagtgccctagagagtggagcacagaaatcagccccgggtagcggatacacggcacagaagatcccagaggaaagccaggggccattctcccagggtttccttcttgaatttgtgtctttacagctgcttttctctgctggaagctaacatagtcttatacaagcttgtgtttcttgtgttattttccaaagaaaacagggattgtagctctaggagcctgctgccagtcccccctggggggggggagggggaggggatggactgtaacttttgcctgcacaagactgttacttgtgattcacactcatcaagaactggctcccacatttgtcaggaagtaccccataactgtggcttcacagctctctatctaaggcctcagcacataccaaaggaaataaggcacacaatcactttaactttgtatttcacaggtaaccactaagatatttggaattaaatgcaaatagttaaggttttttttaacatgaagaaaagataaaaggatataaaaaacaaacacatatggtaaaaatatggtacaataaatgggtccaacatatacccagggtgtgtgtgtgtgtgtgtgtgtgtgtgtgtgtgtgtgtgtgtgttataataaacaggttcattttatagagagaaaacatacatacacaataggtaagttcatgattcaggctcttcccatttggtagatgttccagagttatcactgttagaggaggtgcacgctcttcattcattctctagggcctctaaactgtagctgtgaactgtatagcagcctcagaaaaaaataaaaataaaaacaattttataagactcattacagccattatggaaaccagcgtggggttgtctcaaaataaaactagcatatagcccagctatgcactcctggccataaactaaaggactccacatcctattgatgtacaagactacaccaaagagctagaatgggcatgaaaagggatttgtataggaaacacgaagtcactcaagtggaatttagctaaaggcgtgcttgctgccttcaaaataccccaaagatagtctgctaaccagacctgctagagatgagggacgtttaggatgctgtaatataaacgtttactcactaggaccgaccagccattagtctctgattcccatgctaaaggagaaagctggctgactcatgcccagccattaagcagtgattcccattgcaaaggcatacttctgaaaggacagctcattcatggtgggtagtgtcaggatacagctaccatgaagtgttggtctgccatcaagtcccctatgctcttatcaggaaaagcatagttctgtcaggtgcacaagatgactcgtggtaacagccatttgaaaaagaacaatactgatgtacttaaaataattctgaaaatatataatacctttgctgtgtaaatttccctgtctcctaagcagccagactttgtagtctcctgtctgtgtttaagtgtaacctggggccagacttgaaagagatttaagtatggcagtgtatataaaatgcatatgcctatatatgtatatatacgctaacaaaatattctatgggagcctggctcttgcttgggtgttagtccagtcagacaagtcaagtgctatcaaagttattccttcatttctaagtatatggagtgatttctcacctggaaggtacattctttctcctaacactaccacagagatgcctgtctgtccatggtcattgctgccctgttcacaacagcacagaaatgagacgcccctggatgcctatcaacagatgaatttatgacgaagatgcaatatgaacccatgatggattcaggtgtaaaggagaattaaaatttggaattggcctggaaagtgtaacattagacaaatcgataccaactcaaaagaacatgtttttttcactcatatatatgtcctactttgtaatgtgtatgtgcataaatgggggtaaatggaagtaacgcttagaaacctagaaaagaggccaaaagagggttaaaaaagaggtgctggaggggtggagggcaaagggacatgtgtgacgttaaaaacagaaaagagaccagggagagttacagggagactaggggaggtaaagaaatggcagagatgagaagagaaagagaagactttgtcagaaatcattaccataatatctaatgtctggtatgctaatattaaaaaaaagactataaactcactaaagtcctcaaaaaagaagaagaagaagaagaagaagaagaagaagaagaagaagaagaagaagaagaagaagaagaagaagaagaagaagaagaagaagaagaagaagaagaagaagaagaagaagaaggggagaaaggaaggaaggaggagaaagtgaaaagaagagagagacagagagacagagcgacagaaaggttccaacatgccataggaacattgtgactctctgctggtgtatctgtcattgctgaaacaggagtaagaagtagccttgagcttcttgatgggcaatgcacaaaaggaaagaagacagatttttcttatgcttcctggatggctaacagaagcaaaatgggaggcggaggggtgtgggggtggggagagatgcaggtctctggcctccctatggattgatttcttccagtatgataataacagactccttaattcctcttacaagttacaagcccatgctgtttccactcacactgttagggcaactttcttctttctcatccccagggaatgtggtcctttgatgcacatctcagagaagagaggaaggtttgggatttgttcacttaaaggggaaaagaaaaaagaacttcaatgtgggccactcaaggttccaatgggaacaccagagctcaggagctcaggaactcacaatcagggttacaaatgtgtcatgacagttacaaataggttgtactcagcagacttacctgggtttctgtgaggcacacgttgttctttgcttctgccctgtttttcatgcctggatgtgttagatctgcttgaaccctataaaagataggtggtgttgcttgatttacatttaactcttatctgtgctgacaagactttgtggtgccgactcatgttcttgctgtttcagtggttctgtcctctactactgtatatttatctctccgtgcttaggacatcaaacctgtgaagcaaagcctggagccaggcctgcaggatgccctgttcccatgcccctgctcctcaagacacgttgaagaacagctgccctcctccagtccctgcccatgaagttcacgggacggacatcgtgcccaacatagagatgcaaccatctcaaggagttaagtggttacagacatcacagcctgatgctagagaagcaggcataatactccagatgactaaacaacgtttaataagccaaaacaaagtagagccatgtgctaaagagaagcggttccttgaatttgccaagcctaagggagtttctgcagactgaaaaatgtaatagtctccgagtgagtagagacttttagagcaaggatcttaggatttatttctacaaatctaagaaaatgtctgtcctctctcagttgctcactttcttctccctcactggctctctctccctcgacaaggctcgtcccgcccccgccccccccaccatcccccccactcccctccccctccagtgaattacagaggagcctggataaacctaacccataccaagcactcactttgtcattgacctccaacgccctcccatcctaaggaatgctcccaagatgctgcatattcattttcaaagatacaggctcaaatttgaagattaaaaataggtttctgcatttcgatatttattaatttttatgtgtttatagagaacactagcagatgccatttgggtctgctatttagggacagttgcacacgcgagtggctgttttataatttcacatggtatcagaacgctgtactttgtacttttccatttgataaagagttctttatcatgtcatcttggcctgagccctctgacagcctttaaagacaagaatcccatctcctccagttattcccaaggtccaaacataattaactccgtctcagagttatttggtaccaactaatcaaaagtctttgggaagcctcaccaatagggcatgcagctagccagcaaagctaatgacatattctctttaaaatgggtatggtgacttatttacttacttatttgtttttgctttcacaagtgagactatttaggcagatgcttgactgaaacaactatatatcagaggttataagcaaggcccaaagaggtggaatgatctcaaagattgcaatatgacatcacatttcaaagatgaggaattagtcagtctcagatatgccaagaatagccctgattagcgacaaagtgtcaattacagctgatggagagttatgctcagtgtccgttcttagccagccagggttgctctcaaaaagaactttgaagtgcttcttcttcttcttcttttcttttttgtagtaattttcaaaggactgagggaccattaattaaccttgaaagtaatactagaagatgctaatgaagaatccgaaggattgtcagctcttcctgcaaagtctccgagttaccttgatgctccagtaacccagatactgctgcacatggcttcgacctgtcatatagtgtataagttactactgtccatactgatggaactattactggcctctctgaagcaagcatatacagtcactcctaaccaaaaagtcatcctatgcctgtaaagaaagaaaaatgtcaccagccccctagttctctccccccccatcaacatgatcaaagttttggaagaacacattgattaaaacatgcaaagtccattttttctataacataattgatacaaaaagttccatttgacgagtatggaattagacttgacatctgcaactaacacaatacagcaaacacagctggatgataaccgaaagccttcatcaggataattacttccttaggtcgcctttcacacgtcacaagaaatccaagtggcttctgcccttgaaatatctctgtatattagagacaaaggataggggttggagggatggctctgcattgaagagcactggctgctcgtgaagagggctcctactcagactgggtttagactccatactcacatgactacttacaattatctgaaactccagttgcagggtatccaacgtcttcttgtgaactcctgaggcacaaaactcatgtggtgcactcactcacatacatgcaagcaagccaaacactcagaacaaaatgaaaacaaaccagtctttaaaatttcaaagcatcaagttactatttgaaatgtctttatttattaaatcaacatctttcatgttcacaaacacaaaataatcctcgttgttttgacaatgaaatcaataaacttagctatttct

SEQ ID NO: 282 - DNA, 4553 bp, Mus musculus
aaagagccttttttaccagttcaaaagcttaattaaccagctgtcaccacatctgaatttttgtctctggggcattgacggcaggcagagactaaaagtggcaactcagctatgagttgcctgccctgggctgtcctgctgtcctgctgaccgtgggacaccagggccagcgtgttcccggtgggtttcaactcagccctctgggtgtttggtctctgcctcacttagcggacttagtccttagtccttgtaagtgctttagccccagtggggttttcccagagcactgccacgagttgagtgtatgagtttagccaaataatttctccactgggaaaagcactatcacggaaattgtacctgcttcaaaagagaccagagtaggaaagactagttgcctaggccgtctgggagcaagcagttgtcacgtgcgggcaggagatctcatctgaaaagctaggtccaccagcaggggtgcagttgttaaaatgccagtggcttgctttcccatgtccccccacctaccccctgaattctgtaactgcaaaggaaactgagtggtactggagaaccgcagggagggtaccacagatgagagacaacgcttctagacttcagttcatgccacggatgcacacgatgccgtttcaactgtacgggagaatctgcttacgaacctgacgtcatccctgtgatggcgtcagaggccacagttttcacacgttaccatctctgcacatttgtcctcgaatctgagtcgcattattcagtactgtaaagttaacttgcgtcgagtttgatgtcgattcctgtgaagaagagcttttggcacgtgacagacagtgagttacaaaacacagcaaagcacggaattttttgcagggacaattttggaaccaacagaaaatgtcactttttagttagcatcttatgtatcacttttaccggctatttctaactttggaagggaaaccttgaagcttgtgtaacttagtggaaatgtgtgtgtcgcccttaggatgggtagccaagtctcactaagctgtgttaatctaacttgtatatatgaattgtaattaagagtttggattcacctgtttctcacggtttaaaagtgatgggtcattgcgaagtctggagatgtgactagtctatgatttcaagctgttagaagtcaggaagctctctgaaatgctaaaactaagattctagttttgggctcaaattcgattaagtactgtttgtatgccagagtatgtgaggtgtaaatgtagtggggtacttttcacccttgtagctgtaaaattcacattttgtagaacagaaaatagcttgtactactgaattaacaagttatactaaagtatcatgtcttaaaaacaaaaacaaaaatacatatatctatctatatatatacacacacacacagagttaagcttgttgctgttaccctgtctggatttgaaaattgtgctgatttatataacacacacacacatacacacacacacacacacacacacccctataatggcctgaagcagacatacctgtaactacagttgcaaactgcagacattttggagagaacactgtaccatagctcattcattgcgtggctctttgctcctttttcctgtggtcattttagaaacgagtgtcaagtttgaaattagatctgctaagttggggttctgctgctgaattctgcactgggtccccaaacaaaccgatgtgaatgtagtttttccccctgtgtgaaggagcagccacagccccatcagaataggaggaaaagtctagaagtatctcaaggtttatctttttgtatatgaaaataaataataataaataaaataacctcgtctgtattttttttttaatttgtgattatttctgcatgtgtgtatctatgccatctatgtgtggatgcccagaaaggccaaaactgctcagagaggccaaaacttgtgatcagatcctctggagctggagttacaggtagtggagagccgacatgtgggtgctgggaattgaacttgggtcctctggaagagtagcaagtgtccttaaccactgagccatctctctagagccctggctgacctggaaactcactttgttgaccaggctagcctcgaactcagaaaaccgcctgcctctgcctcccgagtgcagggattaaaggtgtgcgccaccatgcccagtgcacagggtgtaccccatcgtgacagggaaggagctcgaagcagctggccacgtcgcttccactgtcaggaaacggaccaatgcctgctgccgtccggctcctgtttaaaaaaataatttactttttaagatctatctttcttcttgttttttttttgtttgttttttgaggcaaggtttctcttagtagccctagatgtcctggaactaggctgagcaggattcttgtgagtggatcggaaacaccctgggattcagttttgtttcacagatgacctcggcagcgcatggctaagtgtgggctcaaaaaaaccacttctcacttaaacaaattagtcacaggtcctgagagaccttgcagcaagcagcaggctgctttgccaagctgtcttctgtaccaggtgagagaaaccaggattatgttattcttttgaggacctgtgctttcgttatttctccggcacctcagcatcaagcacctgctagaaagctcttaagtggctctggataacagtccagttgcgcaaacatcagccctttttgtagaccaggctggccttgaactcagagatccatttgcttctgtcacccaagtgttggggctaaagaagtgggcaaccacaccagcaaatataagtccatgcaggtgttagggcccatgaattgccgaagaatgatatcctagactcacagtatgccaaagcaaagaacatttattgaacaaattccttcatgcaggggcccaattccattgagatggaaggaccccgactgaattcaaagatgcagttttaaagccaaaaagaggaacattagggaaggttgggtgatctatatcacgattggtgggttctatctctgggggtctgggtgatgccatgattagttagggtctccattcaagcaaacttcatgccaaggagggggcagctcttgatctcctagctgtaagtttgcctaacgattcttttgcaagctagggaggggtcccttttatgtaagcctggttgtcccagtaactgacttgcccagtctgggaagtagaaactcagggctagtctcctgaactgctggtttgcagcctgtcatggagtcagcctggctcaggccaatgctctttttatgggaagctggagactgctgccaggtgaagacccattgatctgagtgggagtctattaaacacgaatattcttctttttacaaaaaataatttacggtcttcagagtgagttcctggacagccagggctacacagagaaaccctgtcttaaaaaaaaaaacaaaaataataacaatttacttaattttattttatgtgcattggtgtgagggtgtcagtcatgagctaccatgtgggtgctgggaattgaacccagaccctttagaagagctgacagtgttcttaatcacttagccatttctctggaccttatgttctccctttgtcagtgggcatttgcccatcaattttgtctaagaccaatttgagaggtcccataaagtggctaacatttacagtgttacttgacggcatgcatcccgtgtataccaccttagtcctgagatgaatccctatcgtctaagatgatgattttaacttcttttttgagacagggtcttgcgatgtagctgagactcatttggaactcactatgtagtctaagctgatctggagctcagaaattccttccttgtctttgctagcgctggggttacagatcggctccaccaagcccaattacagtttattacatcgacttatttatgtctggctgtacatacctgtgcatgtaggatggcaagcccatgcctgtgacggtgagaggacagctttcaggagtcagtcctcttctaccaagtaggttccagggactgaattcaagtgtcagttttggtggcaagcacccttactgatgaaccatcttgcttgtctaggcacaaattaaaagagataacatggactgacacactggactagtttggtaaggatttaacttctgagctctggcccatccagagtctctggctaccattgagtactgttttcccaggaaactcgataggtggtacaaacactctgatgtgtattttgactttgaagcaagtgccccaaacagtccaatggggtacaggttttggaatcacatcgagttggatcccaggttaggagatctttgatggatcatgaacaagcatttactcactattaaatgggactaaagacaatttcttcagaggacagtacacacacaccattaaattgacaagctaggacacttaacccatccattaactggccaggaccagggatggaggtaggcgtgcctcccctgctggactct

SEQ ID NO: 283 - DNA, 3000 bp, Mus musculus
gttttgtgcagaatttaatttccttaaaatcctaaaacttacaaactaatttacagtgataaagtaagttgttgattgtcagagcatgaggttgatagggagacataaatcatgaggggaattggggaggttttggacatggtcagaatgtgtcgtcttgattatcttgatggactcaggatgcgggtcgatcagattcatcaatcaaatgctttaaatatatgctgtttgctgtaaattaattatatctcaacaatacctttaaagataatataatacttggggctggagagaaggctcagcagttaaaagcactgactgcttatccagaggacccaggtttgatccccagcacccactgctgcagcacacaccacacatcacaaccgtctgtagctccagacccaggaatctgacgtcctcttctggcctccatgggaatcaggcatgcatttaatatacaaacaggtaaaacactcatacacataaaataaaaataaatcttaaaaattataatactactagtacattttaactgcactatcttgacactaacagtgttgttcaccattgcctatacacaatcagcactggtgtcaacacagtgaagtggacaaataacagtgtagtagtgttgtgaagacagttttgacctcaagatccaaaggggccaagaagagtcctcttgagtctagcatcgtcacttctctacttattctgttatggcaatgtctcctcaaaatctaaaacaatctcttatgaaaaatattcttcaagtcatgtttaatgctaactactaacacatattaatcatgttcataaaatgtataaggataacatttaaggccctctccccaccccagctcaatggcttcgtctcctgttggctcctggacagaccatgttccccccaccttccgacctgtgctcagacgctcttgagttttgcatagtaagttctacttctgaggactggcttggattcagccctggctgtgaaacctcaggcacttaagcacatgcgtcccttgctggcattcctttgtgtcctgtttggactcgtatctcatagaattgcatcttggtcctataacgtgttggctatctgctttcctttttccctcagagctgctggcataggactgaatatggaataggtctttgaatgattacattctttagtctttggcattctttaaagaacattttgattaaactcctggctttacccttgtcaaacgttctgtgtcttctaggtaaccaagtgtaacatctgtcaattttgataaggaatttcttcagccttctaccaagtttataagttttaatttacagcctctgttggaggtctccatctacttaatcttttcttccataaaggagattaattctctgttaaatatgcgatgtttacataatgccaaataagctggtactaatataattggaaaatatctggtagtcttgcagatggcctgaacttcttgacaccagacttgtgtatgacaaaattagtctcattggttttctgcttaccccttcataccaatgactaagcaaagcatgcctgcgcccttttcgttactgccctaggaagatagggaattggtgagaaacattacctttatctcttgtagttattgataagcattcttaaaattgaggttgtaaagaatcaacatacaataaaaggagttttgtgccaaaagaatgttttccaggtagattctatttcgtgttatgattgaggttggctgtggagagtcaggagtcttattaagtcaccaggatttcaaatctgcaaaagcaataaatggaagattagttcagccctgttggactttgtgacatgcctgtgtggatgtgttgaaatagaggcagctgttttggaaatgattaaaggactctcaaatggggatgctttctgcgagacagatcagcaccgaagaattcacgtgcttaaaaaaatagaaaataggatttaagcatctattcagtaagtagagacctaatggcctcttctctttctgtacctgaaggtcattttcctgaggaaagatgaaaaatttttaaattctataattaattatagttaacaatcttggtgtttttaagagttctgattttattgctctgaccaacattattttttttattcagatgtatgtttgttgtgaaattatgaatagttgttttttctgtagtctgacctgtgaatagaagataaccagtgtgagacagtgggtctaagattgacagaggaacattatggagctgaggcattcagagtccagtggtaggagctgtcaataccagccatttaaaccccaggctataatccttacctgcagagtagacacaggggtaacaaggaacatatttaaatcttcttctctcataatatcgtataaaactaagcaatttaatcatagatttttaaatgatttgttgttgttgttggtttttgtggtagtctgacagaaactgttatcctgtcttaaaaacttcctactggtttttctttagtgttttggttgtttttgcttgttggtttgtttgttgttgtaactgtaaaaaaatggatgagtccattatgtgtacagcagttttaaaagtgttcatttctgtaatggctattgaatttattcatagggtcaggtttaagcatttcagatcctggcatggtggcacatacctttaataccagcaaagactgataacaggcagatctgagccaggactacacaggactaccctgtctcaaaaacaaacaaacaaacaaacaaacaaacaaacaggaactctttaggtcttgaataaaaatagatccagcagctcctatgactaagccagcgttttttttttttgaaagtactgtattcaccaccataggtattggggaaatgacctgaatgagaaactgaactgacatgagctgtggcacttgtgctggctggtttttaagtcagcttgacacaagctggagttatctgagaggag

SEQ ID NO: 284 - DNA, 21684 bp, Mus musculus
catctttcaaagtgaattttatcaaaagaaatatacctgtctccatgtgaatgaataccaaagttgtaagatttttcaatacaaaataaacattactatgttttaagttggtgtgcttctgttgaaaataaaatccaaatattatcaatttagcttattatactctccaataagaaaccttgagaagggctctgatgcagctcactgttggagctcttgcctacgtaaatgtgaagccctgctttcaatctcacgccctctccaaaaacaaaataaaacagagacaccaaaggaaattaaagtaaactaaaataattcaacagaaaaatgcatttgctgaaatattatagtgggtgcagtaacttcttccgactctgagcgccgctgttcacctacgaggagcaaaaagccaccggagcacagttgggattctcagggtccaaaagcttaaagcctcacagttccggcaaaccggctcctgggctgcaacgaaaattactccgcactttaaggtgcttccgctgcgggagacccaaggggtcacagaaagaagaaaagaaccgggtgaaacacactgggcgcctggcggatcgggaaaagctttgagagaattccgtagtcagaagacaatggccgctcaaaggaatctctcagagcgcaccaaactggtcctccttttcttatggatgccctgggaatccgcagctcggcagatccgctattcagttcctgaggaactagagaaaggctcttttgtgggcaacatcgccaaggacctggggctggagccccgccagctggcggaacgcggggtccgcatcatctccagaggtaggtctcagcttttctctctgaacccgcgaggcggcagcttagtcaccgcgggcaggatagaccgggaggagctgtgcgcccagagcgcgccctgtctcgtcagctttaacatccttgttgaagatagagtgaaacttttcgggatagaaatagaggtaacggatgtcaatgacaatgcgccaaaattccaagcagaaactctagatgtaaaaattaatgaaaatgtcgccccaggaatgcgttttcctctcccggaagctactgatccggatgtgggagtgaattctctgcagagctaccagctcagctccaataaacacttctccctagtcgttcagagcggtgctaagggcgtcaagtacccggagctagtgctggaacaggccctagatcgtgaggaagaggcgattcaccacctggtcctcgtggcctctgacggaggaaaccctcccagatcgggcactgtcctcatcactgtgaccgtctttgatgcaaatgacaatgctccagtcttcacctccactgaataccgcgtgaacattccggagaacctgcctgtgggcacccaactgctaaaggtaaccgccaccgacaaagacgaaggtgccaatggagaagtgacatatgcattccgaaaatcgctggacacacaattgtccaaattccaactagacaaacataccggagaaataaaaatttctgaaaatctagattatgaagaaatgagtttctatgaaatagaaatccaagctgaagatggaggggcctatcttgcaactgcgaaggtgctgattacagtagaagatgtaaatgacaacagtcctgaggtgaccatcacatctctcttcagtccagtgacagaagattcgccggtgggaactgtcatagccctactaaacgtccatgatttagactccgggcagaatggagaggtagcctgttccatctcagggaatcttccgtttaagttagaaaagtccattgacaattactataggctagtgacacaaagagcccttgatcgggaacaggtacccgcttacaacatcacagtaacagccactgatgggggaaacccacctttgtcaaccaaagctgacttcactctgcaagtggcagatatcaacgacaacccacctaccttctctcatccgtcctactttacctacatcccagagaacaatcccagaggcgcctccatcttctcagtgactgccctcgatccagacagcaaagagaacgcccagatcgtttactccctggctgaagacaccattgagggggcgccactttcttcctacatatccatcaactcagacactggcatcctgtatgcgctctggtcctttgactatgagcagtttcgtgaactgcaggtacaggtgactgccagcgacagcggaaagccgcccctccacagtaatgtgtcgttgactctgtttgtgctggatcaaaatgacaactctccagaaatcttgtaccccaccatgcccaccgacggctccactggggtagagcttgctccccgctcagcagagctgggctatctggtgacgaaggtggtggcagtggacagagactcgggacagaacgcctggctgtcctatcgcctactcaaggccagcgaaccagggctcttcactgtagggctgcacacgggtgaggtgcgcacagcccgagccctgatggaaagagatgctctcaagcagagtctagtggtggctgtgcaggaccatggccagcctcctctctccgcaacggtcactttgactgttgcagtagctgacagcatccctgatgtcctggcagacttgggcaacctggagccaccacaggactctgaggcctcaaacctcacactctacctagtagtggcagtggcagctgtttcttgcgtctttctcgcctttgtcattgtgttgttggcactcaaactccggcgctggcacaagtctcacgtgctgcagtcttcgagagatggattggctggcgtgcctgcctctcactatgtgggcgtggacggggtgcgcgctttcctgcagacctattcgcacgaggtttccctcactgctgattcgcggaagagtcatctgatcttcccgcagcctaactacgcagacacactcatcagccaggagagctgtgagaaaaaagatcctttgtctttgttagatgattccaagtgtcctgtagaagacgctcctttggtgccagtgagttctgattttacttattctttaaacaattacgagccgatttaccgttgtgcttgagcccaaatgctggaaatggtagatctctattttaaaatcacttctcacggttccaggttccagcttgcctcttgctaaaacattagcgagtagaatctgctagttaagactgtactgggaactgtggtgaaaaatcacctaggttgccctaaggttgtgtgagtagctttggcagaaccttgtgttttattgctgagtacaacatggatgctccctacaagggaactaacttcatgtggaagtgtcagttgatttatgtgtcctcgctgaccacatgctgcaaccctaccactttagcagaccggagctcttttgaaggcaagtctgttaaaattaagtaaatgtcagaaacaaatgcattggccccgacagacacacaaactaaatctaaggctgttcgttggtgttcttaaaggacaaaacaatatgtcttttcgaatacattttttcaaacaataactgaatatacgctttagatatttgaagtttttcattaatatccaaccaacaattcataactatgtgcttagaatctttataaacataatcaagcccattagcccagcggcattccttctgcatatgattgtgtggcatcttactatacagccttttaatttcacttttcttgcccgatgatgattccaagaatttatgcaaggttaaattgagaatttttgttctctttgtcttttttttctccaaaattatacatgccatcgattaaagctaaaatgtaaatatgggttggggtggacagcgttgctcacattcccaagagcaaaagctaaccacgtgatgaggatattttctctctaatgtagaagaaaactcagccagcagaatctcaagtgctgtgacagagctttacaataaactaagagggggaggggagggggaggggaggggagggggagggtgtttttcagaggggaaaccaggaaaggggataacatttgaaatgtaaataaagaaaatatccaataaaaaaaataaaataagagctaagagcaaagaaagaattgccagctcatcagaagatctgaattcaagcaaagatgttcatgaaactcttctaaacaaatgattggtgaagatattgctgagcacatgtagttcaagaaaaatagtaatatatttgattcgatctctggattttttattacgctccagaagttactaaaataaagagtactctacagcgtctcaaaatacacctgagaccctgacacttttgtgtcaactcttggctagccatagatccgtggaaggtaagtaaaggctctggagttataatacgatttatccattgaagtcattgtcctacatctttgtcccacaagagtaacaattattatgtgcatatttcagttctgttatttgtaaaagtgcaagcttcaagagcactcttttgacattgcaaatgttctattaaatttttgagagcaatgctgaacatcctggatgtttggatacagtcagggttgcattccagtgtctaaatgtgggtgcaggggtatttactttataactaacgagagctagagctgatggcaaatataattgtcctcaaaaagagagatagtcatttcccgtagatgacggacttgggtaacaatgggccattggtcctgtgggccttcactttctttcacgctttttaatttgaaggaaatacactttcaatctaaccaaaatgagtatacatgtttatatatgaaagaatatttattaataaaaaatttcactagggaaacaaaatcaatgagaaagaaaattcaaatgttttggctatcaacttaacacagaaaataaaagattcccccaaaatctgaaacgccagactgcaattccactcagagcctctgggcgccgctgtcggccagtgcagagcaagctctgatgccccgatccctcagtctctaagctgcaatttcctgcgcagaaacgaatacacacaccaaggggaactctcactcatacagactaagacaccgattcccaggacaaaactggggtcccgctgtcccgagccaaaaggacctccaccctcgtaggctgaactctctcctactgtgaagatctgaagacctacaggggacctgagccagcaatgggagggagcagcgcgcggaggaagcgccccggccgcccgcaggtactgtttatcctgctgctgcctttgttctgtcccgcgctgggccagccggtccgctactccatccctgaggagctggaccgcgggtcggtggtggggaagctcgccaaggacctggggctcagtgtcctggaagtgtcggctcggaagctgcgggtcagcgctgagaagctgcacttcagcgtggattcggagagcggggacttactggtgaaggaccgcatagatcgcgagcaaatatgcaaagggaggagaaagtgtgagctgcagttggaagctgtgctagaaaaccctttaaatatttttcatgtcgttgtggagattgaggatgttaatgatcacgctcctcaatttccaaaagacgaaataaacctagagataagtgaatccgacagcccaggggcgagaacaattctggagtcagcaaaagatcttgacattggtatgaattctctaagtaaataccagttaagtcctaacgactactttttattgttggtgaaagacaatcctgatggtagtaaatacccagaattagaattgcaaaagatgctggaccgagaagcagagagcacacaccacctgatgctgactgctgtagatggtggggacccgccccgtactggtactactcagctccgaatccgagtggtggacgccaatgataaccgcccagtgttcagccaagacgtgtacagagtccgccttccagaagacttgcctccaggaaccacagtcctaaggctaaaggcaatggatcaagacgagggcatcaatgcagaatttacatattccttcctaggtgtggctaacaaagcccagttctctctggatcccataacaggagatattgtaactcgccagtcgttggattttgaagaagtagagcaatatacgattgatgtggaggcaaaggaccgaggatctctttcttcacagtgtaaagtaattatagaggttctagatgagaacgacaaccgcccagaaataatcatcacttctctctctgatcagatttcggaggattctccttccggaactgttgtggccctcttcaaggtacgggatcgagattctggggaaaacgcagaagtcatgtgcagtttaagcggaaacaatccatttaagattcattcttcttccaacaattactacaagttagtaacagatagcatcctagaccgggaacagaccccagggtacaacgttactatcacagccactgataggggcaagccgcccctttcctccagcacaaccatcactctgaacgtcgctgatgtcaacgacaatgcacctgttttccaacagcaggcctacctgataaacgtagcagaaaacaaccagcccggtacctccataacccaagtcaaagcatgggatccagatgtgggatccaatggcctcgtctcctactccatcatagccagcgacctagaaccaaaagcgctgtcgtccttcgtgtccgtgaaccaggacagtggagtagtgtacgcgcagcgtgcctttgaccatgagcagattcgctccttccagctgactttacaagcgcgagaccaggggtcgcctgcgctcagcgccaacgtgagcatgcgcgtgctggtggacgaccgcaacgacaacgcgccacgcgtgctgtatcccacgctggagcccgatggctctgcactcttcgacatggtaccccgtgccgctgagcctggatacctggtcaccaaagtggtggctgtggatgcagactcaggacacaatgcctggctgtcttaccacgtgctgcaggccagcgatcccggtctcttcagcctggggctgcgcacgggcgaggtgcgcacagcgcgtgccttgagcgacaaggatgcagctcgtcagcgccttctggtcgctgtgcgtgatggtggacagccacctctgtctgccactgctacactgctcctagtttttgcagacagcctacaagaagcgttgccagacctcgtcgatcatcccatcccctccgaccctcagagtgagcttcagttttacctggtggtggctttggccttgatctcagtgcttttccttctcgcagtaattttcgccattgctttgcgcctgcgacagtcttccagcccttcatccactggttgctttgggtcggttcttggttccaaatctagaccagtacttccacccaactacagcgagggaacattgccctatgcctataatctgtgcgtgccgggagatcaacttaaaccagaatttaattacttctcatccgttggagattgtccagccgcacaagatattctcaacaaagatagctcctcggcactgttggctagtattttaactcctggtgttgaagcagacgagaagacctttaaccaggtatttaatgttatgctttttatattccggtacgccaacgtactcctacatagagctactattttagtggatggtttgttttgttttgtttcgtttgagacagggtctctctgtgtattcctggttgttctggaattagctgtgtaaaccaggagggcctagaattcatagagagccgcctgcctctgcttcccaagcgctgggattaaaggcgtggaccactgcactgggatctattgtaggagctttaggatcctaatagaaatgtaggtcaaacttgtgggcatcactgcttttggaagggtgtgggagtgtgctatggaaacaaacttgtacctcgtgtgaaccaaaaccagttctatccagcatgcagaaggtttgaggtgctgaaatactctactatccaatcgtatttaattctttgttttgttttatgagacagggtttctctgtgtagccctggctgtcctggaactcactctgtagaccaggctggccagaaatccgccaactgctgggattaaagatgtgcgccaccactgtccggcccatatttaattcttaaggtgtttttcttttcttttcttttcttttcttttcttttctcttcctttcttttcttttcctttctttccttttctttcttttgttctttttttaagtttgagcatgtagtgtgctctaggtcttgcttcaattaccaattaattctctcctcctcctgactctaacacacacaaatatatgaaaaatctcacgtcaatttttcatcaaaataccttctagttttggatatgatttacaggcatattttattatcttttaaatgataaccataatactattaaaattttgaatggaacattccgtcgttatcatactcattaaaaataactcgttaagaataaaagcaacgttggtggaaactggagagatggcttagtggttaagagcgccattactctttgagaggacccaggttcggttcccagcacccatgactggcagtttactactgcgataactccagctccaccttcttctggacttcacatgaacccatacttgcctgtgcacatactcacaaagacacatgcatatactcataattaaactaataagataaaaccttgaataaaaagtagtaagaataatagccatgaatcctacctgaggatttcgtctggaccatgctggcttctcattcacaaacgccgcgtctctacagttagtaaaaccagctggaatcacaactaacctgtgtattttaagtcccagtgttattttgaaacgtttttttaattaaacaagtccatctaataactacccttttcataagtgctcttggtaaaatttacatcacatcacatagctgttgtttgctgttgtcggcttcacaaatgttaggatccacggaaaaggtgagtgtgacagttttctccgcaacagacaccgggtttttattagtgttgcaataataagattgggctctaggcgccgctgttgaccaatcggggaacgggaggacaaagctattgagtacttctccggaatctctagcacacaaagccgaaaaggatggatactcacgcatctcaactctggaagtaaaaacacctccgttcgctttggaatatgttttggatgcgggatacctggaacctcgtagacacaaaagctgactcggaaaaataaataaaaattaaaccggcgcaagacccttacggaataacgctcacacccagccatggcgaatcagtctcagcgcctggaccgccgcgcgctgatcccgctgtgcattttcctggggaccttgctgacctttgggacaggacagatccgatactcggttccagaagaaacagataaaggcttcttcgtaggcaacatctccaaagacctggggctggagccctgggaggtcgcggaacgcggagtccgcatcatctccaggggacaatcgcagcttttctctctgaatccgcgaggcggcagcttggtcactgcaggtaggatcgaccgtgaagagctatgtgatacgatgccctcctgcatgctgaatttggaaattctcgtggaggaaaccctgaagatttacggagttgaggtggaagtactggacattaacgataacgctcccagcttccgggaagaggaagtagagatcaaagtcagcgagcataccagtcctgggtcgcgatttcctcttcctagcgctagggatccagacgcagggatgaactccctccagagctaccagctcagcccaagcagttatttctccttgcaggtgagaggcgggactgatggggacaagaatccagagctagtgctggaggaaggtctggaccgggagaaagaggcatctcaccacctcctcctcacagccttagatgggggagatcccgtccgcaagggcacggttcccattcgcgtggtggtcctcgacgtcaatgatcacatcccaaaatttacacagcctgtgtatagagtgagtattcctgaaaacctcagctccgggacgcgggtgctcgtggtaaatgcctcagacccagatgaggggatcaacggggaagtgatatactctttccggaaaatgaaaagcaaagcttctgaaatatttcaactgaattctcaaactggggaggttctagttggaaagcctctggattttgaaaaatacagattctatgagatggaaattcaaggccaggatggtggagggctgcttagcaccactacgttgttgatcacggttgaagatgtgaatgataacgctccagagataactgtcacctctgccagtaactcagtgccggaaaattctccttcgggcacagtaattgctcttctaaacgttcaagatcaagattctggagaaaatggtcaggtctcttgcttcattcctagtggtcttccttttaagttagaaaagacgtatggaaattattataaattgataacaaatagtgaactggaccgggagcaggtggagagctacaatattacattgatcgccaaagatcagggcagtccaccgttgtctacagaaactcacctactgctcaaagtggcagatgccaacgacaaccctccagttttctctagctcctcttacttggcctacattcctgaaaacaaccccagaggctcttctatcttctcggtgaccgccattgatagggatagcagagaaaatgcccaggtcacttactctctggctgagtacaccatccagggaacacctctgtcctcttacgtttctatcaattcagacacgggtgtgctgtatgccctgcaatccttcgactatgagcaattccagaccttacaactgggagtgaccgctagtgataatggcgacccaccattaagcagcaatatttcgctgacccttttcgtgctggaccagaatgacaacactccagagattttatacccctctctccctaccgatggttccactggtgtggaattagcacctcgctccgcagagccgggttatttagtgaccaaggtggtggctgtggacagagactccgggcagaacgcctggctgtcctatcgcctgctcaaagccagcgagccaggactcttctccgtggggctgcacacgggggaggtacgcacggcccgagccatgatggacaaagatgctctcaaacagagtctcgtggtaactgtgcaagaccacggccagcctcctctctccgccactgtcaagctcacagtggcggtggctgacagcattccagaggttctggaggacttggttagtctggagtctcccgccaacccggatgagtcaggcctcaccctctacctagtggtggccatcactgcagtctcctgcatcttcctcatctttgtcatggtactgctggctctcaagcttaggcgctggcactcattacgtctgctccaggctgccagcggattggctggtgtgcctccttcgcactttgtgggcgtggacgggatgcgcgctttcctccagacgtattcccacgaagtttcgctcactgcagactcaaggaagagtcacctcatcttcccgcagcccaactatgcagacacactcatcagccaggagagctgtgggaaaagcgagcctctcctgataactgaagactcaactacagttttaggcaaatgtgaaccgacagatattcaggtgagagataaatgtttttgtctcccaattgttcctgttttggcacaagtcttgaaggggcttttgttgagctgggtatgaaaattaggcttgggtgagtgaaattggtccatacatattagaacactacccgttggtttgtgtaacttacaacatcaacagattaacatttcttttcagaagagctttgtcaaagtcaagttttggtacttgcgtcttttctttcgattttgaagagctatatcgattatctttgcttgctttgtagtgagttaccttcaatgttgtttgtctatcgtgattggtggctaccaatgcaaactaatcatgattcaatttgatgatgcacaaacggaatttaatttcaacttcacagcgtctctatagtctaccacgatttgcttctaatgtttaaattgaattcaactctgtagcacgcccactgcagctacacgcccatttatctacactcggcttgtaatgagcttttcttcgaagcatggatcagttctgttttgctttttgatggccgatggaatatttggatcctgttgactatttcgattttgtatcattgctttatcctatcgaaacttggcaaggttttagtgggaagaggccatgcagcaccattttttttcttatgctttctatccattactactgagaactcactacattgttctgaagattaaccagactgttgagttgttgttgttgcttccttttattcttttactgtagtgccccgtagaatgcttttatttttcctgtttttttctttttcttttcttgttctttttttattttcctttctttctttcttccttccttcctttctttctttctttctttctttctttctttctttccttctcccgttcttcctttcttcttttttttgttttgttttgttttgttttgttttttgagacagggtttctctgtgtagccctggctgtcctggaactcactctgtagaccaggctggcctcgaaaaatctgcctgtctctgcctcccaagtgctggaattaaaggcatgagccaccactgccctgctcaaatgctttttgatgtaacaaattcaaacttggaaattatttttatcccatgcttctcaataagtttcaaattccaatgtgtgtatgtgatttgcaaaaagttagagattggagtggatttttgcattgtataagtgattaatttaagggcttggatacaggccagtgatcatgtgcttggcatgtgcacgacccttggtgcaatccttagcgtccttgggggacaaagactgactttgcgtgtagtcatctgttccttcttctttctccttctccttcttcttccttcttctcctccttcttcttcttctccttctccttcttccttctttttcttccttcctcttcttctccttctccttccttcgcctttgccaccttcttcttcttcttcttcttcttcttcttcttcttcttcttcttcttcttcttcttcttcttctccttctccttctccttctccttctccttctccttctccttctccttctcctccttctccttctccttctccttctccttcttcttcttcttcttcttcttcttcttcttcttcttcttcttcttcagaaatatagcagcttagatacttttttctttccttaagttaattttgcactacatttatttaagcgtagtcaattgtggtaatcagaaagaaaaagcttgctattgaagcctcaatacatatccaatagtgtgcatgtcatctgaagcaaagacaaacaaggaaaagagacttatggagatttgaccacaggaatcaccttcataatcaaactccacatccttgggtcacatctagagatttgattcaaattacttgcacattaatatttcctttcaagttaacgtttctcatttaggagtttgatcgtaacataattcattattgattgggtgattgggaacatttctttcagttgttaggataagaacagttgcctaagtttgtcctgaagcaagaaaaaagtatttgaatgttttgtgtggtgtttattcttatgaaactccaaactttgaagaaaaagaactttaaggcgctacacttgaactagaattagattattcaaaagactatgaggcatttgattggtaaggagagggtggtctgtatttttaagcacaatctaaactagttggaggctctcagacaagctcttgaagaagaaaaagaaaaggttgtctctgaaagttgatttgcaagtcataggcaattcagttaggatgcaacatatcgtttaaataaaaggatgaaaagaggggttgaggatttagctctatggtagagtgcttgcctagcaagtgtaaagccctgggtttggtcctcagctctgggaaaaaaaattagaaaaaaaaaaaagataaaaagaaaattctcgggctcccaatggaggagctagagaaagtacccaaggagctaaagggatctgcaaccctataggtggatcaatattatgaactaaccagtaccccggagctcttgactctagctgcatatgtatcaaaagatgacctagtcggccatcactggaaagagaggcccattggacacacaaactttatatgccccagaacaggggaatgccagggccaaaaagggggagtgggcgggtaggggagtgggggtgggtgggtatgggggacttttggtatagcattggaaatgtaaatgagctaaatacctaataaaaactggaaagaaaaaaaaaagaaaagaaaattctctcccatttcatgtcaggagattcttacttaacagtgattgaacatttaacaatccttgtgatgtatctatattacaactaaaaataacttctggcattgacgatctttattccaaatgttccctaaatagtcactcaaaagtgcctctcctctgctaactatgcatgtgtccgatgatgtctggtgtcatttcgccactgtcaagttttcctataccgcgtggtggggctattttcccacgtgatcttgagaaaatactttcctgattcatccaatgtgtgcgtttccttagaaaagacgagctttttaatctgttgtcactgggttaatagttatgttacagatcccacctctgaggagctttgttcggtagcaacactggaaaacagtcaaattctaaactcagaaattcctttgctccccatatctcaacatagctgtattcttaaacccaatgagtctgcgaagggttctgattgcaattttataaatggcctctgggcgccgctgctgtccaattcgctgcaagagctgactccatgctctaccggttgaaattctgtacattcactggaggcttaaagagtaggggtacttgaattttctgcttggtaaatcagattagagactgtgatatcctcaaacgtggagcgtttgggttttcttcctggttggaagtaattcgcgaagcctcctcccttcacactggtgcgggagaaggatggagcgcagcagcgtgaagctagggagcaggaccccgtggaggcaagtactctttcccttcttgctgcctttgttctgcacggggctctcagagcaagtccggtactctattccggaagaaatggccatgggttcagtcgtgggaaatctcgctgaggacctggggctgcctgttcaggacttactgacaagaaaccttagagttattgcagagaaaccgtatctttctgtgaacccagagaacgggaacatagttgtgagcgacagaatagaccgagagtttctctgcttccaaagccctctgtgcgtcctgcccttagagattgtggcagaaaatcccctaaacgtttttcacgtcagcgtggtgatagaagatataaatgataaccctccccgtttcctccaaaatagcattgttttgcaaatcaatgaacttgcgattccaggcactaggtttggcctggaatctgccatagatgcagatgtagggctgaactctctccagagttaccaactcagtttgaatgagcacttctctctggtggtaaaggacaacactgaaggaaaggatgcccccgaattagtgttggagaagcctctggacagggaaaaacagagctcccagctcttggtcctaaccgcagtagatgggggagaaccagtcctaacgggcaccgctcagattcagatcgaggtcactgatgccaatgataaccccccagtgttcagccaaagtacgtacaaagtcagtcttagagaggacatggccgcaggcacgtctgtgctaacagtgatagccactgaccaggatgagggtgtcaacgcagaagtcacctactccttcaaatcactaggagaagatattagagataagtttatcctagatcatcaaagtggagaaattaaatccaaaggccctattgactttgaaaccaagaggacttacaccatgaacatagaggccaaggacggtggaggcatggcctcagaatgtaaagttgtagtggaaattctcgatgagaacgacaatgccccagaagtggtttttacttccgtgtccaattctataaccgaagatgcagaaccggggacagtggtggctctgttcaaaacgtatgataaagattcagaagaaaatggaagagtgagttgcttcgtaaaagaaacggttccttttaggattgaatcttctgccagcaattactataagcttgtaacagatgggatcctggaccgggagcagactccagagtacaacgtcaccatcatcgccactgataaaggcaagccccctctctcttccagcacaagcgttaccctgcatgttggggatatcaatgacaatgctccagttttccaccagacctcctatttgatccaagtggctgagaacaaccctcctggagcttccattgctcaggtcagcgccttcgacccggatttgggatccaatggtttcatctcctactccatcatagccagcgacctagagcctaaatcactgtggtcctacgtgtcggtgaaccaggatagtggcgtggtgttcgcgcagcgcgccttcgaccacgaacagctgcgctccttccagctgacactgcaggcgcgcgaccagggaaagccctcgctcagcgccaacgtgagcatgcgggtgctggtgggtgaccgcaacgacaacgcgccacgcgtgctgtatcccacactcgagcccgacggctctgcgctcttcgacatggtgccgcgtgctgccgagcccggatacctggtcaccaaagtggtggcggtggatgcagactctggacacaatgcctggctatcttaccacgtgctgcaggccagcgatcccgggctcttcagcctgggactgcgcacaggcgaggtgcgcacagcgcgtgccctgggagacagggactcagcgcggcagcgccttctggtcgctgtgcgtgatggtggacaaccaccgctctcggctacagccacgctgcacctcatcttcgctgacagcctgcaggaggtcctgccagacctcagagatgaacctttgctgtctgactcccaaagtgagcttcagttttacctggtggtggccttggccttggtctcagtgctctttcttttcgttgtgatcctggccattgtccttcgccttcgacagtcccatggtcctgctgtctcagactattttcagtcgggcctctgctgtaagacgagaccagaggtttctctcaactaaggcgaggggactcttccttattcctacaatctctatgttgcctccaattgtcaaaagacaatttctcaatttcttaccttgactccagaaatggtccctccgcgagacctttgtacggaagcttctgtagcagtgagtgtcgctgaggagaataacaagatagtctcggattctattgcttctaatcacgtgagtttcaattagcctttcattcgcaagttgtttcgttttcaaaatcttttggaaatattttatatttgtctgtcttttggttggtttacttattttttataatacatttagaggcagggtttctcaacatagcactagttgtcctggaacttagaccgggttgaccataaactcttagagatcctcctgcctctgcctctaccacgatctatattctttacaaagaatatcttagagcacattatataccaacagtctcagttctttcctatctttgctctatatgccagtaactactgcgccattaggcttcaaggactttgaaatattttatctatgtacacccaagcgcagagcttagaagtattatgatgcactgccactcaagcaatttaaatctctctctctctctctctctctctctctgtgtgtgtgtgtgtgtgtgtgtgtgtgtgtgcatgcgtgcaccatgtggcagtcagaggacaacctttgggaatcgggtctgtgtttctaccatgtgggtcccagaaatggacctcagattcacttatgcttggcagcaagcacctttgctggctgagtcatctctcagtggtcctactcaaatactttagttgagctatacttttgtctttctgtggtagtttcttgggagatcaatatcttgatctttaaactgagaaatgatatatacaaaaagttttcaaactatatgataataatttggtagtgatattcagatatagcaggggttcttttaatttcacttttatgtcttacaagcaagttttcttcaaatcttattttatggctatcagagactgaagggtagctcaattagagtttatacttaagcatggctgatagctagagtccactgtccagcagtcgtcactaaaaagtgcttgcttttaaagacagtttctagtcacattaaatatgtacaggcagtcgtctcctagaatcttttctacattttgatgtgcttctaaatatatggccagtagttctgttttcaaaattacccaggagaaggaaagtttacagtattcctcagattactaattttcttttactaagtctttctcaacaccaaatgtcctttttgcaatacaatacatctgtataactgtatagtagaatctccagttcaagttaatgcaggttggaatctttccacttactctaaaggtgtccataatcttcattgattgattagagtcacatatgaatctaataatatgcattataacagttctcatgtttgttttccatatgattgtgaatttttgttttttcagtaataaattccaacttgttacaatagttcttccctttagaaattttcaagaaatctattgaaatttttgtcttactggaaaatataggaaaacaaacagctactgaaaataattcaaggaagtgaatttgtgggggggggggggttacggactgctcactgaactgcccagtactgttgagttttctgtttccatctccatttgaagaacagtaggtggagctatttaaggttcacagaccaaaaatcctctcccggagttcacgactgtgcagtaattggttcggactctgagcgccgctgttcaccacggggaaggaaaagcagggaagccctgcttgctttgcatgcgcctaaaacacaatgcggacagattgagacaaaacccctctaggagcaaactggcctggaggaactcgtcccacctcctaactgtcttgctccaaggcttcaaaagcagattctggttcaggtgatcacaggcagaattggaaataatcctcagttggtgatgatccccatgcaacggcgggaggactgcaaagggctggtcttcctgggagtcctcctcgggatgctgtggaaagctggatccacccagatacgctattcggttcccgaggagctggagaaaggatctagggtgggcaacatctccaaggatctggggctggagccccgcgagctggagaagcgaggggtccgcatcgtctccagaggtagggctcaacttttcgctctaaaccctcgaagcggcagcctggtcaccgcgggcaggatagaccgggaggagctgtgtatggggtccatcaagtgtcagttaaatctagagattctgatggaagatatagggaaaatatacggagtagaaatagaagtgagggacattaacgacaacgctccctacttccgtgaaagtgaattagaaataaaaatgagcgaaaacgccgccgctgggatgcggttccctcttccccacgcttgggatccagatatcgggaagaactcgcttcagagctaccagctcagcccgaatgctcacttctcactggaggtgcagaacggagctgatggtaacaagtacccagaattggtgctggagagctcgctggatcgggaggaaaaggccgctcatctcctagtcctcaccgcttccgacgcgggagacccggttcgcactggcacagcgcgcatccgcgtgatggttgtggatgcgaacgacaacgcacctgcgtttgctcggtccgagtaccgcgtgagcgtgcgggagaacgtggctgtgggcactcagctgctgctggtcaacgccaccgacccagacgaaggcgccaatgcggaagtgatctattccttccggtacgtggacgacaaggcagcgaaagttttcaagctggacagtaacttggggacaatatcaacaataggggagctgaatcatgaagaatcggggttctacgagatggaggtgcaagctacagataacgcgggatattctgcacgggccaaggtcctggtcacagttctggacgtgaacgacaatgcccctgaagtagccatcacgtccctcaccaactctgtcccagaaaactctccccaagggacattaatagcacttttaaacgtaaatgatcaagattctggggaaaatggacaggtaatctgttccatccaagagaatctgccctttaagttagaaaagtcttacggaaactattatagattagtcacagatgcagtcctggaccgagaagaggttcctagttacaacatcacaatgaccgccactgacaggggaagtccgcccctgacaacagaaactcacctcgcactggacatagcagacacgaacgataactcgcccgttttccttcaggcctcatactgggcctacatcccagagaataaccctagaggggcctctatcgcatccgtgaccgcccacgaccccgacagtgacaaaaatgcccaagtcacttactccctagctgaggacacccaccagggcgtgcccctttcctcttacgtttccatcaactcggacactggtgtcctgtacgcactgcattcctttgactacgagcagttcccagacctacaactgcaagtgatagcgcgtgacagcggggacccgccactcagcagcaacgtgtcactgagcttgttcgtgctggatcagaatgacaacgtccccgaaatcttgtaccccactctccctaccgacggttctactggagtggagctagcaccccgctcagcagagcctggctatctggtgacaaaggtggtggcagtggacagagactcaggacagaacgcctggctgtcctaccgtctgctaaaggccagcgagccagggctcttctccgtggggctgcacacgggcgagataagcacggctcgggccctgatggacagagatgctctcaaacagaacctcgtagtgtctgtgcaggaccacggccagcctcctctctctgccactgtcacgctcactgtggcgatcgccgacagcatccccgacgtcctggcagatctagacaatctagaatctccttccacctccgaaacttcagggctcactctctatctggtggtggccgtggcggcggtctccaccgtcttcctggtctttgttct

SEQ ID NO: 285 - DNA, 22992 bp, Mus musculus
agagaacttagcttgtgctcaaggttggaatgaggaaatataggtcagtgggtgctgggctcagggtccacctgggttcctctataggtcttcctgggtaccaggtcatcccctactgtgggaccctgacaaagtcacgtgaccccatgggaatgtcgggttccctctgttgtagagatggaacatgtctaagcagaaagggaaggtaagcacaagggagtgggagactcctaggccctggaatgctacagctgcatagagggagggaactctgaattgcatcaggaggccagcttggaccaagcatcctcacttctttttagtcaggactctcagtaaccactttgggcacacccctgtgagtacccccaggatccttcacttgcctgcccccagtcactcattcattggacaaatttgctgaaagagaagacaaggaaccattacatgagatattacacagcaaggaagacggagaggactcagcagagatgtagtagaacagtgagacagagcgtgagagctacaagtttaaagctcaaatcaagtagctggggctggagagacgactcagtggctaagagcactggctgctcttgcaaagaaatggggttcaattctcatcacccacaaagcatctggcccacaaccaactgtaacttcaggagatctgacttcttcttttggcctccacaggtatcaggcacgcatgtgacacatacatacatagaggcaaacactcacataaaaaaataaaagtaagtcttttaaaagttttcttacataagtaatcgaggaaagtcttttttttttaacctagagctttgaatgacacaaaaggacaaaaacaacaaaacaaaacaaaacaaaacaaaacaaaacaaaacaaaacaaaaccagccaggcatggtggtgcacgcctttaatcccagcacttgggaggcagaggcagaagaagttctgagttcgaggccagcctggtctacaaagtgagttccagtacagccaggctatacagagaaaccctgtttcgaaaaaccaaaacaaaaaaaaccaaaaccaaaccaaaacaaaacaaacccaaaaaaaccacaaaaaacaaaattcaaaaaacccaaacaaacaaccccccccacccacacccacaaatccatgggtatctgaggcaaagggcgcaggcaacaaagactaaagagcacttaaggttatgcaggagaatcaggaagtgacttctaatccatgcttgctaggaaagctggcaaaaaggacaaagcagatgtagctgtgcctgaatagaaagaaggatgtctctggtaaactctaactgcaacaatcagcaatcaggagactgttggtggtccctagagagtggtggctgagggatggcaggaggaatggggctgggtggggctggctgagcaggaggcacacctgtgacagacaggagggaacacactgggaaggaagcccttctccctaaggtagctagacaggagctctgtgtagagctctggagagtctggagtcagagtctggaatgctctgtgagagaaaggaatctggcttggttcttgacagggctgcccagactaaccatgaccctgtttttgaatctgagacaagccaagcatgatggctcatacctgaaatcccattactcagcactgaagcaagagaatttctgcaaactagaggtcagtctgtgctacacagtaaggccaagcttcccccaaatacaaagacatgagataaacctatgcaggcaccaatgagctgctagccactggatgttcttgcagtgacagggagtcccttctagaggagtacatctctgtggctgccatggccacatgaccagagcagcacaaggggaacatggacacagatatagcatactatatttatacactatacttgtttttgtgtgaggaaaacttgctcccaacagctatgacatgagggagtatgacagtggggagactgtgagaagcctattttcttctaagttgtttttctaagttgcttttcatcaagatatgtgttacagggatagaaatgaaactagacaccataacatatgacttaaagaaggagacaatgaagcattagtgtcaagtactgaagaaatgtgaattcccagctaggattctatacccagccaaactgtcccctgcacattgttcacaccaagattttcacatgctcaagtcacttacagcaaatggtgccatatttacatgtaacccatgcaaaccttctttacacttcaaatcacctcaaggtcacttataaaaatatgatatgcattcacttacatgagtaggtagattaaataaaatagctcatatatggagtacttaaaatgccttgtaatatagtacattggtgttgtgcataatcccagtgttgtggaaactgtgtcaggctgcattgtcctttgcaggtaatgctgtttggggaggtgggaaaccattaggagtcagggcctgattggaggagatgggtgtttggggggtgggtcttgagatttatgtccactttgttcaccatcctgtctctgcttcctcatgcacccaaatgtgagtgaggagcctcaggctcctgctgccatggcttccccgccatgatgaaccatactcttagactgtgagaacaaagctagctgtaggaccaacaaagtggctcaggggtaaaggggcatgccactaagcctgacaatcagagtcctgtcctcagtacccatggggtgtatcttgttctctgatcttcgcaagtgcttggcatggatacctaccgtacatgtacatacaatacaaaataaatgcaagaaaacccacacataacaaaactaaatggacaaacacaagtgccctttgtctgaaaattttaattctcttccccccctccccctttctcctctatctctctctggagagcaaagataaatttactaaggaaaagtgagaaagaatttctgagagtagaaggggctccagaggaggaatgtgcccatatatattatttatggacatatgtgtttgcctgcatgtatctgtgcacgacgtgtatgtagtgccctcagaggtcaggagtggactgcaaaaacttggggcaggagttacagacagttgtgagccaccatgtggattctgggcatcagatcccagtcctttgaaagagctctcaaccactgagccatctgtctagcctctaaagctttctctcttttaattatttacgtttatttatctactgtgtgtatacattgacatatatataggttggagggaaacttgcaaaagccagttttctccttacatcatgtagagccagtgattgaatggaagacttcaagcttggtagtaagctcctttgcctgctgagccatcgagtcagcccttgttctctctctcttaaccttggtgctcatgttcctcagaggaaaatttacagccctggtgttagtaagaagagctggaggtaatttgatcccatttccaacttaagagttaggagaacaagacattcatgactgttcttcaggccctcctgtgtgtgaacacagtctccaagaagagcagccctcagagggaagctgatgcttatgctggtctttctgcatgggcccaggtggttctcccatgctaaggaaagctaacctgggcaatagcgcaggtgactttcaaggctgaccacagcaggcaccagggccttcctcgggcttcctctcggggtatcttccctggagaagacagctgctgtgtactaaggatgcctgagtggctcccgtggggattgcctaacaacagtgacaggtgtgccagtgtcctcagcatcaactgcagcagagtaaggagcaggacttcaaggggaaaactggtgacacagacaagcaagaatggtggcagcagccaccatagccatgagagggtgcagatcagataagacccagctggacataccagcaaggacaactctgtagccagtctgtgacttaacttgctacctctgggggtacgaggtgtccccatagtgcccttctgcaagctctgttccatataaatcagaggtcaccctgctgtccacaggaagctctggcctctgcatctggctgactctggctgtgtttggccagcacagctgggcagtgttatcacatgtaatgtgtactgacctcctgaggggtcacataccaaggaattgagcaggcagcttgaacctactgaaggcctcatgacagaggtagtcctggagagcaacagtccgctaggacttaaaaagatgatggtaaggcctcacccaccattagcaaatcacctactgttccaaagaaagactcagctaatgatatcattttagccttaaagtatgggcacacccaggactaaaatatgcactcacgactgaggtaaacaatgagctggtgtggcccccggaggctcagcacacactgggcaggcaggggagcagggacccactgggttgatgtgcaaagactgtgtaattcagggcagagcatggcactgtgggaaacaaaaacctgaagcccatggtgacttctgcacaggaggaacacatggagtctgtccccagagcttccagcgacacagagatggcagctgggatcacgaggaagagccagcctcaggaaaagtttgcaatttctccaaaacactcaagttttgttctgggacaaggaagggtctggattggaaatgtcccccaatacctacacaggctgagtggtggcagggtctccattgcaagtggagctgagctgggtctctggagaggtaccagcatcacaaggctcttacctcatcttggatcactccactgatgaacttctaatactgtggtagtgctggcaagggatagagttaggaggtggcccagatggaagaggcaggttgctagggtcatgcctgggcaggttttctttgtgctgtgcctctcctgtctcactatctttgcctcttggacaatgtgaggtgagaagttgggtgcagtttgctctctctccatgatgctcagctccatcccagtctcatagaaggaacaactagatcaaaatcgccaagcctgtagccaaaatgtccttctccatatttaagttatttccctgagatatttggtcgcaaggacaataaattgatcaatacaacagcccatcatagtagggcctggcagggccctgggacctattggaaaagtcaagttcaagggagatgggtgacagcctggtgcacttgcctagtcacaaatgggacacggtccacagagatgtacagactgcatgtgtgccaagactagcatgtggtcattcatccactcagcaaacacgtgatgagcactgtgtgccacataccatcctaatgtgggatggagacagaccagtctacctgtcctcacaggccagcaagataaacaaagcaatagcagtgtgccgtgacggggaaagattgttgtaaggtatggctattttgaattcagtggccaccaaggaggtaacactgatgtacctggagggagaaagaagaaccacagcctttcagagaaactaacctgatgtcctttctagaacccaggggcaaagcagccctcagccaggccctgccaatcctagtgagtcgatgaagatcctgcattgagtggggggaaaaggcccaccatgggagaggatgtgagccagtgactgtgggaaatgggagcttgaagctggcaagaactccaaagtcatgaccacccgcccgagcttcgagggcctctgcctgcaagacttaatgggccgttagcagcatgctgagagcatgctggaaccaagtggctctgcgctggcagcgtcctaatccaggattagcccaccgtgggatacagccttggctttaccctttgtgttgacgtctgcaagtgagtcacagtggtccctgacttgtgggcagaagcctgaggggacagtttcaggtgcatgatgtgtgtgtgtgtgtgtgtctgtgtgtgtgtgtgtgtgtctgtctgtctgtccaactgagcatactgcagtctctaagttgtccatatcagctctgagcagacacctggtcccaggtgacagatgaagggccatttgcctctcagaagggacagccacgctctgcagacctgtcaggcctctcaggctgatgtggctgagggtgggaagcagatgggcaatggtcattgcatgggggcagtatagatacctcatgtcttgggtcccaacccttagaatgagcttcatagctggacagcccaaagaggacccacaactctctcttcacagactctgccccttgttacaaagtaaaatcaaaccaaacctgccacttttctttcaaggaagaaagctgcctctatggtagcctggtgagctctacctcacggagcaagctctgatttgccagatgtcacatgtctgccagccctcagaggaggaggattgcgacccccgcactgccctcagcttgtggcatctgtcgttaagtgcgtatacacacagctcagttgggttccccgatgtgcttccaaaccatctgtgacttctccaatattgccccacagggaggcagggtcagacctcagactttaaaactgcctcaatcccatgctattaaacacatcttttttagcagtctctgttttgaaaatgtcttggttccagatcatctttcccaagagaaatggctgctcccttccttttcttcttccccagatggcttaaggtcacccatggcacagcacgtgggtctcctgacactaggaaagagagctcaggtcccttgtcagctccagaggaaatgtcaccttgaacagctgggcaggctaaacactgaatgtcaccatgggtgatgtgagcacagactgttctcttgggtgctgtatcccatacagcttgggtcctggaatcccaattaggagcagtgagggaatgtaggaaggacagtcagatggacatatgtacagtcaagctgggatgcagtgaaattctgctcccttagcatatttattaggtatagcacgagagtggggtttttgctagtctctacaggaagtctatagggaacagtctcagactgtacacatcctggaggaggaagttgcagttgttagtctttgcacacactgataatcattcataatacttggtctcctaaggagagcatggccctcttgagtctggccccataggtctgagggtttggagtccttcacatgggtcatcgatgtcaacaacagccattcactcaggatgtcacccatgcagggcttccttagctcagcttcccacaccttataactctcctctgtccctcagccctgaatggccctgtcagttacttgttcttttgaccccagcagccttctccttcacttagctcctgggtcttgacaggctgcagccaacatcaggggcacagtccaccccaggaaatgtcctcttgtacagctgggcaggttgtctccttccctctcttcagtcccaccaggaaaggcaggatctttctggcctgacctcttaccccttgatctctacacatgaactcttctgatgggcactcaaggcagctcaaaggcttagctactcctccttcgtgcccatcaccaggatgtttcaaacagtaagtcagcctgtctgactttttcacaagccttccccgacttctgccagtggcaaagtgcagtaaggaggtgatccgatgttcctgcccagctcagctaccctgcccaccgcattagtggacacaagtgcatctaagtcatttactcctagaaagacaagtgggattctgggtcttctaaaatcttattagattcactcactcgtttgtttctttgtttatgagcaaatagggcgggtacttatcggttccaggggtgcaacttaggttgggtcattaggttaggttagataataagtgatttcaccagctgagctcatcttgtctgtatacggctcttgcttgagcaaaaattctgtgttcttcctctggtccttttggtcttagccaatgagcaaaagccgggaggaatgtgtcagttcctctgtggagccttccaggttcctggcttgcgcttttgggcttcagtttgtgtgggcctggcaccgctgggtatggtaagttccctaccacacagatatgacatggaaccgcagcagagaccctcccaggtaaaaatgaggggatctggaaagggaagcacacaggatcacagaaacagtaggacagagagcttgactggggacagctctgaataaagatcatggccagacccaagctgtaggtaagctggtgggctgacagtgaaaccagagttcatggacaagaagagctaagtttctgttttagttcaaaggtgtgaacaaacatctcttgatagtagatagtgctggggacccttctgaaatgaagagctgaaagagctgggcgggctctctttgacagccaaaagccacaactggttggagtggtccagggacaatcaagaggttcctctgccaccatctgtccgccttcttacctctcagttgttcaggtagcaagagaatgaaacacatgttcacgcacatgcacacacgtgcacacacaaacactcacacacaaactcacaccctgactggtgcaaagcccacacaagaaccctgggatgcagcaggctgtattgggctgtattgggctgtattgggctgtagagaggattgaacagttctggacttttgataaggctgcctggttccaagtccccaggatccttaagcaagttcagtctccgggcgggcagtacaccaaacaagaaaagcttcggggagattcccacctttccaactttctctgaaacatgaaataggcgtaggtatctctcaaaatttggtgggtttctcttttctctttgcggtttgatagctcttcgcttattggtcccattttatatcttatttgcatggacatacattcagccaatcattgttcacttggtccaacatcaaccctttcaacacttctctttgcagcatactttgatggagagaaggcttcagagccagctcctggctctggtcaagtttccacatcctctgtggagaagaaagactgacctcaaaatttaagggggacagtcctgtcagaggcgtccatgcctgagggttccagaaaccctctagactctggagttgtaagcttgctgccagtctctgggctggtaacctaaagtctgcctagaacatggagctgtatgtaagacctgaagcctctcttggttggtatcctgctgccactgaggctctcaggattcccactttcctgttatgtaaatcttcactcctgtgtgacaatgtaggtcccctcattccctcctctctctgctcactctcttgttggaggcaaaggacaagcatccaagaaagcagaactaatcatctcaattgggcaccaatgactgaccaaagaaacgattccacccaagcctcacttagggaaccaacaagtttattggtgcatgggtgacttcgtagcagctgaaccactgaaaagtctgacctagcgtggagaaccactctcagaatttgcatccctagagctccctgtgcaaccttcaggcagttccacagggaagtctcctgctcagaagttgtcattacttacttgactggggaaagggggggggggggaggggagcatgtctcatggatcttacagcttcatgagtcttagaagcctcccttttctctccaggagggaatgctacaatggcaaagaagttgggcttaggactgtgtgcatggacacaactctgaatgattggcaaaactcaggctcaagtgcactggccattctcctgggcatgtgcctatgtccagctaaccagactacctcctccaggccagattaacgggctcatacacttgtagcggccctaaaggtggccaatgaaatcacctaaaccaaaaagaccactgccctgcaattcgacagccatcagggaactaatttgaggagataaggaagacaggaggagaaagacggggtgctgtgacctcacagccacctaccagagatgtctgcatccagccaagaataaagtaccactggggttgctatgtggcagaatctagtctctgattatctatgaggtgactgaccacacctagttgggcacctggggtctcctggagtgaggttctcagagactaccagcacagccacctgccagagatgtctgccactcggccctcccaggggatgaagctgagctttggcagatgcctcccagcagcctttgatgaccagctggagccaccaagagcaaacctaagtcagcttcctgcttcccaaggactggcaccctcattcctctgtagcagcctggcctggcttgtctcacacaggcctctcctaggtctttacactggccctgatgcttaggtcattcctgcctctgcaaatggcccttcctctctcggggctacacggttggcaggtcttcattctttctcccgctcctgatccggccctctgagcctctgctaggcttccccacgtccttgaggctttcagtagacatcttcttctaacatggttttcatcccagcttactgctttgtcctctgctggagtcgtggggctgctcttggacccaggaaagaaatgcagtaaaaactccccttgatccagtgttgaggacaggcctcaagcctctgccttaggtgctcagagccaccacagtgctgtatggatggattgctgccttctataaactgtgtggcaatcagaccctgcttgctctaatcatgcttgatcaccctgtgcaagggcactgattgcttctttgagaggttgcctcagtctcggtgtcagggctggagcctgtggcagcctaacgagggtaattcaggcagagctgattgtgccagaaagttgggagggctcaagagacagaaacgggccatgtcacaccccaaacgggaccacatttgctaaatctgtttcccatgcaattttatggtgattacattgccttttttttttttttttaactgagcaggctggcaggacagttcggctaggaatggaggactgattgtggcttatggaatgccttcagagcccaggggaagcagtgtggcctggggcctctgctccccaggttgtctgaggacagttcacctcaccactgggaagcttactccctagccttgtgcagtaggtgaacgatcatcagacatggttcctagggaggtggtatgcctccacagcagaaagctgtcagtgctactgtgcccaactcaacacaacaccccgccaagctgaggagggcaaggcgaggtatctgagccacatcatcaaacagcagacttatgaactcttccgcccatgaaactggatgggtgtgcacatgggcggtcccacaccaggctccttagtgggaggccatggtgatcctgccttatagatgggtggctcgcagtgacgactgtacatggtcctgccacacaaccactgaggaggttcccgctctgttccaatgaggggatatgctgtttgttttctgcattagataaaactgtggggcaggagttccacggtgcccactgtcacccctgaggatataagctatttctgtggtcacctcttggattcccatcccactaagactcagagccacgagctttagcaaaaatgtttaatctctccttaatgtgtgtttatttacaagtactaaatctgaagaaccgtaaaataggaaatagccgtatatttacacatctgatggctgagcgtattggctctgccgcttccagagaagcaatggccgaggcctggtctactcagaccatccaaatgaccagggattttttttgggtgggggtgggaggaagggggtaagagggagtgttctgcggcattaaaggacagctaatcatgggcttcaccttaaaaatatctttctctctctaaatatatctactctagcttgtgtagcaccgatgtgagccaccagatccaactggggaaactggagtagagggtggcagtcggacccctctgaaccaacagaggttgctggcctgtgcctggactcaatgcagtgtctcttggggacacatcaaggccctcacccctgctgctctgtctagctgtccaaccataagagagtggggcagctggagagcagagccagcccaaggcatgtggaggccaggcacccaggcccagcttggaatggcccaggcactcctgagtccaggtgcaaagggaaagaccaggcaggaagggggatggggcccatggcaggacggcagtaccaagagtgttagggccaggctggctggagtagtgcttgcccacctccctgggccctaggcctgtagagggtggctctgagcatccaccacccagtgtgcagttggctccaaccccaagccatattgaggctgaaacggaaccctttgcaggataccacagagatggatggctctagaagaccaaggacaagcagatgtcagagcccagtccagaagtagcagggaaatgaggcctggccctgatggctgtgccgagaagatgcgtggtaagaacagctagggcagttcgcatgtaaacagaaatgctaaagtgcttgcgaacaaacaccctgggaagctgctccaggccacctcacctcctacctgacacccacatgggcaaggtggcctgtaggacaaagtgaggctggcctattctgagggagcctggggacgtggggctggatagtgaaggcattgagcctagaagctgtgcgtgttccaggcagagctggaagaactgggggcttccatctgaagcctacaaccagggaagactttaggggaaactgaggctcccacccaggcacagcctggaggcatcagaaggaagagaggggtatatccatgggtaaaaccccaggcaacaacaggggcttctgagaaacggctatatccaggctctgaccctagtatcagcccagggaatgagccaaagagttggggtgggagtctgaccagaattcatggcccagggtgtctaggctcatgactaccacagaggagttgctccctgagtccttgtacctgccccatagctaataaaggtgcagctctaatctgacctccaccctgtcccatcggctccctagcttggagtgtgagggaccacaagactagcagcccatggatgtggggtgtgctgtccccagcactgataatggtcctggccacagttagctgtcccttaaaatccattataatctttagtaccatcaaaaaggtgaacttgaaaagggagtaggccgcttgcttgcttttccaatgactaattaaaaaaaaaacatttaaaaaaagggtctaaccacctctagtattcaacacttgcagtttgaaaagatcaactcagactaaacgctagcacagtcatgcaggtccacagctctgcacccaaagctcggggcacggaatcgtgggcagcggcttcttccatctgggggaagtagaggccacatcagatggcagctccagggcccttggttttgctctcttccacctgggttcctcctgaattgcctttccgtgtctcttccctcaaataattgtacagcaccccattggggccagggccacacacacatatatatatatacacatacatacatatatatatgtacagggtccattaaaaacgtactgttgctccttgagggcagaggtggacacagttgacctccagtcccttgggtcactgcccatggtcagcagggtggcagaaatgccccccacatccccagggcaaaataccacaggatttcttgttcccttaaaagcagtacccagatgtcccactgcagaggggccaggacaccgttgagaggccagactggaagccaccgggaacatcaggggaggggaggataaaggatggtgggacggtggcctgttatcctccagagctccgtggtgggctgcgataggagcaggaggcggggaataaataacgggaacatgcactctgactggagccccaggaccaggagctcccagaggcacagccctgaggacagagaagggttcgcctagccattgtccacatgtcacttggaagtggggtctgcaggccctccataggaggggagtggggcctctctccccagcagaaggatgtggcactccagccttggccgcgcagagcacgcggtgaatctgagggtggtggcaagcacagggtgctagagtagaggctggtgggacagccccaggctgtgacttatgtggcctagccttgggtatctcacctctccctcagactctgcctgctggtagcagctgaagaagccaagaaatgtgaattggtccagccccttgtcctgctgccctccttctggagggcctggccttctatctcggcccctcagaggccacctctctctcaggaaaaccactagcagctcttgccaagcagcaaatatccctgggcagaaccagccacgctgtgctatccttgccccacggcagcaagccccaggcacagaggcggctcagcaggaacccttacatccacagcgataagaattggccctgcatggcagggagaggaaggcgagggccaggacccaaccacagcccccacacctggacttggtacaggtgggccaagggctgtctcctgggtcctctgctgccctcctgctctgcctcctgctgggtgggcacttccagggctcagctgctcagggccattgtgtccaccacctgctccagtttgcttcgaagccgctgccttcgagcctgttcatctttctccagagccaccagaatctgcaagggtggggtgaggggtgggatagggtcagagtcagggttagctacccacagatatgggctggaagctctaagggaagcagctggaccaagacacatgaccttggtgtgtctgactcccagttcctagctgtgccaacagttctgatccagagtactacagcacttgagggtgagcccccaagctcattacctccaccctcatctccctcatcaacaggctgtggctcctggctatggcctctcccaccttgcccttctcaggcttctgggagtcttctacggcagtgttccacaccctgcttctgatgtggcatggccactgttctctactgtggctgggtttcttatgctcttcggttgtcttctcgagtatcacactcctacctcagtctatgtgggagctcaggcccagcctcccatcctatcccttaatcactacaacctgtgagcccttccatggctggtttgaacccggagcccttctgagcccaaggcttcacgatcttagacctgtctctgtggcttcccacctccagacaagctgcctggctatctacctcactggctcagcacagccaagcagaccatggtctccctgcctgtctagatctataagaatccatcaggctctgggacacagccaagctccaagcctccacacctaggtcaccctggtctgtatatcttctgcctcttcccaggtgggccctagctcagccatgtagactctatggatcttggcctgccaggccctctcattgccttggccagcactgcccacacatacccagtccttggctattggtacccataagctccagcccagagtcagagacaagttatcccagagagaagaggtaggggagctgcttcttggcaaaggacaaggagcaacctttgccaagcccagagataccatccagcccaataaactactataggaccacagctatccattccaggaaaccactgtcaccctgtctccccaccctgccccagagagccttctttgtgcccagaatctctgattttcttactagccctaggaaaatctgggctgtcagatacagaagcaaagcaagtattgggtgagctctgagacataggtggaactggggtcggggaaggacgcacctcgtccttgtacttggcgatgtaggagtagatctcgtgcagggcactcatgctgttgaactggctgagatgcagccgggactgctctgccaggtaggcgctcatgtcttggtcactgattgcaggcatcttggcaatgtcagcatagtacctgacagtaggtagcagggtcagcatgggtggggtcacagggcctactcacccaccaacctgtggcccctgcatggcccctgctggacacctacctttcaacccagctcttgtagttggggatgtccttggcatagagcaacttgttggagggtgagtctttgcccagcttgtgctctgatgtagagcaggagtccatgaaggtctgcgctaccactgagaggcaggcatctgttatgctgttcttgtggatgtcgaacacgaactgagggttcttaatcacattcacccagaagcgcagaggcaggctgtggacaagcaggcccaagagtgctcaggatggccattctgcagcccatccccttctggacagcagctagagtggcctgactctgtcccccagagaatgagtggatgcccacatgctcaactaggacaggcccctcaccccactggccagacaggacatgctgccaacaacctggtgcctctcagagcatcaatcctcacgttcagcttacgtccatggccatccctgaggcctgcactggcttatatcctgcccctgtgctcatctccagtccaagcacatatgccttcacacctaccccctatgctccacaaggcctcacagacagccttggctgggcacccaatcataacacatgcttttcaaacattaactaaataaaaatggagactgaggctattgtgaccataggcatgtgccaaaagcctgctaactccacatggctgaggcagttgctctagaatagccagtgctgtctctcagcagctcctcccttgctgggacccctgacaggcagcccagatggacctgggtcttaggctcccacagccctggagggagacaacagataaaaaccaagagggatcgtgagaaggggagaggaggagtacagggctctaggctgaggccaggaccatccagcacactaggccaagggtcatgagattaggaaagtgaatggccaactctacttgaaggtcagagcacaaattcagggtaaaaggtgctaacgggtgtgtggacatgaaaggtactccctggagggaatgtagaatggaggtctggtgcaaacttgtaggcgaggaaggtcaactgaccagtcttcagtccaagtggccctcctctaaagtcatgggctatgggggtgggaagaccacacacagtggtagagcctgctgggtcagggttacatacagcagaagcccacaactgtgtttgacagttaaagccagagaatcctgagcagccccaatagggagcacggggctgaggggcccatggctaggctgcaggcatcaaggactggtctaaaagtataggtggtctattctgggagaaggcaggtcagggctgagcacacaggagtcacaggaagcactggagtggacccactggggtctgggtggcttgaattctcaactgctctctgaacacaggcttgtgctatgaacatcacttcctctatgttatcaattgggtctggcccaccaaactctgtttcttacaaggcagcccctcacccatggaattcctacaggccagagtagtggggttgtggcaggatccagggctggaaactgggaaggtcctgggtgatcctgacactgtaaggcccgggccctggcagtcccacccctatggtagtcgcaccaattgctcttccaggtatggcgcacatctgagtcgtggatctgatgcttgtcggcctgctcatctaagaagtcaaacatgtacttgatggccagaggtagggctgagccacggtgcgccgtgctgaagatggtctcgaacaggtcatccacgaacttttgtagtgttccctgcagggtgagtagtgagcttcagggcggcccagggcactaccctcctaggacctggacaggtctgtaggagctctggatttggtcatgtgtgctgggcatcttcccatacacctaccttggtggccagcagcctggttaggtagatctcagagaccatcttgctgccacggtcgccttcacgttggtccaggtggtcgtggttcttcaccaggtgccacagttttgttccactttccaggtctggcgtgatcatgggtgttcgtgagcgtaggctgtcggggctactggctgtacgcagcatgctctctgcaggaatagcctgtcagctggcagggacgtgtccctcacccatggccagaccctgccctaccccagccagttttccttcagagggcaccaaggctcctgctaggtatgttggggaatagccactgtggtcacccgaggtcccttgtttataggctatggggacaggcattgtttcagaactgacaggaaggccacgagccacatgtccccttagtcctggcatccaacacactggcagagcagtaggaagggcatcccatccaagtccactgcccacccacttcctgcttgcaaccctgccggtccctcaccgtatctgctgagggacttagtgaaggtagaggagttggagatgttgtaggccgatgtctgcttgggtactagtgccaccgatgacccatccgtcacctgtgggcagacatcaaggatacaagtcccagggtgccactaagtgtccagcccaacctgggaggacctaaagacacccgtggttctgcccctcgagagaagtcatgccaccactctgaatctccactgggatggttccagggcagataattacttgggcatggcacagtccacacctgactaggcatgttccagtttaagggaaagaaagcccacagtggtccctggatggtagcgttacctgatagtgagctagtgtgttcagcctcttccagtcattgtcaattttagtggtgacgtcctcgtcctgaaggatgatgcgtgccatgcgaccctggcgccactctacaggaagtagggtattagaggtgggacccccccttccttctctccctccttttcttcctctctaccttctatccagctcctcattctactggcacatagaacaagggagtgggggaagagaggaagacagggaggggcttgctctgcacttgaggaagagcctgggatagagccagaagccgaggctcctccactggatagctacactcacaggctcagaggtggcatagtctgcccatggggttggcctttcatctggtgcttggttgagcccaagaggtaggccctgctctacccaggttccagtttcaactattccagacatatctccttaggatcccagaactgtgtcccacatttttttgacttttgactttccccagtgcaaagttctcttccttcagctcagacagccctggcttcccagagaatatcaaacttacacccagcttcttctccacgggtctcctccatcactctactctggcctgcaaaccctagcttaccctgtcacctcccttgaatgccttcctaccataggacagcatcaagggacacttgcccaccactcacccaggtccatgtccccggccttcggccgctgtgagtaaggcacacccttgtacacagcatccaggagcttctccttgacctgggtcacggtgtcacagttcagccccttcacaggaacctcgggcgcattctcatgttcagggttcacgcagttcagggtctgtgtgtgaggagggtggtattgtagcaccagccacacccctcacttctgccagtcctgtccactcagttcagttcactggaaggggaggacccaggacgggggcaggggagtgggtgggctcaccagggtcttgtagtcaatctgctgccgaatgagcttgtcttcgctcagagagtagcgggcctcccctgtgatggcgtcaatagggcccttctccatctgctgcttgatggcacagtacagcataaagagcggctccccagcacactcctgtgtggggtggtagggtatgaggctgggattggacctgtcagccctttaagggctatctagctattttcagaagctccatctcttcttgaaggcaagcctgtctctggagccagcaccaggcaaggatatctaatgagcgacacccccagtgtccttatgactgtagacacagaaatccttgagatactaccctcactcacaccaagtgcgatcatgatctgctggatgatcagcctagaggccagcctagccagaagtccagcatcacgaagagcatgctttcaccacaatcaccagccaaacactgactcctgatgttccttatcaccaagggacagaggaacccacagactggtggcaaggagaaacagggactggcagggtagcctctgcacacttggcaagagcctgcattgtccctaccctcagctgtcatctggctttgtgcactgcaggtgtggggccagaagtagggccacattactcagcaaggtgagcggggcaaatgctggcgctcaggctgctcccatggccctgaaggcccacccctgactgtagcagtcactcctcacagaggctgctgctggctgagaatgcctaggccagaggctagcccaggtgagcccttggcaagcccatggtgactctgtacccagatgtcctagccccttattagcatctgaggcaattaaagagacagctgctaaggaaggaacagccaggagcatcgatcatccctagaccttcagacaacactcctgtctttgaaattatgtttcatttgcaaacttggcttcattaagtcagctaggaagtgggagggagggggagcaggttgggactcagagccatcaatagctgcctcttttggcaaacactccctcataaggtttccccaggttagattgcctgcccttaggttcctgagcagagtaaaaggagcagaggcggcaggccagtgcccaaagccttggatgcagacccgtccaaccctaatgcatctgccccagcaaagccagggcttctaagagaaagctcagacccagaaggacctgaaggcctggactatcactttcaccagtctttccaagaccgtgaaagagcagtcagagatcagagcccagggaggaggccggcccagaacaaagcagacctaagcctagggctttctctctctgggtctcatttccctgtcccattacaggggaaaggtagggccccagcttcctctcagccctgctgagaaggtgcagagaatagtcctttcatagagaggcaacagcgcaggaggagcatggcagtaaatgaggcacggcaccagctttccatcttcaaggagagccaagttgacccctacctcataccatgcacttgtagcataaacgctacagatgatggaatgttgtatttaaaataccacccccccttaccaaattaaaaaaaaaaaaaccctagaaaatacacaattgtggcttcaaagatgaaggtggctagtcaagcaagttgtttaacttgtagaataaacggcagccaagaaagcatgctgtccgtactcatgcacatctccagggatggtgtcacagcacccaggccaggaaggctctaagtcagcacagcttatgctgcaaatgaggatgcagctgtgctcattctggaagccctcacagctccagcagaaggctgctgtgttggggagaattcacattcccctaacaccctctgccagtgtgacagaggacagtgaaagtgacagtaccctgtgccacctgaagacatgggcctaaccctcctggggtggggtaaaaggaagtgaggagcagggtggggtaccaggacccctgtgaaaagcactgggggggtaggcgtggcaaccacagccttggaggtaggaggggtagggggtgaacttcggaccagcacgtcactacagccagacctcaagacaaaaaatctgaacaaaacctgttcctctacctgtagacatttgcttccattcagttcagtgacccacactgaatattgatggctgtgaccaccagagctggggccctgcccccttacctcacattgttgacagtgtagtgacagacaggcagagcaactacctccctcatacattctagtcccaggcatctgtgagcaggggatgggctcagaccctgcccaagtgcagactcatgagaacaccatgcattctgctttctttcccttctgttctccccaggcaaactgagctgtgtgtgggggatggctatgctggccaggcagggtgattctcattctaggaagggaccgctcatgcttctcagagagttctcatggcttaacacacccgcatctctagttgtccattacatactgtgtgctgtagctgaccacagcaactgacccgaaggaaagctcagtagcggtgcaggccgcacatggctgtcagaagacacagctctgcagccacacacctggtcaaaccagccagcaatgcaaggccttcatggataattctgcttagagggcacccccacatcagtcaaattcataggcagaaaggagaaaggtggtacggtggagggagaggagagggacaaggagtgtaccatgaagacaagaccaatggtgcagaagatgttgacaagggctgcactttacagatgtattgactctggtgacctgtacactccagaggctgaagcacgaaggtcatgagctccaggccagcctgggctatctagggaggccttgtctcaaacaataagataagggctggtgagataactcagcaagtaaagaagcctgctgccaaccctgccaacttgactccgatccctgggacccacatggtgaaaggagagaacccacccctgcaagttgtcctcccacttctgcgtgtgcattgtggcatacacccacataataaagaaaaaaatgtaatttc

SEQ ID NO: 286 - DNA, 10254 bp, Mus musculus
caaggttagaacaatgcttcttagcaccagtaccttctaaccctaaccctgtgatagaggggaagactgtttcatgtgttacatcacggtcagcagggcagggatttctggaatagggtttacacgacttttctgtccttatatggaggttgggggtgtgacctagagccagatggatggtaacaggaattttgcaaggcccaggctatgaagatgtcataataccaggcagttagctgtcatctcaggccatgctggtcccagctggtttggagcggtcttgagtttactgttatgtttccacatgcatcctgctgtgagacagctctcggcagccacgcctgtcctagacatcagttgagtgatagagtctttcatccctgtccaagagtaagaaaatgagtgctgaaaatcaactttccaatctttgggggtcaggaggttacagccgagtgagtgagagcaagaacaagctaacagagaagcatccatgtctgtcctgggggtgcctaaaggtttgtttctcaggaaacttgggtactgcctcctggaccactcaactcctgttgaggtggccttccttctcccctactgtgtccatggcagttgacaaatgtcatggctttggaaggcatgtcatttagcacgtagtagtcactccggctgcatatcagatccaaccagctttgaccagttcaccagaagagggacttcaggcataaagacatcctctccacagagaaaaccaagatgagggtggaacagagaatgaaccagtcacataggccacacacaaggcaacacatctgccaacagaatgccctcttgcagacttaaattcaggaggggctagagagatggctcagcagttaggagcaccgactgctcttccagaggtcctgagttcaattcccagcaaccatgtagtggctcacaggccatctgtaataagatctgatgccctcttctggtgtgtctgctacacacagctgaagtgtacccacatacaataaataaataaataaataaataaataaatctttaaaaaaattcaggaggaactgggaagataacagaatatggtgactaccctgtcaaaccagaagagtagagcccctgcttcacagaggagagccatttggaaggtcagtgcagatgtcatccagcaggtggtgacagccacactggtacctggaccaagacagagaagagtcccatcagtaggaatcccaaggcaaagtgaggaaacttgagtgctttgaataaactaaagtatgattggtcaggaaagggggatcttggggccttaaggctagcagaatggggaaggggcggggtcctcagccccagccaggatacctgcctcaggggacatttgtaagccagggagggtgacaggctgtggctccaagtacgtacagcactttgaacgcagggaaaaattgatcatccaggatgcccaattagaaaatacttttgacaaacaaaagcatttggcctgtcccctactttgtacgcaggtccggacaaacacgcttcatgcaacgatgccgttcctaaccacagggcatgctagtgtttctatttaaacactttctaaacagtgaaactgcatgactcactcggctgatcccatgactcattaataaatcacaacctggaggtgtagaaacctaaggtaggaagtggctgtgacactccagagaggaattaataaatagaaagattcagagacccaggatggagcaaacaggacatagagcgaatgcagaatgagctaagagacaggaggaggatcagaaagatcatggccagaattcaggcttgaaccatgggttctcaaaagtcagggatttggggctagacaaggtgtataaagatagagtggtttggtttggtttggtttggtttggtttggtttggtttgtcttgttttggtttttaaatcccacctctcctttttttttttttttttttttttgtaaacccaaatgtattctgtaatttaaggtgtatccaaaaaacagcattgtataattacaagacttttcaagcttttattaaggcaagaaacaaaatgatggagctgaccaagaactcagtgtaccagtgcaggtttgaggactactcaaaacaaacaacgtctactaaagacttagctgggctttgctgtggtggaatcaggtttttcaagacggagaatatgtgtgttaggtagagcatggtctatttatcaatcctgttgacagaagtttctgcattgggctaacatgaaatttagagttcacaattactagtctgggactcttccaggcatttcttagggaaactaaaagatagaaacgccatgaagtttattctgcacgcactctctcgcagagaggctcaaaggatatctttcctgtctctttgcgcagcctccccagcccctccccagtcccaggcttcctcctcccaaatcttttcttttgcaaagcctaggcgtcttgttgctaatgggagattttgaacaatgggtgtttctgagccggtttatggaggcggtcttgtctgtgtcctggggggagattgtaaatgagatgtcaacggggctcctttgtgcggaccgcattcatccctcccgggaggaattcccttacagagctgggatttaaagtcgatttcttgctcttcctaactttttatccaacagccagagcgagcgtagggcaacaaatgaatcactgcgggctctggtatctaacttcctggtttagcaaggaggcaatgactcggctatttacatgtagaaggaaaggctcctacttaaaactttctgggattattctcagcagctgagcctctttacctgacggttaggaaagctggttaacccctatcgagggagcctagctcctagctgtttttcccacccccttttccttgattggttcgcttctccttttaaatccaaggaaagaaagaaaccacaatttcgagctgcctcaaaccatcgtctcccctttccccttccggtttctcggtggaggaccgcaattctatagctataattacagcctgcaaagctcggcctaactccacccttaggagattaggctacgttttattgcctctcagccaccaggtgcccaaggtgacaagcctgggctttatctgagggcctgacagggttatcagcaactcaaacgggctgaacctcgggccatcaaaaaggtttctctaaggtttcatcggtagctgatttacatctgcaccctagccctacttgcctcggtttttccttcattccagatccttctccggggattttggtttgggacgaaagccacagtgactgggcagtttcagggatgagcaaagtcagcctcgagcctgttccatcaaggcaccaagcccggcgacaccaacgctcaggaggtttttagtgttcatggctgccttgtggatttgttcttttacagtcatttctttattgagaaagggcacacaccaaggttagaggccacttgccagagctgttcttctcctgccctgtaggttccagggattgaactcgggcgagcaggcaagtgggatttaccctccgaatagctgtcagcccaaagttgttatttaatgaaatctgacccgaggtattagaaatcggaaagaaaaaaaaaaaagattttttttattgcccttcatttttatggttcattttaaaaacaagaatctaacacacaccaggaagtgggagcagggctgctttggggtcataagcatgtcgaatgtttgatcagtcacccatgcagctcactaacataactgtgtacccacacatcagttttgaaaagattgttttgacaatgctgggggtgaggctcccccagatgctaggcaggtgctatagcacctcagtttattctgtaatgcaagctgtagccaacaattatttcagaatcgtctaaactagagcactgagccatgcatttaaagatgatctgtgtagagttccaatgaatgaaaagttcatttgtaaacaaactgtagccaaacggcccccacagaacctaccatggatccaccctcctgtcaggagaaaaaaaaaaagaagaagaagcagcagcctatctatgaagttgacctgtgggcgaggaacaggaaaaaaatcttccagataacacaacatagattatacagtgtttatctcagaagtcccagcatacagtaccatttggaatgcagacatcctcctaacctgtgacaggaccctccagggacctttagcattcccgtaaaaactaacaaagtttgtcttgtgcgctggtgaaccaacagacacccagaactattccaaacctgactgcacaccagttgggtatgcggaagaggctgagatgagaagatcaggagttctaggccagcctcaactatacttttaaactaggtggctcatgcctttaaccccagcatgcagggaacagaggcaggcagatagatctctttcaagagtagactggtttacagaggtctaggccaaccagagctacatactacacagtgaaaccatggctcaaaataaaacaaaattaaaatataaaaccttgtataccctctaccctctattggtggtccaataccaataccacacagacatatatgtgtgtgtgtgtgtgtgtgtgtgtgtgtgtgtgtgtgtatatatatatatatatatatatatatatatatatatatataatatagtatatgcagtatatagtatatagtgtatatgtagagtatatatgctatatatacttagtatatatatctatgtatactaagagttgacatgtgggtttgagacatgactccaccagccacatttctgaaaactgtcactcaaaatccgaccttggaaccgttagacctgagagaaaaactactaacagtaagccgacagcaggagtttcacagctactatcaagtattgaatcactgtaggtcagcggtgtgcaatccccaggactgggagttccaggagttgttggcgaagttttccaaccagtgctccagcagcacgggttctcttggaaagaatctttttgtcattgttactgttttgagacaatgtctcatctagcccaggctggccttgaactcacaatgtagcagaggcgagccttaacacctgatccctctgcctctacctctccagagctaggactacaagtgttcacctattattagacagcagatacagtggcatgtctgaaaaataagtaggcttcagtgggaaggacatcttccaggccaggtctatcctgggagagctggggcaaaacaacctctctcttggcctcccccccccccccacacacacacacacacttttaatctgctgactacaccctcctctgcagggttgtttttggaattcaaagagaccagctacagccttgggttcattaacacacagtgaatgggggatagaggttggagtaacttgataacaattttaatcttgacttcaaagggactggaaggttgctgggttttgtttcgtttaactgaaaatttttggcaaatgacaagcatccgcgccccacctgtctctttatccacgctagaaatacatccctgtacatggtaggtgtgtgctctacggcagggctatacgctacggaggcagggcaagttcagccgtcagggatactttaaatagtcttgtagtcagaaagatcccccaggagcacctggaaagtttcttccgatttgtgccctcggctgtcgaggagcagcagttaaagagagtctgtccttctcagggctgctcttgctatctgagtatgcataagaaacccgcatcctaacacgcatcctttctctgaggccattacagattaacttgtagagttttccctttgaaaaaggaggaaggagtgagatgaataattaagagctaaccttcagagaccctgggaggcttgcacctcccacaggccccgccctccccggaccctgctggaactaaccggaaggaaagaacggtttcctttctggcttctccacaaatcgcggtttccaaggcacaagattcccgacctccttcttcaggccgctctcagtgccaggcactgagacaaggaggcatcacctgaggctgagatttagcagacccgggctcccgtagatgtgatttgtgaacaggcctctcacttcctgaagcagcacagaggactaccatgcgctggatactctcctcccattccggagcgcgctatggccttggccccaggaagagtgaatcgcggctgagatctgtttactaaacccaggccggcagacgtttgtggtccccatttgggtttgtcctaacactcagggactccatgctagttctgttgaaatgagaagggttcttggaaagatgccatgataaaacccaaatcgtgagtgtaacctaaaataagagactttcaaaccaggctgaagatgcagctaagtttgtggagtacttgactagcatgcaaaaaaaaagtaatggttttagtcgcagtacttcgtttaacaaaaaaaaaaaaaaaaaaaaggcttagtggtccatgcctgtaaccccaccccttaggaggtgagtaagatcagaagttcaaggtggttcaagctcaatatcaaaacaaaacaacgaaggttctcagaagggagaacaactaccttggtgtgtctgtgatcccaacccttggcaagtttgaagctggaggatgaggggctcgaggtcagcttcgagtacacagcgagttctagggcagcctaggccgtgggagacaaaaacccagtaatgatgagtggaaagaactcgtgggaagcaaagcagtcacagataagggaggtttggtatcccgggccctcagcagcaatctcatcggacctgagtgcaccaccaggcagacaagggaggatgttagctggataaggcacaggagtagagatacgttcctcatgttgatgagaatagaatcccaggcctcaggcatggatgactatccaagcatctcaacactggcgttcgacgtactagctctgtggcaaaagctgactagtcgtagctgaacttagccagcacttgacgagtgccaacagaactggccacaactgcctatgtagtagctttggtagctttggagcattgactgtagaacaccctcatgtgctgtgtcctagtgtactagaacattcagctactgtctcttgtatagtatttgcatgtagcctgttgcacatccggcaatataagccattttgagattacttcttacagaaattcaatttctttctaactgcaaatgctttataaatattgtttttttttattttgtggttctagagagcaaacccaggacctgcccaataccagctaagcactctactactgaaatagacatatatatatatatatatatatatatatatatgtatgtatgtatgtatatatatactctaatactgatatagacccataagcctcactcgggatggcctggaacttgctatatagactgcaaaaacctcaaactcatagagatcctcctgcctcagcctcccaagttctgggcttacaagtattcaccaacccaatgttagttttctgagacaaatattcaacttgtagcacaggctggctttccatttgcaatctcccctgcctcagcctcctgcatggtaggaattatgtggacatacaccaagcaaatacttgttatactgtctgtatatagagaatagcaaagaaaagtctgtgcgtgttcaaaaatgagtcaattcaagacagatcagattagattaaaggccggtttcttgggaagctgctctggaggtggggggagacggggaggggagaaagagtcctcatacaaagagggaaaaggagaggaaagagagagacccaaacgtcaggattagataggaaggagccactaagggaatggcagcccagccctggactggaaaattcaatgatgggagcagggtatgccaggtagggagtgagggatgctgggagaacctggaggccaggtctgctttgatatatatacacctcagttgcttgtccaggggttcaaaaccaaacacttgaacttctgatattcctgagctacaggtatgtgccaccacacccaacgggcagccggcttttgtcaaaactcagtctgccctgagggcttggtagaccagctgcccaaacaggaagccttatataattctgtaaccctgaccttgggccctgaatctctctcttctgtaaacagtccattcaactcaggaaggcctgtaggccagacggggacatattttgaaaaacacacaattacaaatgctgaaaaagaaaaaaagaaaaaagaaaaaaacaaaacaattccctaagcgtaagaggaagtgactgtgtctgagtcaggggtagaaaaaaatccagaaagtcatggaacaaatggcaatgacatcttcctggtgatgaatgtgccaggacggccgtctgtgtgcacagttgactcaatagcacctgttggcaaagccgggagatgaagtgctaaagagatcgtattcccatctgggaacaacacccgctgcctgggaaattagtaaccctgaagaccgaaatgtccctcccgatttcaacacacggttccctggctctagaaaggctgtgtggttcacacaggccagcggccctaccaagcttactcagaccccccggccttaacctttgcccttacacgatgtgggcaaaaacaactctaacatctcatggtttcaggcatgggctggttttggcttatagtattatttgattgtcaagcttcgtggaggtctatactacagggctcagaccttaacccctggaccccgcgccttctgaagagacacctccagcattcttcagtgtcctctaatttagttaattaatgaaagtttctgagaggaccaggtactttgatctgaacctctcaagcttccgtgtaccgtttccagatgcagagccaggaagcgctgggtcctgtgggctaacagcgactcgggactgggcctccatttctgcccaacattggaaagggggtagggcagtgtctaagaggatcagacagcctaaaaacacagccgctggcattttactgggtgtagctgcagtctgggaagctgatctggcagtgtggaaatcttcagtaatccttataacacaggaacccagcagggctgactgggaaagcttcaaaacccaaaaggtgtctgtatgtggaatatacgagacaaacagggaaaatgggagtaattacagcaggaatcacgttttgttgatgctttttcaagacaaagcctgagtaaggagtccaggctggtcttgaaccctggtcttcccacatcggcctcaaaaggaagaaatcacaggcccgagcctcctgcaatgtttaccagaccctgttcccagtattctccctcactgattctggggaggaggggggcgtctgagtccagaggtttcattccgtggataattgtcaatgtgcttaaataaaagtgaagactctctacaggtagatctgctagcgtttacctttaatttccgcactcaggagacagaagcagcctagtctacatagtgagttccaggacagccaaggctaaatatctaccatatctcgaaaacaacaacaaaaatggggacattttgaatggattccatctctgcaccagagacaggtcggcacacttccacaaaacttaccagcgggaactgccgcggagttccgaacacgtgcatgttgttccgatgttggccaccagggcgtgcgagagagcaggacagcctgcagcacttaagtttgttttcccagactttgtcttgggagggaggaggttgggtgcgggggcagttaggcgagatgcagctggctcaaaaacaatccgtttgttccctgaaattatcccactcgccttttagaagtcaaaggttgccacgttacctgttgccaggttcctaagagtgctcgggggaaaatgtgggtgagaatggctctcctgaagcctggtggggtttcaagctttgcccaacactgacgctgacatttggagggcagctgcgacggatctgagtctagtttggttgcaggtctaatagagtggctgtgacttacatcctttacaggcatcaagtgcctggggcttccccccaccccacccccttcttttaatggcacttagctttcagattcctcccctcccgggatttctatacagtgc

SEQ ID NO: 287 - DNA, 3168 bp, Mus musculus
ggctagacactttcataaatttaaaaacataaatgttaaattttctttataaatttatagtagactgtcgatttttttttattaagtacagtaacagtagtgggagagtatattgaagccctagggaatttaaagttgttttgtttagcttcactccatggccccggctggccttgacctcactaggttgaccaggctggcctcaaaccttcagcaatcatcgtgccttagcttgccaagtcttgggctcactggcacctgctagtatgcttggctggggcaagaatgtagaagcctgtaaagatgtctgccaacctcactgaaaggtatccaagctaaccttacaaacacagagcagagacacacatacacaggtcgctctgtggttctagtgacagctcaaaacagtaataacctaaacatccactaacagaaggaacaaaaggctgcccgaatacgctggaatgctgtaaaactgcaaacaagtgactgagaaaatcacccccaacatgggactcataatgagaaaaacacagcaaactgtattaagatacatacagcaagagtggttcgtgtaacatttgaaaacacaaaggacagggacagtcattattagaatctggtctattcctacacgtaatagaatgtaaaatttcaggtagcagaacctatgtgacataattgaaaataggaaaaactatattgtgtccttgattcattccaaatctccccaccctgcaaacggtttaaacactattccatactcacatactatctacctgcttcagccctgcaaactgagaaaccggcctacgactctcccatgactacactattcactcctctcgcctgtatacctctggtcaacagaccttaatgtggcatttcctttgaatgtagtaaagactgcccatgcattgaaggtcctctggtatcttcgtgtgcatttctatatatcatagggcatgctgaatactgtaataatatggcacaacacatttttattgttactttttgagacaaggtttctctatgtaaccctgactatcttagcttagttctgtggcatctgtgtaatgctcacaaattctgtggaacccagtcatggcacaaggatagcttatttttacttcacaggtctgggaactcactctgtagaccagactgtcctggaactcagagagatccacctgcctctgactcctgagtgctgggattaaagacacgcaccaccaccacctatagcataatatattttagcaacttaagcagacgggtgccgagccctttgaggaaaggctgaatatggctcataaactctccatagctcctcctcagacttatgcccagctaccatcaattttggtgatgtccaagcaaagctcatgacagaaggttttgattcagttaactcaaaattttcaagttactacagcaaacatagcaggttttccaacactcagtaaagaagctgacagatgatcccagtccccagccatctgagttgttctagcagtggaatcttctattctggtcccagacctgtgaagtaaaaataagctatccttgtgccatgactgggttccacagaatttgtgagcattacacagatgccacagaactaagctttggtggtggcttgagaggcaaaacctggaaaagcagtactaatccaacactttgtctaattgccatatttcattttctcatcagacatttttgatgagtacaaataagtcattaattcatatgtacttcatcatacagatctaggctctgagaaattaccaacattaacattgatagcatagctgttagctttttctagtctaaaccaacggaccaaactaaataatctgtataacaaactagtaaggccactgtactttctgtctctgaatacatgtatattttatatccaaacacattctctcacatcagaaagagaagcaatacatctatgctattgtgaactcaggaagcaattgacatggcttcaattctgtgcagcattaatactttcttcctgaataggcaaatgcataaaaccaaagatgacaacactatttccaaaagtctcttcatagagataataaggatctttgacagataggaacaaatataaagacagtttgggtttcaaaaaagtcttagtcaaaatcagtctcctacttaactggctccaacataggctgtagctcatctatagtgccatgtagcatacatgtacatctataatgtcatgaagagcccaaggctaaggatgtaaagtctgacatatccataatgcctcagaagcagcaagctaacaagttaaattaagtacatgtcatactgctagcagaaaactttgttatcttctttctttctttctttctttctttctttctttctttcttttttctttcttgatgggctagggtctctaataatataggctggcctcaggataaggatgaccttgaataattctccatttctgaagtgctgtgattatagccttgtatcacaatgccccatccgtacagagacttttaaaagtaaaaacagaaagcaaagactcaattacccttctttcacagtaattggtcaacactgccctctggtgattcaatgtaataaacaaggcagcatcttttactttgattcagttatgtacctgcatctctttggatgtacatctcaccaacgacaaaaatagatttaagatggccttcattatgtattgttcataaaattagaaactttaaaaaggcttaaaatcaaagactctggaaacatgctatagaagacacacatcactatgtagtaaattacatttccacataaaacatgtgattaagaaagaccctgaaggcaaatttcctaaagttaaaagcacagtgggacaacaagaaaggtcttatcgggctggtgagatggctcagtgggtaagagcacccgactgctcttccaaaggtccgaagttcaaatcccagcaaccacatggtggctcacaaccacccgtaatgagatctgatgacctcttctggtgcatctgaagatagctacagtgtacttacatataataaataaataaataaataaataaataaataaattaaaaaaaaaaaaaaaaaagaaaggtcttatcatgtgtaattcagacatggtagcacacaccattaa

SEQ ID NO: 288 - DNA, 1269 bp, Mus musculus
caggtttccgcgagacagaggttgaactttattaattatcaacaacaataattaaaataaaagctgtgacgcggtttctgcttccggccctccaccacagtttggcgcggggaatggggaggagtttggtgggggctgcggcgctcactcgcggcttcccaggaaaacgtgagttttatttcccatctcttctaaagtttaagtaaaatcttcatttcttccaaaaagaaaaatcgttgagacaagactttaaacccgcctccggcgagtgagcatgcgcagattccctatctgttcctgtcccctcaggcggccatgacgccaaaaggtcaaatgtaagaactgagaacaggtagcttagcggttaagggcacaaacggttctcccaaaggtcatgagttggaattccagcaggtgctgtcatattttgtaccttcttttggtggctggacagatgactccgtgtcatggaatctggctccctcttgtggccttcaggtgtaaaagcaggcagtactctgtatacttaataaataaataaatctttaaaagaaagaaagaaaattccttatggaagtttcttatagatttgggagtgatgactggatgagcgatcctgcttccatttctccttccaggcgtcttcaagagctgagggtctgctctcagggccactcagagggagacagagacgctgcatttataggattggaagggaagcaaggacaggcgctgtaatgggaagagctcatcactagtgggcaaccttcccgggatgggaactggaagtagcagcgccacaccagcgctgccagcactgccgcaactaggatcatgggggtccaggtgcagggacagagcactcgtgtacgtttgcgcgtgtggcagggcgggggttggtgggacaggcagggaggcagggcggaacggcgaggacggcgaccctgagagctcagcaggatcccagcaaaaggcatagccatttggagagcataggagtcatgcggggtcacacccatggctgtgtcctccctcgggtctgtcctgccagtgccagggctctccgttcaacaccctcccacctctctcttccccctggggcttgggtcacacagctgtcttgggggcggggcgagggggcagggctggagggtggccagagttcacccaaggtttcctggatggcatggtgatcccggtccctggcagctgtaaccaatagccacctatgtgatcccttacctatacttggaccccaactttagacct

SEQ ID NO: 289 - DNA, 5906 bp, Mus musculus
gttgagattataatataattacattattttcttcttcccttttctcccttcaagccctctatatgcccctccttgctctctttcaaattcatagcctctttttttaatttagttgttgctacaaatgtaatacatattatatgtaaagttaatataatataatatacacacatgtaatatgtatatataataaatacaacctgctcagtttgtataatgttacttgtatgtacattttcagggctggccagtaagtatgggataaccagctgaggtgctcttccctggataggactatttctcccactctcagcattccttagttccttgtgtagggctgaggcctcatagtcttttcccaatctgctttggtgtatctattgctgttatccttgttcagttcatgtttagacagtcacattgatttcaaaaatatatagccagacttttggctactttgtgggttcttctttctcccactcttcttcacccttttctttgattctttcaatcttttaacatcatataagaaagaattgagggggaaaggataaagttatcattagactacttcctgctgattagggcatcgagttccttgaggcaagtttgatcttagacagcaggatatctaatttcttcttgtttcttctttgcccgtgactatgtaacaaaccacaaacagcagcaaccagccaacaactaacaatatgcacataacaacccacttattagggctctatcatctatataacctctgaaaagttcccagaaaacaccacatagttgcaaaagctatctgcatctggcaaaatcacgcctttgctagagcaccaggcaaatcacagtcagttgctgtgaacaatctgaaggagcctcatattccacacctgggattaaaatgaaagcattcttacaagatttctgtgtttttaaagaaaccaaaattctcactacaaaaatgagtgaaactgaggcaaagaacactgacatacattctttattccataagtgtttggaagctagtgaaaagtttccaggaagggaaatatacattcagattcatatttaagattgactgcaaaactgaagctttcactctcctgactttcaaattttctgctagccattatcctaaatgtttcattttttttctttgtatctcaagatcttcagaatcttactcttctctcccaaagaccttccttcccacttttgcagtctaagttttcttacatttgaatggtaatttaagtacactctctctcaaaaatgctctcctacttgccattaagttgtcaacctcctttaggttgccctgcccacagctcttccatagggctcatttcactaccctgtgcctgttagataccacattaggaaagtggcaatgtttatttgcttgtacttagcaacagtttcattcacagcacataacaagtacttagcagagctttagagtgattaaatgaatcaaggctgagtgagttaacgagagatggctggattcctttgaatcagaggaaagttttatgggcagaagcagagaggtgaggagtcttatgcatgttttcttttgtcgagaaagttccaagagtacagcatgtctcctgcaaagggagataataaatgtatagggaatgcaagaacattaactcatcaaagcctctccaaaactaactatggaaatagataaagtttaataaatttttagcaatattttcattataatctaagatagttaagaatttttaaattgtgatatatcattttaaaaatcatcacttgtttttattttatgtgttctattttgatttatgaatattttgcctacaggagaactgtgtgactgcctggcaccacagaggccagaagatggcctgatcccctgggtctggacttaaggagcatcataagccactatgttggtcctgagaattaaagctgagtgctttagctagagcaatatgttctcctaaccactgaaccatctctccagctcttaaaatgttatttggatcatcatctaaaagtaatttattctaaattgtataaataattttacgaccaaataccacacacaatgtcattgtctatgttttcatgtgtatttctgtttgcttgtgtttgtttttgttttttagaccatcttactatgtagccttgcctggcctggaatttgctatatagaccagcctggccctgaaattacagagatctgcctggctctgctctccaaatacttgggattatagtcattggccactactcatggctcatttgtgctaatcacagtgttgttgccaagagaaactattttcattactgaggcaatattaaactggcaatcatgatcattagaggtctgcatcaatcaaaagttttggttctttttgaggacttgaccttatcaaagcacaagaattcttaaccgtgttgtctccattttatgttggaacttaagcttgtgagggagagagctaggaagaagagtgaagaaaactaggaataagcaggaacctctatgcacaagctggtacctacaaaggctgggatgagccttgtgtcagctcttattggcctccatcctttgtgatgtggctgtcctggagaagtcagggtgcttcactatggagccaaacaaaaacatgtgtccctggaaacaggaaagctgtaagaggatccaggtgaaaggttgggaggattataagcccagccattgcctcacataaattgcaagccagcatatacgtgatgatgtgtgtgaactacagagtagtagctgtatcatctctactctccaactatcacagaaaacatggctggtacaactcactcctgccagaaacacacaggaaaagcaatcctggatctgtatttaacccagtgaacacactgggaaacaagcagtcacacttctttgaaaattgggttcaggaattccctcatatactaaaatccatggatgcttctgtactttttagaaggtagtatagtatttttttttagggtattttcttcattgacatttcaaatgctatcccaaaagtcccccaggacctcccccctccctccacaaccctacccaccaactcccacttcttggccctagcgttcccctgtagtgagacataaaaagtttgcaagaccaagaggcctctcttcccaatgatggctgactaggccatcttctgatacatatgcagttagagacacaagctccaggggtactggttagttcatattgttgttccacctatagggttgcagacccctttagctccttgggtactttctctagctcctccattgggggccctgtgatccatccaatagctgactgtgagcatccacttctgtgtttgctaggacccggcatagtctcacaagagacagctatatcagggtcctttcagcaaaatcttgctggtgtatacaatggtgtcagtgtttggagggtgattatgggatggattcccaggtatggcagtctctagatggtccatcctttcgtctcagctccaaactttgtctctgtaactccttccatggatattttgttcccaattctaagaaggggcaaagtgtccacactttggtcttcattcttcttgaatttcatgtgttttgcaaattgtatcttgcatcttgggtattctaagtttctgggctaatatccacttatcagtgagtacatatcatgtgagttcttttgtgattgtgttacctcactcaggatgatgccctccaggtccatccatttgcctaggaatttcataaattcattctttttaatagctgagtagtactccattgtctaaatgtaccacattttctgtatccacttccctgttgaggaacaactgggttctttccagcttctgcctattataaataaggctgctatgaacatagtggagcatgtgtccttcttaccggttggaacatcttctggatatatgcccaggagaggtattgtgggatactccggtagtactatgtccagttttctgaggaactgcttcactgatttccagagtggttgtacaagcttgcaatcccactaacaatggaggagtgttcctctttctccatatccttgccagcatctgctgtcagaatatagtatagtgtatttttgtaactcatacatatcttcacctcaactttgctatctctggattacagagtgggtacatcatattgttcacgtaaatatgatggggtaaaagatctgtacacaatcagcacacactattttgtaaacactttcatgtacagttgattgaatctgaggattcagtaatggaggataaggcaggaattgtgtagaaataatacagtgtgaattaggttgtatttattcttttctgtacattatattccacagacatgggctcactgagttatcacagtgccaattactgtttacatttcctttttcttttctttgtatttttccttttggaattattttgttttggagacagggtttctctgtatagccctggttatcctggaactcactccatagataaggctggtcttgaactcagaaatccatccacctctgcctccctagtgctaagactccagccatgcaccaccaaccaccctctggcgactgtttacattttctaaacattagatagcaccacaattcacctaccttcatataacctgtaagtagcagcagaggtggtactcaaaggatgcagacctgccaggctgccttctccctctgggacaccaggaaaaaaaagctgcaaaagcaagctgcagcttagctgtgaagtgcagaagagcctgcaccacagccctcaatactgattctgctgccagcaatgcattgctcacctgaattaacgttgcttaaatttacttttatggatttaaataaaaataatgcttataaaagctatgagggccaggtcgtgatgacatataccttaattctagcacttggtaagcaaaggtaggtgaatccctttgaattccaagctatacataagtgagagaccctgttttgctttcttctgcctccccccccccaacttatcaggcacttaggatatgtccagtatgcacaaatgcctagatttaagcccaagttccccataaaaactcagctatggtggtgtctgataatcctagctctggaaatgaatatgaggaaaaatcagaattccaaggctatccttgactacattacatatagagttcaaggccagtcagggacacagaaaaccatgttttagaaaaacaaacaaacaaacaaaatggtttagacaggcctaatctccaaactctgaaggctaagacaagaggacattcatgagttccaggttaacttatatataatgaattcccaggtagcctgggctatagagtaaagccctgtctcaaaacagaaaaaaaaaaaattatcaatcaataaataaaatgtataaactaaaaagaaataaagaactgttggtaatgggttcatcatttatattgagaatacagttttataacaaaaataattacaaacccacattgctctaaacagtgtaaagctttattcactctggggcaagctaaactgtttctaacagaaagagtggtggagctagtgtctcttagtcataacatattaattcttaattacaacaggaacaaatccattaccaataaatccagggactatcaattaagcccatgaggaaatggtttgtaaaagacttcccaccctcctaaataagatacatctgacagataataatactcactctaatgtgcgtgcagcttttcacatcaactcattaaaagccggctttttcacaacgccaagcttcctttttgtctctgggcatggtttctcagaatgtcccgcgcatgatcttggaggcaaacgcagagggaat

SEQ ID NO: 290 - DNA, 9411 bp, Mus musculus
acctgtctctgtggtctgtatagagcaccgctcagcagcaattgctctgcaaagccgaatactaacctagcccgcctcgggcagtgctgaaggcgacagcccccggagagcttgtgcaaatatatactttgaagtctggcgggtaccccccaacttccggttacaggatcgccctttctggaggtgacacttcttcatgcgtgctctctctatgcgcaggagctgagagccactgaccccagcactcctgaaccctctctcatggcctcagacatctggtaagtggggggtttgcgactgctagggtcagcattgagtccatttagctttttaaaaagtgcgctcggggacagagatttttgtcccatgcccttttctggtccttgaaaagatctcggaagaagccttagtccttagttcccttagtcctctgcctcccgaaccgaccgacctcttttagacctcagcttcagagcttcggggcccaatgttatggtggacattggctccacctagtggtaagaaattaaatttcagcagatcgtggtaaggtgaatgaggcaggtaatggctacctggatacttagaagacaggagtctttttttttttttttttttttcctgactcagtccttgctacaggcatggctgaaggttgactcagctccattcttccatctgtatcttaagagtagctggctgcttgcctctgtgtccagtatctgcctttcaaagcccccttcagagcgctgtccttaaaccactcagaagcctctcccgtcagctcacaccaatgccacccacttggaaagtagaacctgaagtcccagaaaaggtgccagcaacttccccctgttcaccatggaaaccaggacatgtggctctctcctatccactcttctcaggaggatagaaatggccttgccagtcctgagagtcacttctttttggttctgtgcccttggtagattaagtcactggttgcagtaaagagggaccctgtcaggggagggagagatggcctattagtgaagagtgcttgttggtcttccaggggacgagtgttgactccagcacccacatgggtgactcacagttgtttgtaattaagtttaaggggatccaatggcctcttctggtgtccttggccaccccttcatttatggcaagcacacacacaacacattttttaaaaagtattactctgtcataggaagtgacatgatattgcttctgggtctctgttttgacttgccaaatcctctgccaccacagttctaggtgtgtgtgtgtgtgtgtgtgtgtgtgtgtaggggtgtggtgtgtgtggggggcactcacagggctctgagtctgctcactgtggagctcactactgggcattctcagtgagcatgatagttgggggaaaatgtttggacctaaaatgagaaccctgccctgtgaaaagcaataaattcttcataaaacatcaaatggtaacattttattaacctcgttactttctaagtttagtatccataaaagcttcattgcatttggaagaatgtgtgggctgggtttctctctctttgagaagtctcaattacaaaactgctccttctagctgtgtggtttcaaaagaaaaaatatagctattctttaaaaaacaacaacaaccaactgtggagcaaattttcgtcttttatctcacaccttgatggggagggaagtggtctagagccccagtgcccaggcttacaggggtgctgggcaccagtgtctggggtggaaaggggagggagagctgttgtgagggacacagggtggtgctggcagggacccagaggtacaggcagagtgtcctctctgcaccctggcggcagtgggctgtgatggctattcacctcttcagctggagagcaaagaggtgctgtacagggcaggtgaatggagaccagggcttaggctgtaggtcaatccttggaaaattcaggtggggaagttctcataggctgcagtgggtgaggccctactagggttggtcttcagaaaggccgctttcagggttcctagctaggaatgtgctccggtgtgtgctttgggtgaatatcaggaataaagaactcagctggtgttgggcggcagtgaggaccatcccgctactgtcacaggcagattgtgtgtgtggaggggcagggagggagggagggagggagggacagagagagagagagagagagagagagagagagagagagagagagagagagagagagactggtcaacctttgcctgcagctgtcttggggacttggtacatgtcaaaggattgttaccccttactctgtggactttttcaccatgtgccttcatcccatcctttagctttagcttccacagtgcctctgtcacacacttgttctcaactccaacagaagttgcgtccctcaaagagtctcattgttactgtgtaatgaattgccatctcctgacttccttggatcagtgattcagaaatttgagtctgtgcttcccaaactgccattcctgagacctcaagtaaactcctttgactttcacggtctcagtcatctctcctccatcaacccccaaagcctcacctatccaaaagtttctgacaactgtattcggttccctttcatttcagtttttctggacagagtagatcaaaatccatcaaaaaaaatgtccaaaggctggagaaatagctcagtgtagagaactttcttagcatgagcagggtcccaggtttggtccctaccagagcaaaaaaagagagggaaaggcttacggtactcatgggagccccaggtacttacgggactaaggcaggattgcacgagctaggagtttgagcccatccttggtgatctgcaccccatgtcagaagacagagaagaagcagaaacaagcagaaaaaatggagaagcagaagagtgaggctcctggcttttcttttaggacagggaccagtcagttgtcacaagcccctgcctgggcaggaaggcagtgcttcattcctttctcaggaaatgctctctaccctccaggggccacaggacagtctgtcttagtttgcttcctactgacgtgatgaacaccatgaccaaaagcaacttggggaagaacgcatttattatactgttttagttaaggtttctattcctgcaccaacatcatgaccaagaagcaagttggggaggaaagggtttattcagcttacactttccacattgctgttcatcaccaaaggaagtcaagactggaacttaagaaggtcaggaagcaggagctgatgcagggccatggaaggatgttccttactggcttgcttcccctggcttgcttagcttgctttcttatggaacccaagactaccagcccggagatggcaccaacccacaatgggccctccccccttgatcactaattgagaaaataccccacagctggatctcatgaaggcatttcccaactgaagctcctttctctgtgataacttcagcctgtgtcaagttgacacacaaaaccaaccagtacatatacttacaggttagagtccgtcatggagtgaagtcagggatggagctcaaggcaagaacctggaggcaggacctgaggaggccttggaggaaggctgtttatgggcttgctccccaagactggctcatcgtgctttttattcaaattagaaccacctgcccaggggtggcactgcccatggtggactgggtcctcctttagcaatcattaatcaagaaaatgtcaccatagacatatccgcaagtcaacgtgatggaggaaattccttaattgaccttccctattcccaagtgactcagtgtgtgccaaactggcaggagctaataggcacaccttcccaaggtgaagcaaaaggaagagaacaagcagaggagagagacggaagtagctagatagagagattggatatagatagacagacagggaagcaaaagggactgagtgtgaccggctggggagatggctcatcgggtaagcaagcatagggacccgagttcaaatccccagcacctacgtaaaaaggaacaaggcaggcatggtggtatacatctataacccaagtgtggaggggtgaaaacctgcagcggcttggtggccaatccaaaacagccagttgcaggttcattgagagagcctgcctcaaaacaaacaaaccaaactggagatgcatttgaagaatacatctggatgttagcctctgctctccacatgtgcctgcataggtagacatacctgcatacacgtgtatataaacatactacacacacacacacacacacacacacagagagagagagagagagagagagagagagagagagagagagagagagagactgagtggtaataatgatataaagggttaagtagtcacaccctgattagtaaagccatgcatctccaaggctggtttcttgtcaaacatctatggggggtgttgcagggtggggtggggaggggagctgatgtgtgacttagtgaaaaaaaatgcctggagctggacccatgaaagcaaacacatttgccccctaagatttattttatctttaattatgtgtgttgtatgagtgggttgtgtccgtgagtgcaggtgctcaggaaggccagaagaaggcactggatcccctggagctggagttgtgagctgctgggcatgggtgctgggcacagaactctggctctctgtaagagcaggctgcactcttaaccactgaggcccctttccagtcctgggacacacagctttcaccgtggtgtccaaacattaaccccaaaccacagtggacagcctttagctcagtgaggttacttgtgcgatgttgagaatttgaggccttcccaaacactctattgtcctggtaagtgttcgtcacaaccttgacaggcaggttgtgattatttccattttttggagatgaaagccttcattctcacttggctccaagtgagttccccaagtccacacaattactcagtggtcgaactaagacttgaacccaagtccatctggtcccaatgccccctatgtgattatgtctgcagtctgctcggcacttttatacattggaaggacacccttttcttttccttatagtgttcccaaggctccatcagccacagggttctgtctggccctgactgcagggtctgtgcttgcctgcaatagtcaggtgccagaatcctgtccactgtgattggacaaaaactggccaatcagttcttcagggagatcatggacaagagagagggtggcccttctctgtctttgctgcaggagtttccaggaccttggggtcaggtaaatccctggccttcttcctggctgtgcacagttgactgcaggagacagcagccaacacaaaagaaagaatgggaggtggggggccagcgacttcctctggcatgctagctcctgaccttgaacttttcaaattcattttatgtatatggtatttttgttttaaccagtttcagctggatttctgccaagtgccccacaaagaattctgacacaaatctatgatttaaaagagttataaaacaggagctccaccccggcagaaaggggaaggcaggcactgggagtagtgaaaggagcctaggtagagttgagccaggggtgcagctaggtctctgcgagccacgggataagaatgagagtcctgatagtgacaaatggggctccatatagattcccccaccccccaccccgcgcttctatctctggcttcattttctccatcagcttcctacccaagagcaagagcttaagaaatttctgaaaggggtgccagcgatggagctcagttgggagagtgcttgcctagcatgcatacagccctgagttccatccccagcgctgaataaaccagtcagtcctgaccctcgggtggtagcagagaggatcaggagttgaaggtcatccttgggtgcacaagttcaaaactagtctgggatggaggccctgccacaaaaccaaagccaacgttctggaaggacccatgactgacccagccatgccttttcacatgcaattacagtagtcccctcttgggaggagagtaacgtgggcctcacttttgtgatattggagtctctctatagaagtggcgcctcacaagagagaaggaccaacagaatgtctaccacagaaatgaaaaggttacctactcagccgctgggatacttgctggggacccctggcttccagataggtttctgtccccatatgttctggagtgctagaatggtagcccaaacgctggactgtccgatcatcagcttaattctggtgaatcggcatgaggtcaagcacgtgctctttgcttccagcctttcctaacttactgaagcccagcagtctacctggcgcaccagcaccaggtagactcttagagtcaccactctttcttggctctgcgtagctaggtggtgtcacgtggttaagttgtggccaatgagatgcctgatcttgtgtgagggcttcagaacaggtagctagaggtgtgggaagggtcccttttgccttcttcatcttccttccctcccccctctcccccagtcccctctcctatcctcccttccccctccctcttttccttcctccccccccccccccgccccaaccccactcttctcattttgtagtagcccaggctgaccctttttatagctttctcttctttctggtcaatagcatagagatggatcaggaagcattgtggattgtgggatggccttggagatgcagacagtgttgcaagccggatgatggcggctgggctttggggactcaccaccagctctgggttgccttgggacttcttttatgcaagaggcagtatacttcaatcttctgtaagcttgggacttggattttctctttatctattcaaatcttatcccaaccaataaaactactttcttaatagtcccgtcggtgtgtgtgtgtgtgtgtgtgtgtgtgtgtgtcaatttttccataaatagagaaggaaacatttgccgaagactccacagctggcagctgatggatcagttagactcatgaatgttttgccctttcttactgaggtgtctcactgaggtggtcttcaataggttgaagacccgcagggtgaaggacccatcgaggcttggtctcagcctaaaaatggttcctctgagggagtaactggctttgatctcaaaaacctggtgttttgagttttctgtctgggaacatgccacatatgtagctgtctgcaagtttcttattactggaatgtcctcatcaggtggaagccactcagggctggttctcatatagatgagagcttgctgcgccctgccctcccccgccccccccccccccgtgcccactgatggcagtgtcctgggtgcccccccacccccacccctgcccccagaggagggatgactcttgtaaatatcatgggtgattgatgtatgactgtcacattcattcccaccaggctcagcatgggactcaaacaacagaaattaagcatactgaaaccctaaggaggatgtgtcatactacactctacacaactacaaagtgtcaaggaaagccgggcctctggggctggcatctgtacacctttctacaaaccgattctttgtggctgcagaatggctattacctttctggggctagtgctcaggttacaagcttctgtgaaggatatcttcaaactccttgagactgcacctgggtgccgtggataacagcagcaggaacctgatggctacaggtctggaagagcagctgtcaggatcgggagaagggatgctggtggccaacacagtcctgcgttggaaagagcctagttttctcggctttgtggggtgtggtccatgctgttcctctttagtatctgcgaccatctgtgctggcaggtgcttcctgctttgttatgcttttgtgtctggctgactaccttgtttccatcctggcacctaaaatttttaactccagtaaatgaaccactttaaagaacagcaaccatttcaagacatgggcatcaacctattaaaaactcagcacggttttggaagggctttggacgggtggaaacacatctttctgctaaaggaagaagagccgaaaatgtacttgaccttgatcaccatagtcctttccttcgtgcagttgattgggtgggacggcgagttcacaggctgcatacctgatggtgacatctgtgctgttgctttgtgaactaagacatcgtgagctggtttgaaagtatattgggctgggcaagtgttagatgaacaagcctcgaaagcaaaaagcaaaggagagtgaacggtgcatcggcttccttctgtgtggttagcggagtggagctgtctcactcctcttctggacaccaccacttcacagaagtggtttttttgctgcatccactttgctggtgatggcagacattggcgtgtagtgtcttagtgtcgtccagtataggtgggtacatgctcagctgcagcccttaagtggaccactccttggtgattatgaataacttcgatccccccttcaaggctgatgcatttttacttttgatgaccccctttacaacactaaaccgatgaactttagtagagtgggtgggtggagggtctggacagttgttggagcttgctttagctagaatggtctgtagctactgggaaatgtttctagtttctgcttcggggtctgcttgaaagtctggtttcacaaatacagagatcaaattcaccacttaatttttttattatttatttatttactcatttatttattttgagacagggtctcatcacatagccctggctggcctcaaactcatggagctttgaaatacaatctcgaatacagacttttggaagttcgcctttcaaaagtcctgaaggacttgctaccttgaagtggtacacagggaaatggagcttgatgccaagcagtcagattcaccagtgggacaaggggtggtgcttcataaagattgctccctgcctacgtcataggcattctgctcctgagaggaatgcatcttcagtggctctctcatcacatggtaaacctaccttcctgacagggtggctccctgtgagttcaaggccagcctggtttacgtaggaggttgtaggccagcatgggctactgcggtgagaccttgtctcaaaacaaagcaaaaaccaatcaaagtatgcaaaacagaacaacctaaggcctaacagcagcaaaagtgagctgcaaaattctcatttcgccagtgatactagccgtatttcagtcactacaggtacccaaagcccagccccacctgacccccaagagacagtaatagcagtgtctaagtttcttgttatttctcc

SEQ ID NO: 291 - DNA, 2161 bp, Mus musculus
actgagagagcctctccagggagccgggcacgcagtccagaaggctgcagtatttcctccaaggggggaaaaagaagatgaaaaagaagaagaaaaagaaagaaagaggctgctgccacccctctgctagctatctggaatagcacagtgagcagcgtctgcagccgagccgcgggtggaaccgaaccccagcttctctgtgaagtgcctgggtggggcatggcccagcctccctgccctgctccgaccagggctcccaagctcccaagctgcttctcctcttcaatcgccaagttcccagaggtgaggcatggcattgatgaacaaaacagaccctgccctgcgaggggagcatgagggaaggagaagtgtgtgtgtgtgtgtgtgtgtgtgtgtgtgtgtgtatttacacacacatgccaacctttctagttaagtagggagaaaagtgtattcaaggctttttcaaaatctgttaacacattaaaagccagatgaaccgaggacctgaagatgaaaccaatgttttgggggatgctcaagagaggagaaaaagtggggattctcagctgggtacctctgtggggaagccaagccccatctcaacaagggggttgccttaactatcacaaataattgtgttgtggctttatccatctcttaaaaacgaaatcaaagtgatctttacatttattcgcttattggagaataaaataacctctctctctctctctctctctctctctctctctctctctctctctccttctcttacttgctctttcttaatgctttcgtggctctgtaagtattgcacacaaaaaaattgaacaaaaactcataattacttgtcagagtttttccccccaccagtaataatattccgacacgtcgatcagctgctacattataatacagattgtttcagagaagatagatctccttaaagggtttctctgcaaggcggcggtgaggctaaaattagctgtgccagctgtgttttgctgggagtgctcacgcatgcccggagcgtgggcagccagcctctgtgcctctccactcccccaagtctgccgaacactccagccgtcctttcagataaaagactccaggtacaaaggcagtttcctcacatggagggagaattgaaactgcaatacacaggatgccacctctgctttaagtcccgcctgccactcatggggtaacaacctaggctcctgtgctccttagctccaggaagctcagttctgaagtctgggtaccagcagaaagacaaggacacggagacatcacattgggttttatgtcgattctctctctctctctctctctctctctctctctctctctctctctgtgtgtgtgtgtgtgtgtgtgtgtgtgtgtgtttctcttttttaaaagacagggtctcagataccccaagctgctcttaaaacttgctgtgaaacggaatgattttggcttctgattctcctgccttccatcgcccagcactggtattgaaggcataaattaatgaatgaaccaggttcctgtgggcactggctgtggaacctaggaccctgcccacaatgggcaagcactctaccaacacagctatctcttgatgacaaaaatcagaacttgggttggaaagtgggtatgggacacctgtgatggaaacatatcaagacagcttcactcatggacctcaattattccatccataaaatggagaaggacagcaactgaaatcaggcaccaatctcaaagtcttctggccacatctccctctctagagaacttgtcaagcatctgggaatctcgttgttccttcctttctgcttggtatcagactgtaaattctactcttcacacttcatggtccagctctgagtgccactgagcagaggtcatgttggtgatcgccaagctcacaccaggcatcctctgccagcatgaacatgcccccctgaagcagtcttcctgaaaccctcacttcccaaggtatagttggttttccccaagttggtttctcccacgaccttctaaactcagaacagcaggccatagcctcctctgtagccttaagaactagcaaggccagacacaaagcatgtgttctgacatgcttggagaacaaaatatcctggacataataaacaatttgtccctc

SEQ ID NO: 292 - DNA, 2107 bp, Mus musculus
ggtgccaatttaaatagttttattattccatgttacttgttttgggtccctgtggaacaaagctacaccttcttcttggactgacttaatccacctcttcaatggtggggcctgaagaagcaccaccagatgggggagctcctccacctgggaagccaccaggcattcccccaggcatgccacctgcactctggtacagcttggtaatgatagggttgcagactttctccagttctttctgctgatgctcaaattcttccttctctgcagtctggttcttatccagccagctgatgatttcattgcacttgtcaagaatcttctgtttgtcctcatcattgatcttgccttgaagtttctcatcttccacagttgctttcatgttgaaggcataggactccagtgagttcttggaggaaaccttatctctctgcttctcatcctcagccttgtacttctcagcttcttggaccatgcgctcaatatcttccttactcaagcggcccttgtcattggtgatggtgatcttgttctcctttcctgtgctcttatctacagcagaaacattgaggatgccattggcatcaatgtcaaaagtaacctcaatctgagggaccccacggggtgctggagggatgcctgtgagctcgaactttccaagcaggttgttgtccttggtcatggccctttcaccttcatacacctgaatgagtacaccaggctggttgtcagagtaggtggtgaaagtctgtgtctgcttggtggggatggtggtattgcgcttgatgaggacagtcatgactctgccagcagtttcaataccaagggaaagaggagtgacatccaagagcagcaaatcctgaacgttctcagacttgtctccagatagaatggctgcctggacagctgcaccataggcaacagcttcatcggggttaatgctcttgttcagctcttttccattgaagaagtcttgcagaagtttctgaatcttggggattctggtagaaccacccaccaagacaatatcatggatctgtgacttgtccagcttggcatctcgaagggccttctctacagggtccagtgtgccacggaacaggtcagcattcaactcctcaaatcgagcccgggtaatggaggtatagaagtcaattccctcatagagagaatcaatctcaatactggcctgggtgctggaggagagggtgcgcttggcccgctcgcaggccgtgcggagacggcggacagctctcttgttctcactgatgtctttcttgtgctttcgcttgaactcagcaatgaaatgattgaccattcggttgtcaaaatcttctccacctaagtgggtgtctccagctgttgatttgacctcaaaaattccatcctcaatagtgaggattgacacatcaaaagtgccacctcccaagtcaaaaatgagcacattcctttcagctccgaccttcttatctaagccataagcaatagcagcagcagttggttcattgatgattcgaagtacattgaggccagcaatagttccagcatcttttgttgcctgtcgctgagagtcattgaagtaagcgggcactgtgaccacagcgttggtaacagtctttccgaggtacgcttctgcaatttccttcatctttgtcagaaccatggaggacacttcctctgggtagaaactttttgtctcccctttgtattccacttggaccttgggcctgcctgcatcattcaccaccatgaagggccagtgcttcatatcagactgaacaacagcatcatcaaacctacgcccgatcagacgtttggcatcaaaaactgtgttggtggggttcattgcaacctgattcttggccgcatccccaattaatctctctgtgtccgtgaaagcaacatagcttggtgtggtgcggttaccctggtcattggcaataatttccacctttccatgctggaagacacccacacaggagtaggtggtgccgagatcaatgccaactgcaggtcccttagacatggttgcttgcgtgtaggcccagctgcgctgacgacgagaccacacgaatgcccggcagctgcctctgcgttcaatgagacc

SEQ ID NO: 293 - DNA, 7256 bp, Mus musculus
gcactcaatcagggcgatcctaggctcgcacggcggctgtccaccgtttccctccgcccaccgcgccgacgcccgggcgcccacgccaccctttccccgaccaccctctgcgcagcccgggcccaagcggcgggacgcaggctctcggacccggagccggttcccgcttctctcgctagagggcagacggggcccgctcaaagccctcagaccgaagggcacgcgcagccggtagagatcccgcaatcggagccgcactccggggctgggctccgcgaccaacgtggggtccgagatcagagcccgggagcgcgacgcacggcagacccagaggacccgggaggaacggccagcaatctcggggtgcgcacagcgcacgggcaccaggtggaggcggcgccggcacggcagttcggggacccggttgggcgccaagagagctgcgcgaggacacacgggacgcggctaggtgcccgcctgggagcagcggagcggctggcactcacctgggctcgggtcgccttcggcgggcgcgggcttcccgcgggatccccggtccttcttcttgcccttccccttgcctctgccttctttgcgctcagacatctcgctaaagatgagcgctctacgcggacccggctgggcgacggtgacgcgcgacaagtttggtccaagggcttgcagaaaagtttgtcccgggagggaagagccagtggccgggctgcgcgggggcgtcgcctgtcgcctgcagggagcggcgtggactcgatcacctggagcgcccgctacgtctgggggtgtctcggggctactcttgtgtcccgggtcctgccgctgccggctctggagtggcctcgctccggtggctgtctcgctcccttacagcccgaagagggaaaggtgctcacagtccggtctatgctcgcatctcccggcagctgccgccgctgcgctgcgttccgctcctgctgccggcgcggcccggagttcccacaagttttggggaagtcctagccggctctttttcaattgcccgcaagttggacgcaggcgcctccttcgcaccctccccctcgcctcgccccctccctctttccccaccacacccccaccccgaggcgcagacacgccaccgggaggagcctgagctgggcgatcacggctcagcccctttcttctggcagctgggccagcctaggggcggcggagcccagcggctgccgggaactcccgacaggggtcgctggaagcttcgctgacaaagtcgcagccgccgcgggacagaacagagcagtctggagaggccaggaaggcaggaaggcgaccctggtgctcgcagtccctggcaggctgcggggctgatccaagccttgaaaagggggggggggcggtaggggggctgctcgcgcgcgcgcgcgcgcgcgtgtgtgtgtgtgtgtgtgtgtgtgtgtgttggggcggggggagggatggagaaaactttgcaaccgtagcacctgccccataatgaaagctctggagacctggagccccggtgagggggaaggaacagttgctatttcccagaagggttcagagttcatttctctcttgctttagggaagtttccctctggcactaagagcgaaggtgcagcctggagtggaagggaatttgaggtacccaggaagggttctgtgaacttcaagcatggacagcttgcacttcgtacatctgccacttgagcatgtgtctgccttcccgtgctaaatagcatgactgttggatttcccatctccattaaaaaaaatactctagcttcttcccaagcacacgtatctcttactacagcttaagttttaaaagaactgaggagccatagttcaccatagagagtaacatgtctacggtgtggatgggtacaagtcagatgcgcgggggggggggggggttggggccgtagaactgtagtgcagacccttagttcagtaataccagccccctcccacacccattagactttctgagaattgctagtgaatcctagcgttcctggatccaggtggagaactctaaggaatagtcagagaccagagtgatctgcaccaaggagtgattcacaatggtctccacatagagacagatgctgtcatcaacacacacacagttgtggccaacttagcctgctcttttactgatggtatagagttgtggtcgagaaacagctcgcaccaacgatcaatattctacagctatcccactttcagagtgatttggctccttccttttcgcttcctggagttaatactaacagacccgtggctgtccacagctttccctgtgttctctggctgccacgatttaaacaaaggtgaaatccagagtacacctgtcacacatgggtgggaagggaaaacggggcaaagatgttcattttaaatcgtcttaagaatcgcttccatcctactttaattttcgttggattaagaatcaaactctgtaagataggtgcaattgttaagatagctcaacagtactagcatcattctttactcttaaacctttagtgtccagacacctttgatagctttccagcaaataccacatagtgtggtatttgtgccaaacagcagaaccccaggaaagattatgactctgtgaaaagcactgcagccggcctgggccattcagagtgaagggaaagtggccccagagccggctggaataactccactttcccaggaggggccactgctcagccagctaggagtgagcggcagcaagccgctgaaagcagaaacctttcatttcagagtgtatttatctggaggatgtgaggcagttagagagctcacgattactaaccacatgttgtcaaacaccagcattttagaatcaaagggctgaaaacaagcttgcatcttggaacttaaaaaaaataagtgtaagatcttcccaaatacttgggtaatcaaaacccaaggctacaggaacaccatcttctaccttttgttcccgagtctagatacgttacttcccagaacaccttcatggtgggagtatctccaggaggataaaaggagtctacacttcctgaaattttctacttgaataaaaccactgtgataggtgacaaacctccgaactattttaccaagaaaaatgactgatgctccagtaacttcagaataaagcaccaacagtgttcccatggaaactgtgggggtggggaatggatggatatgatttggatgtaagcagtaactagcagtacatgattttttaaacttggttagatgacgatggaagaggagaagtggggagatgagttgtggtagtaggtgctgatggaaatttcaagacacatgacagagtgtcatttaatggcaaggctgcttcctagaactttgccctgattctggaatcctattttattgccagttaaagctgaattagcaggaacttctccacaaagccatttattttttatgttattttgagttgatttcttgagtatattttactacatgatttacaaccaactgaaagattaaccaaaaagtcaatttcttcgatagttaaaatatttatgagattggtcaaaacttcaaaattgtgcttaaattattcatttctgtggtcagtaagtggcaaatgtaatggttttgtgttttaaaaaatactttggaactgacttaaggactaaaaaaaaaaagtattctttttaaaaactatttaagcaggtgtggagatgattcatcttgtaatctccgaacttcagcagatgaggcaaaagtaccaccaggggccttaaggccagcctgagctgcagaaggagaccacaagtaacacagacccaaaatgttacaaatataactagttaaatagaaaaatattaaatgttagccttagtcaaaacatttcaaagtgaaataacttagtgaatttaacaaacttgttatgttttgttcagctccttgaacaggtatcatgtatggctggccagctatcaacttacaccaaagtgtcaacatacatcaaccggcagaagaagaggacattatgaagtcaccctgagaaatgaaggtgaggtgtaggggtcctctataaaagctttaagaagtgccaaagctgaccactgcagttacttcaagattcattagcctttggggactcatagaatctacaaagcttgttgaatgtgttcttttaataacccttttccattctaatccaagaaaaaaaaataaaggaaaaaacaaaatataaaagaactgatgtgatttttttttttttttgcaaaacgtacattctttgacaggaatgagagctaaacttgaaactctgctgatagatactttttgctttttaaaataaaataacaaagatttacttttgaataaataaaataaaataacaaagatttttttttaaattcttttgcaacaaagttgctgttgatagcacatgagttaatgaaaggaaacactcccagactcaaatccaaatctgtgtgattcatccatttaccaagcatttcctgaagaaatgctggacaatgaaagaatacaaatactgtctgggttcatgtaaaactaaaatcttgtgagaaatacatacagacaagttaactatccaactcagcaagcacgtacattttctaaagcctgaagctcacaaaatttggggaaacttttggaaggaaaataatgcaatgatgcaaatttagaaatacagatttgcaataggaatggaaatcagagtttcgtatgagaagccctgggctaactccacccatccagaacaaaccactaatgtaggtacaagtacactaaagggggtcatgaccacacacaggccttcaaaagtcattagcttcatgataaagtcacctctatgcacttcaagtatattccgtcatctctactatagttataaaaatggtttaggacaataatatacttagagattagataatactttcactatcaccgtacatactgtccctataaataacacaatcaaaaatgcatgcaaaactgaagggagtaagaaatggtcctggaccggaggcgtatgaggagaaagtctgagtaactcaagttttataaacaaagtacttctgaaaagcctggtgttctagcaaacactgaggggagtccttcattacatttagcaaagaatgaatataattgctaattaatcacattctgtctgcagtgaagcaaattcattgtataccaaaattgtgaatttataatctcaaacattctaaaaaaggatggataggtggctctgcctgtgtgacttgaatggttacgacatgctgaaaatcacctttaattgtcactattattaatgatgattattcgtgagtaataataataataatcccattatcctcaacttaaatagatgacgcggctattatttgtgtttatttactttctaccacaagccctgcttggtttctttcttttgccatctagagaattggacttaggtccttacacattagacaagtgtcatcactgagctaaagtccaaaatgtccttcttttcttttgtaaatttagctggtatcatatctcttcggtgataagacaaatgtgtaagacagtgttttcttttctttcctttcctttcctttcctttcctttcctttcctttcctttcctttcctttcctttcctttcctttcctttcctttcctttcctttcctttcctttcctctcctctcctctcctctcctctcctctcctctcctctcctctcctctcctctcctctcctctcctctcctctcctctcctctcctctcctctcctcttcttttcttttcttttcttttctttcttttttaaaatactttaattcctcttgagaaaagcatgccacctgtctgtgtttgctctctcttgctgtcattaaacactggcaatatccagagggaggaaagagcttacttggctgacacatctcatcacagtctatcacagaggaaagtcatggcaggagcctggagacagggacacattttgcaacccctaaataacaattctccccataattaaaaattgtaattattttttgtgaaatatttaataatctgcttctactaggtatgcatctccccgaggacagtctattttatgttcaatcttgtctaacactgcatggatctaagccagtatttagtttgttaactagtgaacaaattaaaaccaatacaatttctttcccatatcccataagaccttaagacacatttgtgtatgtacttcttggtcttattttaaatggtaattatgtatataattatcaagcatagcattttgtgataacttctgttaaaataatctattagttgatttattttcatttatttcagtgctggggttgtaacccaatatacttgcatacaatagagaagccctccacgtatccaacaaaaaagaagccttttaaaaacaaatcaaaaaataaaactcttggtctgaagagttagctaagaacacttattgcccttgcagaggacgtgatttcaatacccagcacacatggtggctcacaaccacctgtaactcccacgccagagaatctgaactcttctgaactctgtgggcacaaggcatgctcataacccatcaaataacagatcagtataggtagaattcaaaaataaaataaaaagattaaaatcttcacttatctctcccatctctcaacaggtgagaaggcggcttgcacagaatgacagaatgtcaaggtgttttctttaaatcgcctttgtgagtttcacctgtgtgctatgattcctggctctgtccattcccttggtctaaatctacaaacacagcctcgtgagcaggcttaatgacctctccttgctccaagcctgggatgtacagcttctctttccaccagcttacttctcactccacacaacagtggtctgcctccatctaatcactgaatcaagtgactctccctggctgccttggaaacaccttggagttcagctggaagtcctctttacattctgctcttacccactgtccttatgcacacagcagataaaaatgggcttctctgtgcattcttatagctcagactctgtgtgcatttaacaaatatccaagagagaaatcacatggcttgatggcttttaaacatcagcccacaagatcctctccaaggttaacatttctttcctttgaaatacactttcccgtgcctgggaaaagagtcctccctattaaatttataatgatgct

SEQ ID NO: 294 - DNA, 4929 bp, Mus musculus
actgtgtgaatttgattgcagtttggctgcagggcttcccaagtatgaagcagagatggctgcactggacattgcctttataatttaataatgttctttatatgcaaacaaaggctcagtgcctttaaaaaggaaaataagtgctctgggagtctggaatagtctatcgaatttaaatttcccagactagggctctgtctgcaactgtggaggatttgctgagccaggaaagtttcagctgtctgaatcatttgctctgtgatcttacagtggaggagctgctgttgtctgagtcccagctgtgttttcaaggctaatgagggactctgtccatgcctctctatcaggaaccctagtggaaggtagcttgcggctctttatgggagtctcttcagagccatctcttgcaaactgtgaagaaggccaaaagccatgtcatggtgattgtaaagtgtctcctttgccaggccagaaggagcaagtttgcagagctattagagtcagatctgctggtaccaaggaccgtggttcttttggtccatgtggtgatcatagcagaggcccttgtcctttgacccttcctgagtgtggattaatgggggtgtgggaagctcagtagccctagtatcatatgggcctgggtaccaaaggttttccgcggaaatttctggccagccttggtgcgagggttccagcaaatacaaaaaaatgcaggcaaggaggggaagttgcaaacctgcttctgctgtgccagtcaactccacctccctctctgctgtgctatgccataattctgtccctccctgcactgagtagggtcccaaagtccactgggggcttggtcagtaatgtttttcttcagatacttggcagttcccttgtgcagggttgttttattagacttctcctgagtttttcccagtgtatgctagtttctgcagacttcatagaggtctccatttctttccacttatccctgtaagtaggatacaagatgctactcttaaaaagtttacttggcataagacatagcttgggtatgctcttcccactgcagctgttgtaaattctaccttctaattttgctatttttctcatctcctgggaactccaactcagaaacccatcactggaaaatggcttgctatttcagggctctgaggcacttaataaatgattctgcgtatctttgttgtgaaaatctcctagctgtctcaagtaggatttgtaatctctagtccatatttaaattgttcaaaataacctggggactgaacaggaaagaaacttatggatgagagcatgtgtggaatccaaaacctgtttttggctcactggtgtttgagtattagccagagctgaatccattgctgtcattaagaaatttttcccaattaatattttagttgtatatggagcgatttctttctgggatgacatgttaattctgggagagctgtctcgtcttcccctcatagagatgtttctaagacaagctatgttgacttaggtagccttgatcctggtctgctactccccagagcaatgaccttgctttcctcttgatagaaattcctaaattcttgagttaaagaatgtagcaaaatagtgttttataatagctcatttgagtcatataatgaactgttaatttcttctaccttcagtagagaacaggagcaatggtttactgttatctctgtcaggtgaagtagggcaggagatggctagattatagacgaaagcttaagggaatctgctccaggtgtcaccattctagtgaaggatgagagtcaggcaggatgaatacttttgtaatttcactaaatgtattaaataatgcatgtgattaaataaaactagattggtgggtgcttaatttgtgcaggttagcttgagccagtgataatgaatttctcttttaggatctgtactatatagatataatgtatcagaaatgtaaaacacatgctattagctgtagctgtgtgtgtcacattatagatctcagtagttaacaaagcacatggggcaaggtcaaacactatcttattaatatcattccttctactaagaaaggcctgatctttttcatatcagtacagtgatatattttcccaatataggtgtgggtttgttgttattatgtttgttttgacaacccactgaggacaatgtgctgattaagaagagtgctccacagtgtctgacatgtgtcctaattgctctgagccttcgctcatagccattgggtgaaagtacttgcagtttacctggacccagcctgaagccacaacacaaaatcttatgtcctaaaatctctcttcagttactaatattcgggcactgaccacctgtggacagtttggtaactccaatttcagctgattgatggggaatgtaagctatccaccttgattccaggaggaagaaggggaattgcctcctgagcgctggaattggagctcaggcaagctccaaactttcaaagcagtgaacccaggggcactgcccagaaaggggagaggcaggcacttaggcagcaaggatcaggaatcttagcctctcccaagggcttgcaagagaacagactattggaggagacacactggtgctactgaactgcaaatctgcagatctggaaaaggattggcccagactggaaccactcggctgcatctctacagtacactctaaccctaagcctggtgttcacttcactcaagactcaatagcgaattagagcctccacatggagctgccagtcagaagaggaggtgactcttccagttactaagcctgcatgttcctctgtgtaactcagctgatctcagtgtttctgtggaatcggttcttattatttttgctggttgctgtgaggttagctcaggcaaacttagaacttcagacatggtaagtgcaatgtcatctcccacaaagaggaggagcaagcatcttagcaaaggatgcttgtgtaatatctcttcccagaggctggattgtcagcatcagccagacagatggggacatctgtgaggtcctttgtggacctactctctccttttggtcccagctgtggcctctgagtaactttattataagactgcactggacaaaatctttgtggcaggggcttgtgtgtggaaacatacttggcaggatgagaacgagaggaacagcttactgtgtacactgtcaggtaaaagagtgctgacaagagctaggtcacagaccaaaggaaaagggagtgtgctgcaggggtcatggttatggagaaggtcctggttagggcagtgagaatgattttgtaacttcacagactgtatccatgtatggatctaatttagtaaacctagattgaagggtgttttatttaatcaggttagcttgagccagtgggtaatgaattcccattttaggatctgtattatgtagatttgtgtaatccttgttgacatatttaattgagctcagaaatgtaaaacacatgccattctctgtagctgtgtgtgtcagattatagatcttagtagttaacaaagcacttagggacaaggtcaaacactatctcataaatgcctttccttctaccaagataggcctgatctttttcaaatcagtatagtgacatatttttcaattatatttatctttttaaaaagccaatatttgatattattttttaaaattttattttctttatgtataggtgctctgacctcttacttcttcctattctccaatatttcccagaaatcaataatttaattcctatttttaaagagattacatatctttctgtttacagcaacatcggtagctcaggctttccttatgccatgtagttaagccttgctttgagcacctgagcctaaaaccttccttgctctttctgagggtagaagactgatggcttcggtgattaacacctgtagcctaacagcagaggattaagcagtgtggcctttgctctaactcagaaggaattgctggactctaacttttagcctgcaggtcagaagtcacaggaagaaaatgagacactcaaagaagtggttatggagtttttactaagttgtcaaaagttacctatgaatgctatctaagaggaaaagtgaaaagatcctacgtggggaagggcaaaaaaacttctcctttctcttttccatatctccttgtcctctgtacttataaatctttcagaataactgatcacatgttactgagtacactacaagttcacacaaaaaatcaaatcataaattgagagagaagttcacaacagagaatggttattagtaaaactagattggtgggtgtttaatttgggcaggttagcttgagccagtgggtaatgaattcccattttaggatctgtgttatgagatatgtgcaatccttggtgacatatttaagtaatctcagaaatataaactcatgccattagctgtagctgtgtgtgtcacattatagatctcagtagttaacaaagatcataggggcaaggtcaaacactatcttattattgccattccttctaccaggaagggcatgatctttttcaaatcagtacagtaatatattttttcatttatttttttctttttaaaaagttcatttttggtattagattttaaatttcattttcactatccatgggtggtctcttaagtgtttctgttctccaatattgccccaaaattaagaatttcattcctgtttttaaagagatttcatatctgtctgtttagagaaacatctcctgtagctcctactttctttatgccatgtaattaagacttgctttgaactcctaaatccagcctctgctgcccagggcttggaaaacagtcctacaactcctgtcaagctgggttctgactgatcagggagacaaaagacaccagggaatgaatgttgtctaacctc

SEQ ID NO: 295 - DNA, 20558 bp, Mus musculus
gcaatattgcatgatgtttattcaaatagtatcagcatgctgagactgagctcgtaacccacaaggggcagaggagatagacctccagcagttgcagtggaggtttttaaagaatgaaccataaagtgagggaaggacaggataagcatcataaatatggggatggtgaattacagctcatctctccccgaaagtgaggggaaggatggatcacgaagactggggaagttgtgtaaatgttcttggtcccttacacaatgggtcagatgcctaggtgggtcacccatctcacctttcaggctgaaggcaaaagaacaaagaactccatgctgggcttctttcaggctgaaggtgaaagaacaaagaactccatgctgggcttcatttctaggggtctaagaaacacaaagagttggggtcttacagcaacaggcaacattgactgtttctcacccaccaaggatctgagaagcccagtccagcacagctgtctgtgtgaatgacagggcattgcactggaacaggaggaactgagagtcagactccattttttaaaaggcttttaaatctaagccagggcactgtctgatttcaagccctgggtgttctaaactcatgagagaaacacagcatcccatctgtgaaagttctcccaggtcagggctaggcatgaatcacagtgagcatgaagcctgcccatgggaatcaaggctgacattccaaaagacaggacaccaggagtggtatttgtgtgtttaaatctgagaaaggctcctcaggggttgatttccaggctgatctgagggcaggaaggcaggcaaggctttgtcatataaaacgttgctaggttacctgtgtagaaagaggaaggagcttttggtagggaattaaacaaatccttatctctacttctaggtgaaagaaaattaaaattcaagatccatgactcaagaagcttgctagttaggaaggctttttgggcctagagcaaagaacaaaggctgtaaagtcatcccaggaactggctagccacaaagatagagaagatatacaagaatgtggggattggccaggcgcctccctatctcccaccctgtctaccttggttaaaagttaaccagatgttctgctgacttcaataagcacctggccctcagaattcctgactcacggacctgacataatctttttctggtgtgtaatcattctgctggtgtttaaatgaaccaatcgtgtgaaactgtgccaattcctcccccagcgccagacccttttctataaaaccccttagctttcgagccttgtggtcaacaacctctgtctcctgtgtgagatacaggttggcttggagctccgtcattaaactactctgtgtgtttgcatcaagacggtctctcgtgttccttgggtgcactctgattcggaaattaagtggggggtttccccactaggttctttcaatctgacaagaaaaaactaaagaaaaatcctaaacaaatgcttctaatactagtaagtagtacatacataagcctgaaatttcattaaaaaaaagactgcccagatgaatcaactcaatgatacaaaattatcacaacccaaaagttagtatgtttacccacatgaagggaggagaattacttgaacagaagaacagaaagtctgaagacacaggataccagaagtttccccttaacaaacaacaaaaagatatggaaaatattcagaatccctcatctatatgagataacagattactcaatttaagatagtcttccccgtatattgcaacttacaccaaatagcaagtttctaatttcccaacacctgtgataatggactccaggtaatttgaacaaagggatagatttgactgagaaatatcaaaatattttctaaagaatacattgttatcaattcagatacacacacacatttatatgtgtgtcaattttcttaaacaagaatacagacctttgagatctgtcagttcttatacttcctgagacaaagaagcaatcaatatcactatgccttaccgagctatgatgtctggattcactcaatactgacatattgcctaaaaggaaaaaaaaagaatattcaaacccagataaattttctcattaaaaacagatttagttaactttagaaatcacatttaaggagaatggtatcttagcataatatagaatattttatggactgtatgctaccttaatagatgaatttcagtttctttagttatccgatagaattttaaatcacttgaacaataccatggaattatttcctattctaatttctagctgcattcttttaaaactataattttataagataaatctgattttaacaatttcaagatgtatactttcacatacttaggtttgataaactccattctgcacaactctacaaactttataaatgaaataattacaatagctactactacccaatgttcctgataaataataaaacacaaacggtttacaaagggttagattaattctcacggtactgtggggaaaaattactatcagccccaccttttacagattagtaatttaagtcccacagctggtgaatgcccaaattggaatttaactccggtcagtttgatttccaaggtctttttgttttttgtttttgttttgttttgtttttgtttttgttttttgagacagggtttctctgtatagccctggctgtctgggaactcactttgtagaccaggctggcctcgaactcagaaatccacctgactctgcatcctgaatattgggattaaaggtgttcgacaccacgcctggctgatttctaagctcttaaactgtcatactactgtaataattagacatatttcaaaaagtagtccacaaaaaaaccaaaaatctatatacaaagggaatttttctttcacctttagctgttactaacaagttctgtagcatgtttattacatttatggagatgaaaataaatattatttcataaggataattaatgacttagaatatccagagagtgtttataaggattattaggctaatattattttataataatattattactaacactcctcctgatgttccaaaatataaaaatacagatcctaaatctaagaatctaaaatataagaacattttaagcttgtaaaaagttctgatttcagagaatattcttgggtgtaacaaaacaaaaacaaaaaccttactcaggaacaattgagccacttcatgaattaactgtgagacaattgtctagtctcactaggtgcaaggctctgaacctttttctgtgttgtccttaagtagacataagctgaaagtcactgattcttgccattcctcttgcagaaaggaaagaggcaagaacggcgaatgcccatgcatgttcctgttgcagaaagtggcagagcaaggattcagattgaggctgcatgatctagatcaaacccttgccattttctctgacaatttcaataatcacaatctctctttcttttgctgtgcaaggtatcaaactcagggcattgaacatgtaaggcaaacaacaatcacaattctactgttcagagttctatgaaacagaaggcaaacaacttaaaatagtattaaatatttaaggggtactgactgtctaagtaaaatacctaccaaatgctttcttacaacataaaaatttatgaatttattcccattcatgaacctaattcataatagtatttttctttcttaaatttatttttattcttttcatacatggttacttagtgtaaacagccctggctgtcttgaagacactttgtaggcctcaatcctgtaagagcctgcctctgcttttcaaacgctggcatgaactttgtacaccattatgactgaaataaagaaatgaatcaatgactttttagagtttaatgaaaatgggtacacccaaatttatgggacacaataaacgcagtcctaaaaggaaaactcattgctctgagtgcctcgaaaaagaaacgggagagagcatacactagcagcttgacagcacacctgaaagctctagaacaaaaggaagcaaattcactcaaaaagagtagagagcaggaaataatcaaactcagggctgaaatcaatcaagtagaaactaaaagaactgaacaaagaatcaatcaaaccaagagctggttctttgatcttctttacttgtcttatttttctggctagaattttaagtgatattttcaaaagatagatagggatagagtgggaaggttagtcttgttccttatacctaaatggagaggaaatgtttgaaattctccatttagtttgatttttatctattggcttactgtatgttactgtgattatgtttatgtatgtaccctgtatccatgaattctctagtacctttaaaatgaagaggcaatggatttaatcccaggccttttcagcaactaatgagaaaaatcatgtgagttttttctttaagtttgtttatatggtagattacattggtggatttcaatatattaaatttctaagcatctctttgaggaagcctaattgatcttgagcgatgacatctttgatgtgttcctggattcggtttgcaggtgttttattgagtattttgaatcaatgttaataagggaaatcaatctaaagttttctttctgttgagtctttctgtggtttaggtatcagagtggctgtggcctcatagcatgagtttggcagtgctccttttgtttctattttatggaatagtttgaagagtattggctttagctcttctttgaaagtctggtagaattctccattaaaacaatctctctattgggatttattggttaggagacattcaatacatgcttctatttctttaggggctatagagatgtttaaatagtttacctgtccctgatttaactttccaattggtatttggatagaaaatcacccatttcattaggattttacaattttgtggagtataggcttttggagtaagacctaatgattctttgaacttcctcaatgtgacttgttttgtctttctcatcattactgactttgtttatttagattctgtttcgctgtcctttgcttattttcgctagggtttgtctatcttgttggttttctcaaagaatcagctcttagctttcttgatttgttatattgttttctttgttatgagctgatttatttcagccttgattttcattattttcttcctcctactccttgttgatattcttgcaccttttttttctagagatttcaggtgtacttttcaattgctggtttcagcatttaaaatttctttatgggggcattaagtgctatgaacattcctctttgcactgttttcattgtgtctcataaaactggatatattgtaccttcattttcattggattccataaagtgtttttccttccttccttccttccttccttccttccttccttcctccctccctccctccctccttccctccctccctccctttctccctctctctctctctctctctctctctctctctctctctctctctctctctctctctgccccccttccatgccccagagatcactgaatggagacttgttcaatttccattagtgtgtaggctttacagtgttcctgttgttgacgtccaactgaaatccatggtggtctgattagatacaaggcattatttcaattttcttgtaccttcaagatttgctttgtgactgattatatgatcagtttggagaaggatccctcaggtgctgaaaagaaagtatatcctcttgggttttggtgaattttctgtacatgtctattaggtatttttgattcacagagcctgttagtttcattatttctgtgattatggttttgtctggatgtgctgtcttttgatgctagtcaggtcttgaaataccctacaattaatgtgtgggatttgatgtgctatttacattctagcagtctttcttttatagttgttgagtgcccttgtcttccgggtacagatgttcataattcagatatcatcttggtagatttttcctttgatgagtatgaagtgtccttccctgtctcttttgattaattttgcttgaaagtgtttatttttgttttttgtttgtttggtataagaatgactacccccacctttcttattgcattcatttgctcagataactttttttctagcactttactctgaggaaatgtctattgtcttcctgaggaatgtttcttgtatacaaaaggataatgcatcctctttttccatccattctcttagcctatgtctttttaattgggaattgagtccactgttgttgagagatattaatgaccagtgattgtaattttccattattttgtcagtggtggtttagtgtgtgtgtgtgtgtgtgtgtgtgtgtgtgtgtgtgtgtgtgtgtttatgtatttgtcagtgctttctttgcttttgctggtatgggtttgcttatttcctgtgttttcttggatgtagttatgtttctttgtttggagctttccttctcctattttctgtagagtagaatttatgaacagatattgtttgattttggatttttattgaaatgtcttctttctgccatgtaagttgattgcgagtttttctgggcatagtagtgtatgtaggcacctatgtttttttagatgttgcaggctatctgctcaggcccttctaactttgaccgtctatgttgacaagtcagatgtaattctgatatatctgtctatgtatgttacttggtcttttacccatgctacttttaatattctttctttgatttttaggttttgtattttgataataatgtattaggatgggtttcttttctgttccagtctaattggtattctagaggcttctcacacatttctaggaatctctttctttaggttgggtacttttcttctatgattattttgggaatatgttctggtccttggagcttggagtcttgtcttagttagggttcaattgctgtgatcagacaccatgaccaaggcaattcttagtttcagaggttcagttcagtattttcaaggcaggaacctggcagcatccaggcaggcatggtgcagaaggagctgagagatttacatcttcctctgaaggctgctagcagaatactggcttctagacagtcagaataagggtcataaagcccacacccacagggacacacctactacaactgggacacaccttctaatactgccacaccctgggcccagcctatacaaactatcacagagtcttaacattcttttatttctgttgctctttgatggcctttggtggaatcccagatttcctggatgttttatgctaggagttttaaagatttgtttatttatttattatatataagtacactgtagctgtcttcagacactccagaagagggagtcagatctcgtgattggatggttgtgagccaccatgtggttgctgggatttgaactcctgaccttcggaagagcagtggggtgctcttacccactgagccatctcaccagccctatatttaacatttttcactgatgtattaattacttgtattgtatatttatgcctgactgtctctcttccatctccattattctgtacatgcttgttgcatctgttgatcttgttgtcttcccttagttttctgcctccagaatttcttcagtttgtgtcttctttattgcttctattttgacttccaggtcttgcccagttttatttgtttcctttacctgtttaattctattttcctgtatgtctttaagtaattatttgtttcttctttaaagacctttattgtttgattgtatttccagtgtttctttaaggaatttataatttcctattataaggcctctatgattattgtaagatagtagttaaggtaattttcttgtatttcagttttgctaggttatctgagcttgctgtagtggggtagatttgctttggaagtgtcatattgccaaggcttttgttgattttgtttttttgagggcctttagcaaactggatggttttaatccctagatgttcttgttgtagcagatattgggaagagggtgaacttcaattttcctggtgtggcaggattctgatggatatcattaggctgtatgtttcagcaccttatggttcaggagtctgactaggtttgaggagagatgatgggagagtggaggtccacatggcatagcggtctgctcagggcagctttggttggcccagagggcccaggagctgtatttgttactttctctactacatattgtatgttatatacagcatttaaacgttgtaaaataatcaatcttccccaaaaatatatacttacaagtgacagcaactttagcaaactgctagaaaaaaaatgaatacaaataattgatagccatgatacactgaaaggacaaggaatataccagtataaaataatctgaatgtacagcttaaatctcaattacatcaacaaaaattatgaaaaaaatgagcataacaattggacaatatctgaaagtttctcaaattgaacatggaatgaaaaatttagataatcatcatctcaaaataaaaagtgacattaaggccagacgtggtggctcacacctttaatcccagcactcgggaggcagaggcaggcagtactcaaaagtagacataggatcatcaggtatggatattattaaatatgcattaatgatatttttaaagtataaaaggacaggaatatgaaagttgaacaaaattttgatgtattatttggttctcaaaatattcagtattattaagatgtttgatacataaaatgcatttaaataataaaatattttaaggagaatctgttatatattttatatggtttaagtcatgcttttttatgtatctgtggaaatacaaattcaaggttattttatagcagtctttctcaataggactgtaatctagttcaaggatggcattcagagataaaacaatctttattaactttcatgaataaaatatttatcatatcatagtgccctatgtctatgaattcttaaattgtattcacctctaaagattgctaacatatgaggtttatttcaagacatttagacagaaatttagcatttctcatattacaaactttactgcaattggaattttgtttcaaacatcgttcttaatcatcattatgccttgttttagaatatcattgagaagatacaagttttctctggtaatgttttttgctactgatgagatcaacaagaatccttatcatttacccaacacgtctttgctattctccttcatggatggcctgtgtgaggataaattggtattctgggtaagatatatttagaagaaaaaatcatttggtttttaattatatctgtgaattagaggatgattgaaacatatatcttacaggaccatcatggaaaacagctgtaaaactgtcaatttattctagaacaccatatttaagaatgtgtgacactggatgagttaacaacatttaaattccatttatatttacctacaagaaaacttgaacagcgtgcatttatgagtgatgagtatattgctacacactgagaaatatacatgcacacactctcacatacacacacacatatattttaaaatagatatatattatttatattatataaaataaagaattaagtaaatagatcatagatgtactagccaaacaggcaaactgtttttgagaacagtggaatgtatcagagacagtcaacaatctaataggaatgatatttataaaattatgaactaaccagtaccccggagctcttgactctagctgcatatgtatcaaaagaaggcctagtcggccatcactggaaagagagacccattggacttgcaaactttatatgccacagtacaggggaatgccagggccaaaaagtgggaatgggtgggtaggggagtggggggggagggtatgggagacttttgggatagcattggaaatgtaattgaggaaaatacataataaaaatattttcaaaaacggaatatttatagtataatcttactatctttgataggagttctgaaagatgagtaatgttacttgtatataagtccaaacatcatgacaatcatattcctcagtagatgttttatcatctcttctatatcctttaggttttttttgttacatttaatccgaacctaagtgaccatgacctgttcccctatgtccatcaggtagccacgaaggacacacatttgtcccatggcatggtctccttgatgcttcattttagatggacttggataggactggtcatcttagatgatggccagggtattcagtttctctcagactcaacagaagaaatgcaaagacatgggatctgtttagcttttgtgaatgtgatcccagaaaacatgcacatacacgtgacaagggctaagacatatgataagcaaattatgacatcatcagcaaaagttgttatcatttatggtgaaatgaactcaactctagaagtcagctttagaagatgggaatatttatttgcacgcagaatttggatcacaacctcacaatgggatgtcatcacaattaaaagagatttcaaccttgatttcttcatgggactgtcacttttgcacaccacaaaggtgagattgctaaatttaggaatttttttgcaaacaatgaaaaccaacaaataccagtaaacatttctgagtctatactggagtggaattattttaattgttcagtctctaagaacagcaataaaatggatcattttacattaaacagcacatcggaatggacagcattgcacaaatgtgacatggccctaagtgaagaaggttacagtctgtataatgttgtgcatgttgtggtccacacctaccatgaactcatgcttcaacaagtagagtctcagaaaatagcagaacagaaaggattattcactgactgtcagcaggtaaagtttcttacttttcattatgcttatatatataacagtgtgatcttttaaatggacccagagaaacaagtatacatttgttaaaggttattctgtcagtggaaagatttctacactgaaaaactctgtaattaatcatttacatgaatgaatatcatgcacaaaataacatttaataggagacaaaacgttttttatgatagcagtgagttttgtgaaaacgtgtctcaagatttccataaataagttcaaaatttaaaataggaaccaagagttttatcataaaagccttaaatgatgactagactagaatatgtttttaatgcataatttctcatccaaacagtgttggcacatgcctttaatcacagcacttgggagtcagaggcaggaggatctctgagatcgaggccagtctggtctacaaagtgagttcgaggacagccagggctatacggagaaaccctgtcttggaaaaaaacccaaaaacaaaaaagaaaagtttctcagggatcagtacatgtgcagtacaaatagttactcattgaactttacaattacttacaaaaccataaatgattaagactgtacattttattaagtttatgtttatctcatatatgtatactgtctattcatgaaagacccacaaccatcctttatcttcacacacattcagaattccccttcatttgcacatacatggcttcattttttaaaaagtatttttgacaaacatgtgcacacattcacacaccatgttacttgttatctggtaatcattttttctagtacattttaccatcaaacattaatatgaagtatataaattttcaattatcaaaaaggtatattgtattttattatacagggttacttcatagagctgtcttttctgaaagactaagaaaattagaggaaattctcaattttgtcttccccttattaatatgcttatgtaatcatgaatttcttttaattggtttccttgctgaaagcccagatatttaataaacctgatggtgaactggtgaacatgaatcatagggaatatcagtgtgtagagtatgacatttgtatcatttggaattttccacaaggccttggattaaaagtgaaaataggaagctattttccttgtttcccacagacccaacaacttcttatatctgaagacccggagtgggccacaggaggaacatcagtgggtattccacaattttatatttttcatgatacctaaattttaaaatatgaggcagtgaagtaatagctgtgtggttgagaccaattgctagtcttacaaaagactatcctcaattacaagcacaaatatttcataactcacaacttcatgtaaaaatggtcatagggaaaaaaggtctcttgattccatgttcaattgtacccacatgcctattcatcccacactataggaatatgtttattacatatattatatatatataaattttgtatacacacacaccatggaattttctgattctgggtgacatatttatagcctaattaagtataggatgtattcattaacagagatctccagatttaaggtttcctgtttttatttgtgtattttttattggttactttatttatttacatttcaaatgttatcttgcttccatgtttcccctcttctttagaggattgccttatctgacatcagagggaggggaggaccatgatcctgtggaggcttgatgtcccagaataggggaatgctagggtggtgaggcaggagtgggtgagtagataggggagctccctcataaaaaccaggggaaacagaggaaggtatagggggttcaaggtcttcttttaaacttaggaaagcttccttaattttatgagagtcttatatagcatattttgttcatattcatcaaacaaatctttctggatctatcctaccttatttctctacacacctcagtattgttattttttatttgtaaatcattagagaactgatgccacataaacattcctttggattaatcagattaggaaggaaaaattttaaattgcttcaaactaaatattacatatctattattacatggtgtattaaatattgtgacattcagtgcactgcagggtaatacaaataataatgtgcctgaaattgttaagtaatactgattatcagaggaatatttatagccatatctgttaatgtcccatatatcaatctaagggtcattatgtatatgatgtacacatgaactacattcacacacgcaaacatatacaatttatgcatttcctcaggttcccttctccatgtgtagtgtggcatgtactgctggattcaggaaaattcatcaggaagaaacagcagactgctgttttgattgtgttcagtgcccaaaaaatgaggtttccaatgaaacaggtacatgcttgcatgcagaagaaaaattgctaaatttgaatgtgttctctttccaaacaagaaatatatggtctagatgaaaattgaagacctaaaatcttcatgtttcactacttaatcagttaaataatatcaactgcttttggacccagcaaatagcctgcaatatcttcttcaaacaatgtatttctctcacaatatgatggttactgattttatgttacatagaaaatgtttagggggatatatacatgtaacaaatttctaaacaaaaattttaggcataatctatgcatacgtttatttttcattgatcctttatacaaagcaacttgactacatgatcagtccataatctttttctccagtacccagcttagtacctgacaaagaccagatgttcagggtaaaagttgtttaatgaaatatattttaagagcttagatggtttaaaggattaagaatttcctgtgaaagaattagaacaagagtgaagatttccagaatgtaacaagagatgggacagtgcttatcatcaatcacagccaacctaaggaaagagggatgaatgtgaatttcaatagccttcgtgacctacagcttggaatgtatagttgggaagaaagagattgtaccacaatgggagggacatgcatatgtctatgaggcatacagtttcaagaatgaaaatattcctttatgcaaactgtatttgcatgagaaattaaatgttctagctcctacatgtaaataaaaacataggcacaatccacaaagcaacaaagtacacaatgcgttgcaacaactggcaccaacaatgatgtctgcaaactacccttttctgtgaatagtgaatttatggtttgaggagataataatctgagagtatgcatattaattttcataatattttcttttttgtttaataaatattttttgtccattctctatgatgtttttttcttccactataaatcatagttcaatcgacagcaatcttaggttcatggttcctacaacaataaggaatggaatagatgctcaacatcaaattatttattgatatatcctctgaataatacaaattcacaattattaactgcataactatgatatcttatacaggtttattgttgttcaccagcagatatggaacagtgtatgtgtccacatgataaatatgccaacttagagaaagcccactgcctccaaagagctgtgtcatttcttacttatgaagatccattggggatggctttaggttgcacttccctgtcctcctcagccatcacaatgctagtactagtcacttttgtgaagtacaaggatactcccattgtgaaggccaataaccgcattctcaactacatcctgcttatcgctctagtcttctgctttctatgctcattgctcttcattggacatcccaaccaggccacctgcatcctgcagcagaccacatttggagtatttttcacagaggctatttctacagtgttggccaaaacaataactgtggtcatggctttcaatctcactactccaggaagaaggatgagagggatgctgatgacaggggcacctaagttggacttcccatttgtatcctaatccaactcgttctctgtggaatctggttggtagcatctcctctcttcattgaccaagatgtacaatctgaacatgggaagactgtcattacttgcaacaaaggctctgtcattgccttccactttgtcctaggatacttgggtttcttgactctggggagcttcactgtggctttcctggctaggaaccttcctgacagattcaatgaagccaagttcctaactttcagcatgctggtgttctgcagtatctggatcaccttcctccctgtgtaccatagcaccagggggaaggtcatggtggttgtggaggtcttttccatcttggcttctagtgcagggttgctaatgttatctttgtcccaaagtgttatgttattttaattagaccagatacaaattttatacagaactacaaaggtaaattgctttattgcaacttagtatgaaaaggttagataatactcgacatatctttttctttctcttgacaaaagtgtctgacattgtcgtttaatttttttttcatttatatttcctgtctccaaaacaacctttgtaccactccctgcactcctaaaatgcacatggctttatatttcattaattcttactgaatgtgtatatatatttgcatatgcatatatattttgaaatataagttgtagagactgtgtaacattgcatatatttatgctctgaaggctcattatttggtactatatggccaatctttagactctggttgtccctgaagttgacaacctcttccattccaaggtttatagtttcctataaatggttgtgtaggctatactttgtcagctttcttccttccatgctgtaatgcacactgtagtgaccccttttctcattatgttttggaggtcatattgttaagacttcatggtgtaccattggggtcacagggcaatatcagggtcatggcagagagtctgaatcagaaaacactatagaggtcatgttggggtctgaattcggagttcacatgtgatgtaggggtcaggcgtgaggttggggttctcatgataggtcagatgtcacccttggtgtcaggggtcacaaagccatctgggagacacagtgtgatccctggctgcgctttggtgccacccctagcctcgccccccactacagttgccccgcctggccagagtcacgtgacgcgggcagcaggggaatgagagatgttgggagcaggagggcaccctcgggtggaccccagggagtaatgagctgcggacagggattgtgatcttagtaacccctgacctcttctctatggccgcgctgcctgattcaccgcatggataccgctgagcaccaagcccacgcccttatccctcagtccggacccccgtggccgccctgcgcgccccatccctgcaccacgacctggatgaccccaagcgggcagcgctggcgggtggctgcgacttccaattcctgtcgcggttctggaagcagctgtgggacttctggcagttgcagggggacggggcggagtctccgggatcacgggaggggcggggacaccacacgagggctctgtgatcccggatccgcacttgagtggtgaaggttgagggagcaggtctaaggaggctgtgtgtgacgtcacggggccacgaggggagggggagaaaggcgagggtgcttcctgacagcagtgggcgctcccgcacccctgtgagtaaccgggaagagaactgcggagttgacaaggtgtctcagagggtcacacttccgcgctcccgctgttgccaccagagtctaaaaatgcgcaggttaatctggcgccgggcccagtgcgggggagggggggggttggggtgggtgtaggagccttggggcggggccgcacccgcgcagggcggggctgtgggtagagtgatggcagggggcggggcgccgtgggaataaataaataaaaactaagtaataacacacatacaaataaacatgcatgcatacatacatacatacaataaatggaactaaatgcatggtgctatacagagtttggatgccacccacccacccgacctccatcatatgcctgcactatcatacatacacaacattcgtacacaacatacacacatacaggttcctactatcacaccaatgcacacagtcaccacacacccacccaccacatgcaacacacacgaacacacacacatggatatattttgaaattaaattaaatagataataactataaaatcaaaaacaaaatatttctggggtcaacattctgctgtcaatacactgacagaaaaagaaatcaaacacacacacacacacacacacacacacacacacacacacacacacacacacacattacctccctagaatgaaagaaagggaaaataaaaaggaaagtgtgctttgatctcagcactggggaggtagaggcagaggcaggactcacttgaaaggcctgcctggactatctaatatgttttggcaccatgtagagagactttgcctctcataaatgaataaataaatacagaaaatatatttatccatctatacatgcatgtgcatattaatttttaagtttagtttattatgaataaaattaactttggccaatttaaccagtttactttacttaaaatttctttggtattaattacatgatgtgaatgacacaccatgtgtatattctaaaccatgtgtatatgtgtatatttataaaaagcaaatattaataaaccataaagttgcatttactgcttgtctgagattcctttttcataattttgattgtcatgtgaaaacttcacatacagatctttagtaagcatacttttcgtttgggtagaaagtaaatcagatgtgtctagagcaaaagaatactgaagggcattttatttcataggaaaattagctctgtaaataactgacagtgaggcccagaagagggtagcataaatggtctttgctggcagcagtctgactggcttttaaaacttattctttgattatctgttcggttttgtgaatatcaaagtctttgcttcctaagttaggatgctagttttggaattacatggatggaaaaacttttaggttcatttgagaagccattaagtatgcaaggtagaatctataagaataagaacaagggctggtgagatggctcagtgggtaagagcacccgactgctcttccgaaggtcccgagttcaaatcccagcaaccaaatggtggctcacaaccatctgtaacaagatctgacactccctcttctggagtgtctgaagacagctacagtgtacttacatataataataaaaaaaaaaaagaataagaacaaaacaaaacattaagatatagtaggcctattatttttgttttgttttgtttttgttttgttttgtttttagcagttcaatgtgctgccttttattttaccacacaaacaaaatgattggaattatttaggtccagtaaaagagacaaataacttctgaatgactaacagtaatactgattttgcctcttatgagatacatatatttctagaaaattctctccctcctacatacaaaaccaaaaagataattctttccagattatggcttttctggtatgtatactaatattatatatactttcacatatactttcacaaattctccgagattgtatttttctaagatataatccaaaagtgagctaatgtttatcttaaattttacccatttaactgtaaatagactacaactcaagaaaaatgaagattgaagtgtggacactatgtccctccttagaagtgggaacaaaacaccgatggaaggagttacagagacaaagtttggagctgagatgaaaggatggaccatgtagagactgccatatccatggatccaccccataatcagcatccaaacgctgacaccattgcatacactagcaagattttatcgaaaggacccagatgtagctgtctcttgtgagactatgccggggcctagcaaacacagaagtggatgctcacagtcagctaatggatggatcacagggctcccaatggaggagctagagaaagtacccaaggagctaaagggatctgcaaccctataggtggaacaacattatgaactaaccagaaccccggagctcttgactctagctgcatatgtatcaaaagatggcctagtcggccatcactggaaagagaggcccattggacacgcaaactttatatgccctagtacaagggaacgccagggacaaaaagggggagtgagtgggtaggggagtgggggtgggtgggtatgggggacttttggtatagcattggaaatgtaaatgagctaaatacctaataaaaaatggaaaaaaatatttcttttttgtataatcgggatactactgatacagttgtaccatcaagaatcatgttgtccaccattttgtcttgaaccacatggttatattaactaaatctgtggtgacacatggcctatgctatatttatgatatcactatcaaagaagagcaccaagttccataattgctttcatcttaggaggatccccaagtgaaacttagaacaatcaatgcaatagtggttttctgttctatgtgaattgcaccccttggcaaagtaaagaaatttcccatcaggaagttccagattcttggataacctcctttccactttcctgggggcaggaaaagagatgatgatattatgaaaaagaggactagggaggcagatgagagaagagatagaagctgatttcacatagcacagcaaatccattgccctaactttgagcctagtcctaaccatgatatttcttctttgtgtaacagggatactattgactcagtagaacaatcaagaataatggtggccaccttagccctaaccctgagcctaaccctgggacttacccacaaactcttaccctttcttaaacctcagcccttattttcctaactaccataaccctaatctaacaacccttatcctaatccttaccataaccctctaatctcctaatcctgattctaaccctgcttactgtgggggatatttcttaattataccttttgaggtgagaaaccctttcttattcttgatcttttgagatgttcagatccacatttaatctaggctatagtttcttttggcaatctacatatattttaaaaagcctcttgttttctaaaattcctttttaatgttaatagcctggccacccttccattcctgggtcagattgatacctacaatgcaggtagagtaatgggctattgaaactactcaccttgatttcagggaaaagaaggcaagtgctatggagaatgttcaggcaaggtctgaagtcaggaacattgctcacagaggggaggagctggcagcagaatagcctgagctggaatggtggattctccccccccccccccagggcaagcacgaatgctaatgagctgaaaagggctccagagatct

SEQ ID NO: 296 - DNA, 14134 bp, Mus musculus
  misc_feature (975)..(975): n is a, c, g, or t
  misc_feature (982)..(982): n is a, c, g, or t
  misc_feature (1032)..(1032): n is a, c, g, or t
cactttaaactttttaatttggtttttggagacagggtctcatgtagttgagttgaacccctgacacttctgttgcccctttctgagtgctgaaactacaggtatgtggcattttaggcagtgccagggattgaacccagtcctaagactgttttattacaggtaagatggttcagccaataaaggtacttactgctaagacaacctgagttcaattcccaaaacccatagggcggaagaagagaatcaactctggtgagtgtcctctgacctacacacacacataaataaataaaatttccaaaagcatttactgggggatgaagagagagcttaatggtcaagaacgtttctcgcagcggacctggtttggttcccagcacctacatggcatcacatctggtagtaactccagttccaggggatctaatgccctcttcttacctccccagacttcaggcacatacacggtacacagatataaacagtcatacacataaaggaataataaaaacttattaaaataaaatgaattccttttttaaaacagaaattttagagggataggaggggtcttgctatgtagtcctggctggcctccagctcacagtaatcctcctgtgttctgttcccaatgctgggattccaagtgtgagtcggtatgtcctgagttttgtttgtttgtttctatgctgctgaggcttgaacctgggacttcatgcatgctaggcaagcactctatgaacaactacattttcagccttgaaccagtgactctcctgcctcagactgctcaaagcgctggatttgccgacagtgacgttccgccgtgtgttcattccttctgcgttgagtatgtttctttgtaaccacctccctaaagtaagatgaacagggaaacatcaaaacctcttctggagccgggcgtggtggcgcacgcctttaatcccagcactcgggaggcagaggcagccnggatttnctgagtttcgagttcagcctggtctcagaatgagttccaggacagccagngctataaaaagaaaccctgtctcgaaaaaccaaaaaaaaaaaaaaaccaaaaaaaccaaaccaaacaaaaaaacctcttctgggtgactctttgtggtttgttccatttacactctatactttctttctagcttccaacttgtaatcctcctgtgtcagtctctctctctctctctctctttttttttttgagacagggtttctctgtatagccctggctgtcctggaactcactctgtagaacaggctggcctcgaactcagaaattcgcctgcctctgcctcccaagagctgggattatgggcgtatgccttctccatttgcctgagattataggatgcactggcatgcttggtttctaggcaacaccttcctatcttcaatcagcatgaattagtttctagcgccctcctggcctgccaatatcactccttggtttcctgtggctctaaagctgagggttaaagagaactttagaagtatactgacaatgccctctacatagttgatcactgagagaaaattccttcttcctcattaagtaggtggatcataaccctgataggctgttccgatccattaccccaccctataaaatgttcttttcctttcctcatagctattgtatcagaacaccggggctagccagctagacagagttcccttggaattttttgctttccttttcgtttagagtggacacccacacactttcatcctgctttttcatcaggttgtgtttacctagtgtttgactcattgtatccatcgcactatccatcacactacgttgttgttgttgctgttgctgctgctgttcttgttgttcaaatctctctcctaaatgggtggcttaaaggcagaaacctttctttacctcctactaagctctcggtaggtgttgagccctgctaatcttctgaccttcagaatcttctaatttcagccctgtctgcctaaccttgaagtaacacttgttatcagtcagcgagttgataatttacagcaggtctctgttgcctaatggctggaacatgtctcatcctgactctgagataactgcggttgagatttgccttcaccctgccatacccaaaccatcctgccaaggcttgcttccaccagcctgatgtccttagtgacccaaacacactatatttctttctgaccttggtcttcactcatcatccctcctgcttggaatgcgtccagcgcttcaaaccctctgcatttcacaagaattaggagaatgtatttggcaggagttctggtgctctcctcaagagttttgtttttgttttaacatgggaaagatgaaaattagcagatgaatatgtataattggattccgtgaaggacgcagatgcaaagctgtgttgctccagcatagacctgtatcccttgtcatactgtatggccacttgctttctcctttcttctctttaggcttagctttttaaagggagggattgttatttcattgttataaactaaccatgaaatgtaaactaacatgatatctgttcagtaaatgagcttagtaattttttttttttttttggtttttggagacagggtttctctgtgtagccctggctgtcctggaactcactctgtagaacaggctggcctcgaactcagaaatcctcctgcctctgcctcccaagtgctgggattaaaggcatgcgccaccactgcccggctgagtttagtaattttaaagggaggaagttagaaatactactaaggaggggatagtgtttattatgggaagggaatgttgggttctatgtttggtttacagtaactgagtagttatcacaaggcacttttaactagtccatctctttcattctttgtaaactaggacttggaagattgacatccataccaggtatggtggctcgtgtctataaccctagcacttgagagaccgaggcaggaatattgccatgagttcaaggccagcttcaattatagcagactattctctgtggatttctgtgagaatttaatacccatgaagcaccggtcacctagaacacatggatttgtgtacatgtataccagtgtaaacagtaattgtgaggtaaatacagagataaaggtatcattggaagaagcagccagcataccggaggctgagaaaagaggaccaggaatatgaggctagcctaggctacatagtaaaatgctgtttaaagtactctggaggcagaggcaggtggatccttcgttcaaggacagcctggtctacagaatgagtttcaggacaaccatggctgccctgtctggaaaaacaacaaccacaaaaacccaaacaacaacaacaaagccaggtggtcacagcacacatgtgggcagaggcagacagattcctgagttcaaggccaccctggtctacagatcaagtttcaggacagccagagctacacagggaaaccttatcttgaaaaggaaaacaaaacaaaagacttcatacacatgcagatgataaaatgttacgaatgagtgaactcatttgaccagtactgtgtggaacataaaatatacattatatgggttaagaaaacatgttgagccgggcagtgcctttaatcccagcacttgggaggcaggcggatttttgagttcgaggccagcctggtctacagcgtgagttccaggacagccagggctatacagagaaaccctgtctcgaaaaagattatatatatatatatatatatatatatatatattgtttccactgggataccccaccatcaccaccactttattcccagagggaattttcttctccttttcttcttctttttcctcctcctcctcttcctcctccttgtctttgtatattctgtttcagaaaaaggttggaagaacagctatgcagtaggaaagttatgagtggaaatggagaaaggacaaaaggctggaatgggaaaacaaaagtggtcgctctgctctcttctctgagaggactgcagagatggcggtgaaactggagaggttgtgggtggaggtggtggaggtggtagcacttgggaagtgaggggcactggagaagagaagacaaaaaggctcagctatggtgaccgagccagagagcaggagttccctgcaggaagaaagagggaaagaagctgtgcaggagggcagctgggccagagaaaagcttcgagggtaaatctcaggaagcagccatttaaaaagaaggggctagtcaggaactgtgaagccggaattagagaggaggggtagcctggggttactagagacaggatggcatcctataggaatgataaatccagggtgttttaaaaaggatatgattccttccttccttcctcttattattctattcatttacatttcaaatgatatgccacttccctgttaacccctctacaagccctccatcctacaacctccctctcatccctcccccctttgcctctgagttgctcccccacacactcaccctctccagccccaccgctccagcatttccctaggttggggcatcaaacctccacaggaccaagggcctcccctcccattgatgttagacagggccattctctgctacctatgtatctggagccatggatccctccctgcacattccttggttggtggtccctgggagcactgggtggtccagccagctgatgttgttctttctatggggttgcaatctcctcagctcctccagcccttctgccagctccttcatggggtctctgagctcagtatgatggttggctccatctgcattcgtcagttgctggctgaacctcccaaggagcattcacccccaggttcctgtcagcaagtgtctcttgggcaacagcaacagtgtctggtttggtgtctgcagacaggacggataccccggggggtcagtggttcttccttcagtctctgctccatttttttgtccctgttcttcctttggacaggaacatttctgagttaaaaactttgagatgggtgggtggccccatctctcaactgggggccatgcctatctactggaggtggtctctacaggttctatctctccttctctgctaaaatcattcccgtggggtcctgggagcctcttgtttccctgtcatctggcactctccagtggttatccccatttcctcatctcccctgctacatattttattttatttcctgactctctgaacctcctacttatttccttcccctcctctctccctccctccacctcctgtgatcatcttgttcccccctcagtgcaggactgaagcagaggatatgatttcatatgagatgcactcaccttatgtgaaacaaattctaaatagctgtgctactctaaatagaagtattcctctcaagactggaagggattggtagcagctatactagaggctggtctgcagttgtaatggttaacctggtaggtggaagaagcctcgaatatttaacagcgaaattgaagaaggagaatgaatatagtaaaagaccagttgcctggtgaagggcggtcctctgatgtacaagaacagggtcaatttgatgatgttactctagaacaatgttgattagtggctttgagagcttgggacaaagttgaagagcctggggggggatccatttacaaagattatacatggctctgaagaagctgccacttatttatttgcaaagattagtggctcagagggtaagagcactgaccgctctttcgaaggtcctgagttcaaatcccaacaaccacatggtggctcacaaccactagtaatgagatctgatacccttttctgctgtgtctgaagagagcactgtgtacttatgtataataataaacctttgggccagagttagcagtgactgagtgagtggggcagaccggagtaagtgggatgcgggggttgaccgaaacgagcagaggtcctaaacttcaattcctaacagctacagtatactcacatacataaaataaataaagaaatcttttaaaaaaaacaaacaaacaaaaccaaagattagtgtcagctgtggacactaataaagccataccagaccctgacacaaggagatgttgatagaaacactggtgtataataaaggtatgggcagcatcccatgctaatataataggtcaagctatagctagaggtctccgatatcaaagtgcttcaactgaaagaggttgcaaagaggtcatttgcaaagaacttgtgaccaagctgataaaggtctcagatcgcacaatgcccagtgctttaactgtggtcatttgcaacaaaattgtgaacaaggcatctctaagggcgatgttcaaagaaggcctaggtttccagactacttcaggcagcataggtctagacttggccacaggtaaatatcttactctatacccaaaaatcatggttataaaataaactactggggtttatggttctttgcagttggagacagcagggatgatctggggaagaagtagattagcttcccaaagagtcagtgtgcatccaggaattgtagatgaagattacaaaggagaaattaagccgggcgtggtggcgcacgcctttaatcccagcactcgggaggcagaggcaggcagatttctgagttcgaggccagcctggtctacaaagtgagttccaggacagccagggctataaagagaaaccctgtctcgaaaaaccaaaaaaaaaaaaaaaaaaaaccaacaacaacaacaaaaaaaaaaacaaaggagaaattaaaaatatagcctctgtaaaaagagaattgcagttgagcacagttgacagcaggggttccctacatcaaaggcaaagctgctccagtggcaagaatgagggtttggaagtcctggaaaacatgcgcttgggcaaacagttgttaatgatcagaggtgaaaatgtaaaattgcaagtaaaatgaaagagaagttttggtggatacagaagctgatgaaaccatcatttcacgaaaatcttggaattcagaatggccattcaaaaggtttatacccagtttcttatttatttacttatttatttaattaatttatatgagtagatggttgtgagccaccatgtggttgctgggaattgaactcaggacctctggaagagcagtcagtgctcttaatccttgagccatctctccagcccttatacccagtttctaaggattggaaagttatctcagataaaacagtgtgcgatgggctaaatgtgtgggaccggaaagtcacaaagccttatatggctgatatacacagaggtttggggggaagacatctcttacaacagcgggatactcagattaatattcctgaaatcccagaaacagcccacatgatcccataatgaagtaaagggtgggaaaaagaagaacccaaaaagtaggaaagaccagctataggcaaaaaagaaacaaaaacaaggagacattagattcaaggatctctctctctttctctctctctctccttgtttccttcccaggggatgaaacaagaggggcaggataaatctgggtccatctgtgagacttaatttttaaaaaatgtattttatttatatgagcacactgtagctgtcttcagacacaccagaaaggtgcatcagatcccacgttgtaagtcaccaagtggttgctgggaattgaactctgggaagaagagtcagtgctcctaaccactgagccatctctccaggccctgtgagacttaactgatgttcctgaatgtggacccctgggctgaggtccaggaccggacaaggagaaggcaagctgactatcggcatcccatccgtctctctctggttgccaacttcagaggcaacgtgagcacttgccttacactcctgcggctgcggctggagctgttctctctgccatgccttccccccacaggctgactcaactgcttgccaaagcaaactcttcctaccttaaactgcactttgttgggcatttgtcccacaatgggaaaggcactgcagcactcggcccaggatgaacagacaagtttcacacatgagatacaagtctatggatcaaaggctgaaaatgtagaaactactgagaatagttcatcatcgaaaagtgataaagacatccctaactatgacgcaaaactagaagccatagaaaaagctgaggatgccaggtgtggtggtgaacacctttcatcccaggactcagtaagcagaagcaggagaatgagtttgaggtcaacctggtctatagtagtaaaactctgtcaaaaccaaaaatctaatgaagtaaaatctaaacaatcaagccaaaccttctacatgatacgtggatacactggtgcacgtgtacacagacacggcacacatgtgcactgacacagcacacatgtgcatagacacggcacacaaaccagaaggcacagaacactggggacattttcaactgacagcacacataagagaggtaatgtatttaatatataaagaacacttaacaagtgagtaagaaaaatacaattatcctgctatagtttgtagaaggttttggtgtcccctgaagggccacgagttggcgggtcgccgagctgaaaggttctagagtcctttaagaatcagcacaggagccgggcgtggtggtgcatgcctttaatcccagcacttgggtggcagaggcaggcggatttctgagttagaggccagcctggtctacagagtgagttccaggacagccagggctatacagagaaaccctgtctcaaaaaaacaaaaaacaaaacaaaacaaaaaagaatacaaaaaaaaaaaaaaaaaagaatcagcacagggttggacaatggccttgcttttgtctctaaggattgggcaggcacaaaacaccccactaggcttggtcctgaaccattttaaggactctgccaagttgcagaagacgccagtctttttgtttgtccccacaaactagccttctttttgatggaacgaatggcccacctataaagtaggagagtgtgaggaggggactttccatctcccattatttacagggtgatggtttagtttatgtgtcattgggccacacaaactaagtgctatgggactcgacacttcccactcttcttcctctaaaggagggtgagaaagccctgacttggaacttcccactgggccttagggaagatcccggagtcctacttcctgcccagccaattaatgaaaaggtcactagaaccaccaatcattacatgcctaggtgccgttgctataatttaccctcaaaaactgtataaaaagctaatgaaagaaagagagaagctgggcatggtggcacacgcctttaatctcagcacttgggaagcagaggcaggcggatttctgagtttgaggccagcctggtctacagagtgagttctaggacagccagggctacacagagaaaccctgtctcgaaaacaacaacaacaacaaaaaacccaaaacaacaacaacaacaaaaaacccccaaaaaacaaaaaaacaaacaagaaagagaaggggtcacctctcctctgggtgcaggatgacttcagcgccgtggaaaaataaacctcttgcttttgcattgaaaaaaaaaaaaaaaaaaaaaaagaatcagcatagggtgtcggtggcacacccctttgatcctagcactcagtagcaaaggcaggtggacctctgagttcgaggccagcctggtctacagaatgagttccagaacagccagggctacacagagaaaccctgtctcaaaaaaccaaaccaaaccaaaagaattaatcagggtgtggcagcattcacctttcatcttagtattttttttttaaagatttatttattgattatatgtaagtacactgtagctgtcttcagacactccagaagaggaagtcagatcttgttacggatggttgtgagccaccatgtggttgctgggatttgaattcctgaccttcggaagagcagtcaggtgctcttacccactgagccatctcaccagccctcatcttagtatttgagaactggagtcaggtggatctctgagttcaaggccagactagtctacagagccaggccagccagggctaaatagtgagattggtttatttatgtatgtatggtttttttttttttttaattttgttttcaagacagggattcaccaccatgctctgcatgcctttaaggaaagaaaagaaaagaaaagaaaagaaagtgagcctagggctcgcgatggctctgtaggcaaggtgaagcacttgccgcgcaagccctacaacctggaccacctcagaactcaggtaaagatggaggagagaatgaactctaaagagttgtcctctgattgccatgcaccaacaatggtgcaggtacctgcgctcacacatcagatacacaaagaagaaacaaattttcttttaagaaggggagtttgggctgggcagatggctcagtatttaaaagatcaaggtaccactcagaggatctgagttgttcaagctcccagaacacaagttaaaagccaggatccaggggctggagagatggctcatgggttaagagcaccgactgctcttccgaaggtccgtagttcaaatcccagcaaccacatggtggctcacaaccatctgtaatgagatctgacgccctcttctggactgtctgaagacagctatgatgtacttacatataataaataagtcttaaaaaaaaaaaaaaaagccaggatccggggctgggcaggctggagactgggattctggggctggctacagttctagctgtaaggtcagtgagagaccctgattcaaggcaaaaaggtcaagagtggcagagcaggacacctgacatcttcctctgcctctgtacattagtgggcatgcatacctgcaacatacaagcattcatataacacacacacacacacagggcaaggggagaaacacagagagtgagacagatagatagagacagagggaaagagggggcgggcactggtgacaggagatccttgggtcactggaaaccctcaaaggagattaaggaatttcttctaggacagcttagtagttcttggaaggctgtcacagaggaagcctagatgcacccagtgtctgcatcctggcttgagatgtgaccgtttccttttgcatgcatttctgccatggcaaactgtccaattcaaggggtggtggtgctggagaacaaaacaaaaacaagaacacaaaacaaacaaccctacaagaattgagctgatgggctggagagatggctcagctgttaatttcagcttacagcttgtggtccataccagggacgtcagggtgagaattcaaggcagaaacctgaagatagattgatgcagaagccatggaggagtgttgcttactggactgcctagcttgctttcttatatcatccaggcccatcagcccaggggtggcactgcctactgtgagtcagtctggtggggacattttctcagttgagatcctttcttcccaaaggctctaccttgtgtcaagctgacatacaactagccagcatactagtatatatgccaatatatcaaaaaaaaaaaatcaagcaaggcgtggtagcttattgcttgtatatggggagtgccgagagttcaaggctaagctagaccacacagtgagagctcaggacaccctggaaaatatagtaagtccatacttcaccctgttcccaaataaaataaaaataataaatagactgggtctataattctgtgatggactataagtctattatgaataaggccctgggttcaaatcctcagtgctaccaaaaaattatatgtatgtatgtgtatatatatatatgtgtgtgtgtgtgtgtgtgtgtgtgtgtgtgtgtgtgtgtgtgtgtagcaaattctgtgggtcttctggaagaatggggcacagtctttaatcactgagccatcattccagctcctaaaacctttttttcttcccttttaatggaaaggctatcagggaaaaataatggtttagcattttgtgtaatgccagagcacagtggttgggaactaaaaaacatttgtacatatttattaggtatgtaagaggagagccgctagaacccagcctgtctctgaggcaactctcccatttttgctctcacattttgttaacagggtcaagccaggttcacattcccggggtggaggacactcctaccctgaccctccaaatgtccgcttaattgtctggtaaactgggaaaagaatgtaaaacttgctgttatcttgactgaggtgcctaagttgtaaaaatttatagccaaagcctgccaagccctcattaactgcatgcagctgaccagcgcctttgttccttttatcactttgagctcccgaccaaatgtccaggaggatgaactgagagccatggattctggacccagtgtcctaaaggatgaattaaaggccttcaagccaggtgtcctggaggaagcccagtcttcaacaaacactgtcgtgcatgcttaaccattaatgcaaaaatatgctcgatgaccctgcagctcacccagcccctccctccttttgcagttttaccctttaaaaatgcaacacagcttccttggggatgtggttcagacccccaacttggccacctcctgaccgctcagaaaataaggcttctgttttgacgtttctgtctctgaagtgagccttctcagcttccatccagaacccaacaggtatagtgagtgggtcatactgtaatcttggtattcagggaggctgagacgtcctaagttcaaggatatttggggccatatgtgagttgcagagcagcctgggctaaagcaagatcaggccaaacaaatgccaaaactgtgtataagtctcagtttaggacttcaactttctttgagggtgaataacaagtttgcccttggcagatacccaaatatttgtttcagtttagtagtacaaagtttctttcttggttacacactgtcctgtttattttaactgccaaccttgaagtcagaaatgttgttttaatttatttatactttccagtctcatccaggagatgcttggtaaacttgctgattgttgttgctgttggtggtggttttttgagacagggtctcacactgcatctctggctgtcctggaactcacaatgtagatcaggctggtcttgaactcacaaagatctacctgcttctgcctccccagtgccgggattaaaagcatgggctaccaagcccagtgtagcatgcactcttaactgctaagtcatctctccagcctgttttatttttgaaatggggtctcttgtagcttaggctattctctgatttgctaccttgtcaaggatagccttaaactcctaatcctgctgtccctgtcttttacagtcctgggattacaagcataaacactaggttgggttttttccccctttctatccttctcctcctcccctcccacccccttcccttcctctgagaaagggtctcatgaatcccaggctggtctacggcttattagatacctaaggctgagcccccaatctttctgtacttacatacctcttggcatagccatttttataggaagatccacagtttgaggccagcctcagcgacatagctagccctggtctagaaaacaaaagctaatccaaatgtaaggcccagcaaaggagctgctgacatagatcctatgtgtatgtataaaagacatattcccagtcctcccaagaagtatgggtcagcttttattatctggatgcttcctgtatccgtctatgtaggtttctttttgagagcaacccagtttgggatagtcaagatgtctctcttgtctcaaccctctccctacaccttcctatattaatttgtgtttttcacttaccaagggggaggggaccaaagattctgcaccatcaagcaattgaaaagtaatggaagagaaatcaaccaagcacattcctgcatctcacaggcagtgaccttactcaccttctctttagagatgactatcgagggcctggcagtccgaaaggctctatctgcatgccttgctgcccaattgggat

SEQ ID NO: 297 - DNA, 7203 bp, Mus musculus
gaaagcaaatatatttatttgaaattaaattaccgtctttattaaaggcactgcttataaattcatgtctctgattttacaaagtgtaatgggtaaaattaccatattctttttcttatttcaatccatacaatgagagtcatgttcagtttttcactgacttcatgctgggtaatgttcactctgcattagcggttgccatgttcaccgttttcttacaatgtctatccagtgcttgttactgtctcactgacagacagaagtctagctgttttcatccacataatggcaggcaggactagtgttgctgatgcttcacccagagaatctcattttacaataaagttagcattatacttgaaaaataaaaaataaaacacacgttcagaactcactttgtagaccaggctggcctcgaactcacagagattggccagcttatgcctctggagggctgggatgaaaggccagtactactactgtcctgcttcacgcctttcaattgtttaaaaaaagatttttatgtgtatgagtctgtttatgcgtctgtctgcacttacatacgagcaccatgtgcatgcctagtgactataaccttccataattttaacagccctgcttagctcacctctgatctagatcgcctcaaaagtatcaacacataacttcctaatttcaggcaattaaatcattcgcgaaggcggatgtggggtatcctatgtccagcgagcactagccgccaacccttccaggcgctcagtcttggctgctgcggtgcctctcattgcaccgcgcatcctaacacttttacttccatgaactttgcggcgaccggtgaagtcactggtccttctgtcactagtgacagcccagggaggtgggctcccagagcacggtgccagtagctggagcacccagatgactcgccatgagcggcgcgcgctttgccgatgaccggttagataggaccggcagcgcggtggccctactaaggtagtctccagctccgtcccactgccacctgaccccacatgaccaatcaaccagtcaggggcggaggcagggcccgtgcggctcacagattggccaaagcgcgaagcgcagccaatgcggatactccgggacccgaggctccgcccattcagagacttcggggcgctcaggcttggggtgacctgccggcgatcagggggatggacgcggcgcgaaatggcgcgctgggcagtgtggagagcctacccgacaggtgcgctcccttcaaggagcccgcagggcctagggacacctgggggacctcagtgagtgtatggtgaggcgggaggaagggacacgcagaagcgtccggccacaggaaccgggagagaacaggctaccgcccaagctgagggcagaagggggcccacgggtgacaactgtgccgagtgtggccacatcatcctcccgcgtttcgggcttcttcccagggaatgggctcttcctggaggttggaactggcagccgaatcgcgattatctgcgttttacaagaatcgccgctgcttagagtctaggatggcgtggctgtgggacgggggggaacgggggggggggacgggactttggggcccatttgaccacccgaaggtttaaagtgggctttggggcgggaaccctaggagcaccaggacagtgggggagacctgccttctcttgctgtccactgggctgtgggacctcctcccctggcgcgcaaggaaccggaggtcctggctcagccttctcccacccaggaatgtgttataccagaagccccctctccatccccatctcatttttttcttctttctcttttctcttttacccccggtccctcctccacctcagccccataaggcctcgatatgtagtccaggctactcctgccttctccgatatggtggaacttgcctataatcccaacactgaggacaggaggattgtgatttggaggccagcttggatcacacagtgagaacctgtctcataaaggcctaagcctggtggcttgagcctataccagacgtttattaagcagtttcactttctctaggaagcccgctaataacagagtcaatcgctgataaaatgcaaaccataaaccagttcggccaagctatagatgggaaaaccagtcacttggcaggcctatgggtgtgcagcactttgggggctctttatttctaggaaggaacagacttgggacacaggcaaagcctgcggcaatgggaattccagccccagggtggtcaggtaggtccacattacaaagcccagccttgcaagatcaggtgactgcgtggcacttaaagcaaagataggagatgaaagcttcttcctgcctgttctgccgtgctcccctggacatagttgggcagtgtgtgctggctcaccactgcatcggcttgaacactggtttgatgtaaaaccaagtgaaataatgactgttttcaggcccgattgcctaccatagagatttccgaaggtctgggaccctggtgagaacacaagcagataactctccttagggagggtctctggggctttgaactctgtgtcctgtggatgaagttcctacataggaagacaaagcctgcttgttcctggagctgctcatcacttgctccctagagaggacactaagcatgtgactcttgggtcagatgatgaatgggtccacagcggaagacagggagggagggagggaaggaagagggccaggctgcgtgcggcctacagtttccaatcgaaccctggagcctcatccaaacagatctgctgaagcacagactttaaaaagtttaggtagagtgggggtggggcaagaaaaactgaaaatgcaagttgccccagggagagacctgcccagtaaaagccagggaggggacagccatagccctgggaagcctccagcaaagatgagtacaaagctccttcctagaggcagttcctggaggactggaaggggcagatggctccaagttgttgggaaattacccaggggaatgtgggactccccagccattggcagatccttcctccctcccttcctggagttgggccgcatctctggcctccagccatcagtcagcctcatgctaggggagattatggccatcttgtatggggcagctactgggtgactggaaaccatggtgtctcccatcaggagggagaacatggagagctgaggtctaatagcctacctgggccttcactctagatgcagaagaccctcactgtggtcccccaaaagagtattgctgctatactctgcctccccaaactttacaggctattctctcttccaggaaggtctatatggactataatgccaccacacctctagagcccgaagtcatccaggctgtgacagaggccatgaaggaagcctggggaaaccccagcagctcctatgtgtcaggtaatctagaagaatccatgacaataaagggaaccagaagcctcttagagaaagtgtatactaacctgacttggtggcatgtgcctttaatcccagcactcagaggcagactgctctcagagttcaaagccagcctggtctacaaagtgagttcctggacagccagggctacctaaactgagaatccgtgtctcaaataaaaaacaaacaaaaatgggtgggggtatataaagtgtatgcttacatgagatggttttgtttgggaatggggtggactttcatttttctttcaactttaaagttagtacaatgcctatattgcttaacagaattcccaagagtttttttttaagcacactttagaaaaatggaaacaaaataattacgttctaatctttaagcattgtgtcactaaagtctacatagtgtcttctatgtaaattagcatcatgttacaattatatacctgacttgattcttaaagtcttctgtccctgtatgatatcctagctaggaactacacatcccacaggctgggattaaaggcatgtgccaccactgccaggcttataattatattcttacttctttctagtttgcctttgtggtgtagagttttaaatttttgcatttttggatgataatttgcttcaagtcagtagtcaaaaagacagcattccacattttctccacagacttggaggctaatcatgctttgccttcctagttaatgtttatcagcagaaggcaagggccccgcacccagccctgcactgtgtaattagggtaactaagacaagccacattaatgatggtttattgggaaatgagtgccagccaggggactaaagatgacccaagctaactgatctgccaccaggtcttactggtacctctgtccctccgtaaggggtttggtgggtcatagcagttgcttattgaaagctccccagcaactcagtgacacagactttccagatcagatgctagtcacccattaacttgtctgttgccttatttctggacattgccatctgcctaatgtcccctgtagtatagtcaaacttctgttagggtacactagagaaggccaagaagattaagggtcaacaggaagtggggcacacagtgggagaccgttgctggcctgggtgacatcccagctgctttctgttgatatttgagtagaaatgccaagaaaagtgaaaatcatgaatcacaaatgtttgcctgtcttgttttcaaggcagatgggatctcactgtgtagctctggcttccgggaatttactctgtagcccaagcctgcctcaaattcacagagatccacctgtgtctgcctccagagtgctaggattaaaggcatgtaccaccaccccagctcatcacagatgttttagtgtgtcacagtattaggttttaaaatctacagcaatgtgtgctgaggttctgtgggaagagtttgagtgctccagatgtggccttgcttgtaacagccaacagcatttggaagtgagcggagaaggggagaggttctggcctactgggcagcatgggaaagctggtctggacccagcatcaaatgtagggaccactggtatgttggctgagagccgcatagagccaccttcctctgacacagtgttcagtgcaactgggcagcagccaggacacctaattgaaggcaaatgcttccaaccttcctcctgtgtctcccaaggctgacctgaggttgagagaaggcactggctgaccgggtgtgtaaagcctcatgttctgtttggttacttctgtggttccttgtcctatcatgaatggtgggaaggtgggcggctagccatagcaccccctcctctagcatccagtaagaaagaaaagctgtgctgggggagcctagattccccccaaccaagctgcccctggctctcactgagttccggtggtgggcactgacttcctaagtctctcaatgtggcccctttgctgatgccccaccaagtggtaggaaagtgtgctccttttagtgggtgtgtctccttttagaatcaccccagtccttggcttcccttatctagttgctctgttagatgtggaattgctagtaatgaccatgttttttgtccttcaaggtaggaaggccaaggacattataaatgcagctcgagcgagcctggccaagatgataggtggaaagccccaggacatcatcttcacttctgggggcaccgaggtaaagctgctgcctttaccaaaaggcaatgatggggtaggggtggggtcacatcaggaacagttgttagctgtggatcacaggttacttcagccacagcagtttttagattaaaagtcaattggtttgggggttttttgtttggttggttggttttagtttgttggttgattggttggttggttggtttttgcttcttgttttttgttttgttttgtgtctgtaataggcattgaccaggacataaaaatgtcacttaggaaatagatccagtagaaaagaactggtgagacctcccagggaggtgacagacatttcctggggcctcctaagaagttctgaccctgctttgcagattggaggatgtgggttcttttaaaaccaatcagctgactcagtacagcctctgttaaaattctgacaatgaactctcacaaatgaactcatgtagaagctaagagtcaaggcttctggaagattagctgcccaatgagaagggtggacactccccaaaccaagactgtaagagctcccatagctacgcagacagctttagcaaggatagacatttggtcagagacagtgtgtcagtgcgaacacttgctgcgagactaggtggccacacatcttgcctgctcaggacaggcctggacagccattgtccatacagtagtagggcataagactgtcatgtgagtgagtgggcagatcgtagggaaccctgcctaactgtgctgccactggacccaggagtcaacttctgctgttcagcagagatgggaccaagaagtgacattagaaagtccttagctgggggctggagagatggattggcggttaagagcactggctgctcttccgaaggtcctgtgttcaattcccagcaaccacatggtggctttcggccatccataatggaataccctcttctggtgtgtctgaagacagctacagtgtactcatataaataaaataaatctttaaaaaaaaaaaagaaaaagaaagtccttagctgctgcctcagtacctctgtagtgtctgacaacgaaaggtttctcaaagcaagtgtggatagggtctactttaaaggagagcattgggctgggcagccgaggcaggaagatcacatgtatgagccaaaaccaaccagggagacactgaattgtgttccagcaaacagtaacagataaactttgcattatcggagaatacttcaaggaaagtcaaagagcatttgaaaaaggctttcatctcacggagctgaccaacagctagcacccaggacagctgggggactcgcacaactcacagggggataacagccagcaaacgagtcagagactttgtattagtcagcggtctctagagtcacagaacttatgggtcatctctatatagtaagggaatttgttgatgacttacagtctgtagtccaactcccaacaatggtcagcagcagctgtgtgaatggaagtcaaaggatctagcagttgctcagtcccacaaggcaagcaggcagaaggagagaaagagtgt

SEQ ID NO: 298 - DNA, 13219 bp, Mus musculus
gagatgggagctcactaagtagctgagcctggcctagaattctatctaggtaaattaagctgtcctagaactcacggtggtccactcacttgcctcttcctctccaagactggactgaaggcacacagcaccacaaaaggaataagaggagttttgttctgtgttaagatgactgtttgcaggcagcagatcatggggacattgtgtcagtcttctgcctatcacatgatctctcttctggttttaaaaaaatacacagttgactttcttcatagtggtatagtgacaaaaatgatttggggcatgtttcaggagccatgctaccctggtttcaaatcccaaggttgaaatttcatgtcagtagatgtggctatctctgtccccagtgttctcacatccctcttgattttccccagtcccctgctaagcactgtattaccctgagatagcaaattctgccctctttctactatttctctcagtacttgggatagaatccatgttatcggtttttgtcagaaagccagtaaatccattatctgcatttacagccaactacctccaacaaccgggcatttagttccgtactatagacccacgacactcaccatagtccccacactacttcccaggctcatagggccccattaacgcacacctgtaacatccaagttccacactagtccccaggctgttttggcttgcacacttctctgctgcagctgtctgttcccctttaaactagcaaggctttctccacctttcctgttctctctgcgcccgagagattgccatgtaatttaaaaactgacgaataaactgtgctttctcccatggagtggtccgggtctggttcctaggttttactatgccgtcctccattaggctgtgagcagtcttccactgagctgtctgcaatcctactttgtaacctttgatttgtggtggtttgttactaaattgcacaaggtgattgtagtccaggctggatttggcgtttgtgatcctcttgccagagtctgtggattactggtcaggataaacagacgaggcttttgtagttcacacagccacttgaggagacccaaggatgaggtcacttttccctgagaggcggggaattcggtttggttatagtgcacatggagttctcaagggaggacctttgacagattctaacggctcaggaatgcaggaagcactcctaaaacaaaacaaaacaacaacaacaacaacaacaacaaaaacaggcctgcttttcacattctggaatcctcgtgggactaacagccctcccggtcattttttctttggaagccatgtggtggaatctttctctctctcggaacgcacgcaagagttgtccccacgtgctccgcgtgcactggaaaggtgaagaagcctcagggaatgtggcgggtacagcggctcgactcacctgcttgccggcccgcgggtcccggggtagttggggacgttggggacgctacctgagtgggcaggtgagtggcggtggtgaccagtagaaggcaggcgactcttaggactgagaaactggaaccccatgttgggagggattaatatgcaaatttgccaaattgacggctactgttctcggtgtcaggattcagtttctgggatgttgggagttaggccacaaaaatgaaccatccccagaacccccaccccccctctccccctaccgccgctccgtcccacgtcacgtgcttttgcaaaatcccttgagtttcccaatgaattgaggactgggcaaccccttcactcccctcatctgcatatgtctcagaaacgccagtgacatcaaggatgatgtcgctgttctctacccttctactggtttccagccaaccagcgcacctgtcacctgctacctgggaggagatgtcactctttgtcaccttttcctgtaactcatttgcatagaaaaaactcagactcccagatccagaggagatgccacgcccttctctttagaagggttggcttgttgaacttttttgtttgcaggagagctggaatgctgaagacccagagaaaaaaaccattgaattatccaaaacccctaagtattcacctgtatcagacaggtggtaaagaatctgtaacaccctgtattagcctttagaacactcaaaccgtgggtcgcgaatccttttggagggtcgtcgaaggattttcagagtggttgcctaaagaccatcagaaaacacatatttacattatgattcataacaagcaagattacagttatgaaataatgaagataacttttcatcacagcacgaggaactgtattaaaggctggcaacattaacaggtagctggcaaaacccacaaaactttaaatgaagccattttgctctgtatcccatgtgctaagaaataaccggggaagggtgggtggtatacaccattactcttagcactctgaggcaggcagagctcaggtgaaatggggccagcttggcctacataggagtctattttaaaacaaaaagcaagctatccaaaagtctatatcatactaacaggaaaacatcatcattccccgaacaccacacatgaggcacactttattcctaaaagtaacaagagtgttgcctaaactgggtggtgatggctcacgcctttaatcccagcacttgggaagcagaggcagatggatttctgtgttcaaggtcagcctggtctacaaagttccaggacagccatggctacacagagaaaaccagtctcaaacaaacaaacaaacaacaataacaacaacaacaaagagtgatacctaaaaaggtatcaaatggagagctggctctacaccaagttagcaacatatttttgcttagttacaaccaaagagaaaatgtttggaactcaagtacaggcctttaaagctttttcagagggtgctactatgcattgtaattccctggtggacagagacctgggactcttgtacagttttctgacttagagcttcccagcagttacctgtatctgtgggtgaagagggtgctatacacggaagacttgctcttacaatcattttgtttctctctgtagtacaagagaatgtacaattaaaacgtttaataaaatgagaaagtagtaggccacgattctcctcctccatccttattctgcttttggtaaatcagaaaaccaggggagagagccaacatggtcccccacaacacaatgactcccgagtcttccgtgggtccaggtgtagaactagggtcctttccctttccttgacagtttctgtttggtttcactgcagctctggtcaaccctgccctgcagcagggctttgggtgagaccgagttaaatgtgggcatcaggaggaactctttggttctgtcacctgggcacctgttaacctgcagaagaggaacactgggtacttctagaggagcactgggtacttctagaggagcactgggtacttctggaggagcactgggtatttctagaggagtgctggaggtaactctaactgaaggttctcccactgctacctcccgatttccatctgtcttagggtttcctgatgtaaacagacaccgtgaccaaggcaactcttataaggaaaacatttaattggagctggcttcagaggtttagtccattatcataaagggggaaacatgggagcatccaagcaggcctggtgcaggaggagctgagagttctacatcttcgtctgaaagctgctagcagaatactggcttccagaaagttaggatgaaagtcttaaagcccacacccacagtgacacacctactccaacagggccacaccttctaatagcgcctcgccctgggttgagcatatataaaccatcacagcattcctctcacagtggggaagcaaactccagtcttaagattatttttatcgactgctacaaggaaagcaggctttgtaaagacgggaggagaggcaaggagagaggaaatcactggaactatcaagacttccttcccctttaacgagcagcatagcagaaacctaagaggtctctagcaagtcctccttggaacggagtgaataggttgtgcaggaaacaactgcagttattggaaggctttgaagtgcctaaaagtttctgttttaaaaaattatgccgggcgtggaggtgcacacctttgatcccagcacttgggaggcagaggcagaggcaggcagatctctgagttcgaggccagcctggtctacaaagtgagttccaggacagccaggactatacagagaaaccatgtctcgaaaaacaaaacaacaacaacaacaaaaaacccaaaaagtgcagcattaatatctgtgcaccagtacactgtgccccgactgcattttgaaaaaaattatttatttttatatgagtacattgtagctgtcttcaggaacaccagaagagggcaatggatgccatcaaaccaccatgtggttgctgggattttgaactcaggacctctggtagaacagtcagtgttcttagtcactcagccatctccccagtccctgaactgcactttgagtgatgtagcaatctccttctggtggaaacattctggggtggggtggggtggggtggggactccactggacacaaacagttctaaagggagtgaactccaggactctagctttcgagagctgtcttccctcgcccacattcctgtaaaatggacagacttatgggttctccaagtaggactttgatggtattctttctttggtctggtgaacttcacgggagacttttcagaaccaggagtttgaagtggcattggcatttttcttctaatgaatgaaacttcaaggtcatgacaggcagtagaaggaattctgtagaccatgtcctgaaactccttgagatacaaacctggcccagattgaggggtaagaggacttgggccttttcacagagtagcaggtaggagaatatttcctcctcagtactgggaaatacaaaggtgtcctgtggagatactgaggtacattgctgtgtgtcattcagtaaaatgagatggatggactttcatgttttctcaatgtgccatcataactgtcataactatattggtggctcagtggtagaagtctcacctcccatgcagaagaacagggttccagtccccaccagtgcagtagggtgtaatgttgtttgtttgattttggtgctagcaaaatatctaggaccaaatccatggatgtgaattgttattgaagtattgaagttattaatcacatattgttattcagatagaagaaaagaacttgtgtggtggggtgtgcctttaatcccagcatttgggaggcagaggcaggtagacctctgtgaatttaaggctatcctagactacataatgagttcaaagatagccagaactacactgtgataccctgtcgagggagggcagagagagagagagagagagaaacgtctctctggacactgccctctctgtggcctgtgatcgcacagtaatttccggcctgcgtggagacccagcagcctctgttcaggttctagcctcagccgctgacctctatgctcttggtacagttgtcatatcactgcaccattggggcaggacagagtgagaaaggacaccagttggcacaggcctggcaaacacaagaactgtgattggctttcctgtctgagtcaagtacagaaaacaacaaaacaaaagcaaaaacaaacaaaccaaaaaacccaagggctgtattagtctgtctcctgtggagcttaggtaatggaattgtttacagatcttttttgtttgtttgtttgtttttttccgagacagggcttctctatatagtccttgctgtcctggaactcactttttagaccaggctggcctcgaactcagagatctgcccgcctctgcctcccaagtgttgggattaaaggcgtgtgccaccccggcctggccagatctgttcttaatgtgtcacaattttgtctttctcttctacctcctcctcctctctcctcttctttttcctcctcctcctctctctcctcctccttctcttcttcctcctctccctccttctcctcctcctctttccccctctcctcctcttcacctttctcctcctcctcccccttcctcctcctccttttcctatttgcctgggcattgccagccaagtgtggcatgacctcacagttctcattccactgttccagtattttaagtaaatcctagttgatagaataaaattaaacacgatgactttcttcaattatttttcatgactgtgtgtggctgacaaatgagccatcacctgagtgaaaggacagagagagcgttgatctccatctgcccgcactgtgcaggtaacaggttagtcaccacccactccacatacacaaccaccgttctcatttctctttccttctctatccacccagtggtcaggtttaagcatcagtaaggtttctagaggggggatggtggcggcgggggaggggggaggggagggagaggggggcaggggcgttgttcatgtgagcagatttaggcctcttctcttgctcttgtccatcatctcctgggtggttttaaggatggctgggttttccacacagatggtactcagttagtttactagctacttttcccagccgttgctatgcaacatcccagaagagcagctgtagtgcgttaggagaccacctgccctgcaaagtaaacaactcacaaacctggggaacaatggccggcttttcttcccacctctagcttcttcctgtccaaactagagggaatgggatgtgcagcccctcagagaagggttgtgccatctgtgtcacacagatggggtgttgttgtgcacttgtttccaggacctatgtggatttgactacttctgaattgagcgtgctttgggcactggtaaagcacaaggaaggctcttcgaacaacgagtttgaactgaagctagcattttccttttaataggctgaaactccccgatcgtggccaggagacatagaaggaattctgcaggccatgctcggaaacttcttcagcagcaaatctgattcagactgagtcaggtgagaggacttggccctttcacagcctagcgtaggagggcatttccttatcaatcctagaaaatcctgaacaccgtgaagattcactgatttaccggattacttttcagtagaggcatggctctcttaccttttcctaaagtgttgtcacaaacctcatctacgggagcattggtagttcaatggtagaattctcgcctcccacgcgggtgacccgggttcgattcccggccaatgcagtacctctctgttttggcccccctctctgccttcagtgtactcttttgggaccaggacccaagtccatcttttccggctctttttggtaacaactacttgatttgcggtggcacaagcaggaaagtactgtcttatgtatcaaggaaaccagggacaaacttaagaatatcgaatattgctactacagctgctcagttatttgcaaggttttgtttccgttcagacaccttcccttgaggattttattctcatggcaagagatagcttcacaccaatattctaggccaggaaaagatatgatgggcaggcagaaggtgttcagggaagaatgacagccgaaagtttctgcctggctgctttagactgtaactgagttatgtggtgacttctggctggaagatagaagggagtgactttcaggtttgttggggcattccgcagtcaggcaggaggatctctgtgaattcctggtcagcctaacttatataaggaggaggtcagcctaatttatatagcgatctctagcccagctatataaatagtgagaccctgtcttaaaaaaaaaaaaaaaaaagaaaaagaaaaaaagaaaaagaaaaaaaaaaaagcaatcaaaaaacggttttcacccctagggatcctgcctgaggtttctcagtatcgctgcactgcagcatttgagtaagaagtcaggtttccaacgactcaccagcgaacattccttttgtgggaagaccactgcttacttaatttgaggcttctgcgaagactaggtttcatcaagaaattctctaataaggagcaaaagagacggctcagaatgagagctcttcgaagaatccaggtgtgactcccaacaaccacacaagaactgtcttccgatctttgctcccggtgggtccgcgcagcgtcccaaacagaggcaggggagataaacaaaacccttacaaactcttaccaatgatttccctcttgggtattttttggtaacaaattataaggaaaaagtgcgaacgcagctctaaataatacaaagtcagggaaccgatttcctcgcttttgtggaagttgcaggaatcagcacatcccagatgcaataaatgagtctcttcctagaagatccccaccccccaccgtataacagtgttttcccgccgagtacttatgtttttgtttttgttttttttaccttcagcctctttagccccgcgctctgaacgcaccgccactttacaatgcacgctggagagcctaaccggacacgcttttacgttgttcctctgctccgccccgcgagacctgcgctctctcccacgccgtgaaattccccgcgattccaaagcgggcacggacaccgaagccctaagcaccctttatgtacatagatcactccccactctaacaccacagacagctcaggttctcaagaaaacacccggcttctggacctgccctcctgctgtcaattagcatttcatttccctctgtaggcttattaacattaaccggtttcaaaactgctttaccgtttgctgttcctacagctgtgtttaaatgaaattctcctgcctcttaggtgaattcttcattgcaccttgtttcttccatgtctcaagggacccagaagggcagcgaaattcacctagaaaggagacagcaggagactggagagagatatggcttggctgttaagaatgttgccagagatggaggcaatggctaagcaataaccaacccaacttgagacccatcccatgggcatgcaccaatctcagacactactaatgatactctgttatattcgcagtcagcctagcataactgtcctctgagaggttccacacagcagcggactgaaacagatgcagagacccagagccagacattgggtggagctgggggagtcttgtggaagagatggggggaggattgaagcccacaaagtggataggattccactacagtcaactaacctggacccttggctctccgagactgaaccaccagccaaagagagtacacgggctgaactgaatcgtccccacaacccccacatatgtagcaaagtctctatgtggatcccccaacaactggagtgggggctatcgctaaatctgttgtctgtctgtggaatgttctcctaactggcctgctttgtctggcctgcgtgggagaggatgtgcctcgtcctgaagagacttgatgtgccaggttgggggatagggagggggctccaccctctcggaggcagagattgggatataaagtgaacaaaaaaatattgttttaaaggttgaagaagactccagttctgctcccagtgcccaggtgactcacaaccatctgtaaatcctactccacaaatctctttcgaggtgtgattggttcttaggcatctctaagacacatgctgaccccataactattcttttctgcccatccctcgtccatatccatatcgcacttttctgtaagtgcattgagaaagtctcatctgcagctaaagatttaaaaatcttattcagaacattaaaattctggaaaaaaattttcctccccacaattattggttccagagctccagagtctcactttctagacacataaactcaacccactcctgctcacctctacagacttcgtttttaaagctgtgggcctctggggagctgccagtaactgaggagaaggggaaactcgcagcattctaacaggacgcttcagacttgaggggaacctcagagactggggtgggaccttaaataagtcattgaggttttctatacctaaatttctgcattttgaagcaggctaggaggggggggttcttcatgggctgccccccaaattaaatggctccttgtatttactttctgtgatcaaatatctgagatggctcagcggttaagagcactgaccttcttccagagatcctgagttcaaatcccagcaaccacatggtgactcacaaccatctgtaatgagatctgatgccctcttctggtgtgtctaaagacagctacagcgtagttacatataataataaatctttggaccggagggagtggggccagagcgagcagaggtcgagttcaattcccaacaacgacatggtggttcacaaccatcagtacagctacagtgtactcatatacataaaataaatcaatctctgaaaaaaaatctgagaacagcaatttaaagaaggtagggcttaatttggttcataatttgagggtatagtttgtcactgtgggacatgcatagtagcaggaccatatggcatccagtgaagccattacaagcgtgaagagacaactagcaattttctcttctgtattcaattgagacccttgctgacagcttggtctgcctacatttaggatggctcttctctcctcagttaagcctttctgctaatacattcatagacacacctagagattgtatccatggtgatttttaacacatatcttgacacaccagtcaagataaaagtgaacattaatcaacacataaatattggaacgggttttctatttatttacttacttgtttttatttaaatttttttatttaattttgtttaattttttgagacagggtttctctgcatagccctaactgttctagaatgctagcctcaacatcacctcccttttcctccagaggattgggactaaagttaggtaccaccaccccacactcagctataacagggttccttacatagagtaatagtgtagaactggtgctagggaactgtagagatggtttctgctatttgagaagatcacactcacataacagctctaactctagtatccagaagatccactaccctattctggccatccagagtatcagccacacactcgtggtttcccgacatacatgccatcgagacacctttacacataacttctttaaaacaaaacaaaacaaaacaaaacaaaacaaaaacttgtctgaaacaccggttccatcaccagtaccagcccttcaaaaattgcatgttctttgtgttgtgagtggagtagtatatatttaaaattttcctaattcatgcacatgaactggattctctatataggatatttatataataatataacaaggctatattacacatataataagaattaattctaaaaagcaatttcaaggtcaaagtacttgcttatttttatgtctggtaatttttactgaattatcctgaaacgaggaaaaaaacaagacatttaaaaaagaaaacaaaatatgtctagaggtacatggccaacaacgtgcgtgtttgtcgcctgggaattgctatttatttggaaactttgagttgacagtttcaactttgagttgtcaaccttgaaactgacttttccaggacagctcacaaaccttgaaggattcttgtggtcaaaagccttccctgaccgggaatcgaacccgggccgcggcggtgaaagcgccgaatcctagccactagaccaccagggacggacagaacataaggtgaacctgggttgtaatcgcacttaaggtgaactcgggtcggaatcgtaaaagtgccgaatcctagtcacaagactaccagggaataacagaatttgaatggcatgtcatgtagtagggtatttaccaataaatgccggcaggaccagaaactgaagactagcaggtatcaagtgtgctcacatccaccccccagcgtcctacagcctctgttccacctctcatgtttcccggggccaggtggtgcactgggctctgaggccaggccataaggaaactcacctggattccagaccagtctagccttgtgcagaaacactttttcgggttcgtggtggtttaagtgaggacaggtctcagtgtgtgtcgagcatccttttccaggtcccttacatgataattggctcaagggagcaattggcatgctggttccgtttcttccccgaccatctcgagcatcctaacggtctttcgagaggaagacttagcaggaagacttagtggagacttgcctgactagatgctgtgctctgcagctgtgcttagggaaggaggaaagcaaatggctttcaggaaaaacaaacaaaaaaacgaaaacaagcaaaaaagaaaaacaaaacctttctggtttttagacactaaacactgtcaacctgtagagatttcggaagacgaaagttgcagattcccggatctaatgctaagggaagttagcttgcctctgcgccccaatgctcaacccagtctcagcaggggatggaggtcaatcctggtgttcacagggctgcctgcggtgggtgggggactcctaggcattccctttccacctctgcctcaaatacagccacctaggttctgtcatttttgcctccacttcaccctctttcccctatgtctccttattttgaacatagtcctcaaccaacctccgagtgctgagatccccttcattcagttcctcatgcggtggtgacccccacccataaaattattatcattgctacttcgcaactgtaactttactactgtataaattgtgatgtaaatatatgtgttttaggaaagcaaacatgtcccctttcagggatcttacaaatgttagcaatgatgctgatgaggccgggagaaaaagcttacaccatgccttgaagattcatccatgacactaagttgcaccctgggtagcggtggcttctgacggagtcaaagtgtcactgtggttgcagtccttcaggcagtgccaacgtgcttaatagtgcaagagtgtgccagagactgacaattactctggaccaggagaccgcatctccaggaagaggacaaagcattatcggcagggagctcagaccagcagcctggtgggatgggcattt

SEQ ID NO: 299 - DNA, 110006 bp, Mus musculus
cacatttattttatgtatttcttacttttgaatttaaagtacaacatctgtcacttgagcaggaatttatggtctgtttctggtagaaatgacaacaatactcagcctgtatgtcacaggtaagaatcatgaagtgacatactttgaaaaatgtcctcattactccctgaaaattcatgtattcctatgcccattttttaattacacacttgatgctgtctgtctacaaatgcccagggcatcaagttatacatattataaatttatgacagcaatgtatttttccctgcatctccaatttctgttttacagaaattcctgttgtcagtaaattttccatcacatggattagggattatactcatttcatgcatattacaattgttagaatattcacagagaaacattctggtagaggatttgcattatctggtttctttggtattgcagatattacagagctcctagagtttactctaatctgtgctctctaaatcccctagtgcttgtgttttcaggtgaatggccttcgcacatgaagtatcccagagtgcttacacagttaccatctcttctttccctgtctcatcccttgttattcatgttttcatcctttccttgtgtttcatgtatgttctgaggaaggttttagatgggtatccatgctgtcatatattcataattccatattccatgataaatgaccccatgggtttccataactccacttcctccttcttttacagtcttgcctttacctcactgctagttttttattcagctttctctgaattggcagtttccctttatttacaaaccatgtttgtctgacttaggctgaaagccccaacaatttaaatgtatttccgtatttctacatatagcagtatgtcagttataaattcacttttcagactgtgatctttagagcaacttttgaccagcttccagtgccatgtctgtatttcctttgtaggttgacctcagttcaaaccagtaaagtttctgtttcctacctgtcactactgcaccggtcgacatacattgataggttggtattacagtacaaagatcagcatctagggagaatcattaatgacaatttacacccatcaaccaacagagcccctttttagcagtttgtatgctaaaccagcatatccaagatccttttagacactgagtgctcttctcagttatcagattattctttaggaatgtataaaaccaaatcatttttttatttttcttgtattattctatagcgtgttgagtattttatcagattggattattctcttgggatacttgcaggtcttgagttgaagaattatgtttcttgtaatttgagaaaacttgttttcctcatatccttatttgaacattgaaaatattctaagtctttcttgctctttgtaagcactgctgtactgtgataccttagtgtggaagctttgcacatccttgtctgtcttctgagtagagtagaatgatgacagctgtcttcagtttgtatagtaataggcttaggatgttggctattatcctcattagactcagtaatgttccttctgttccaaattcttcagagctttcatagtgatccactgtgaaattttgccctaggcctttcatagatatattgatatatatctatcagtgagatttctcccactgattatacataatttatgccttgagttgtttggtttgtgcttgttgaaacagttttgagtcactgtcatgaaatcaagttgagtttactttctgcatctattagagagaaacttttttaaagttaccctggtgcacccatactgttattattttctgtgtgcatgtttttgtggtcatttgcttttggacccaggtaaggtcagctttgtgtgatgactgtaccatattcccctactttctgtattatgcactgttttctgtgcaagttttttgtgggttttttcagaagaaattcgtgactttggtgcagcatttgattattcctgagaaagtgctagaaggaacactgagagcctgggtttctgcacttgattattcctggcctagtgtttattgttcctaggaaatcaatatttccctttttcccattgtcaatctatacttctgaggctggggcattgaaagagatcattcatatacctgttaaatgccaagagaaatatttgacatgagagaaatataaggtcaatgaaatacataaaaagcactgaatatttgctgatatcatggtcatgacatgatttcttcagtaatagtatctccatgttcagaaggaattcttatgttttcatttatgcataaacatatgtatgtatttgtgtatatatgtttgtatgtgtattggtatgtatgccaggagaccattatcacatattctttcatgtgaacctacaagagtggtagccagagatgaaatctgtaacagctaagctctaatgaatgtcattgtattcatatttattactgattgggaacctgagaactgcctggagcaatgccacaatgcagatacatgcttgttgaggaagatgttccaactgtgattgtatttaacagatttgatataatgagggaatcattccaagggcattaccctcaaatgactcattttgtgtatgtgtatatatatattctccctggcagccaccagtgagtttctaccatttctccttcttgattttgtatgtcaatacattttatgcaatatgctctcagtataaaatatattcatagtaacactactcataaaattgcatatagaagttgtatacaagtcaagtgtcatttttacactaaagacacttaacttgattttttaaataaaatttctaaaattttctctgcaccccaacccatccattctcctcaccgctccaagaggatacccccacacctcaccattccaccaggcctccccaatccctggcacttcaagtctctggagggttaggtgtatcttctttcactgaagtcagaccaggcagtcatccactgtttatttgtcatggtcatcatgtcagctgctgtatgttgcctggttgttggtcccttttctgagagatcttggggggtccagttcagttgagactgctggcatattgatggggccaccctcctcctcagctgcttctggcttttccccaattcaaccacaggggtcattggcttccatccattgggtgggtgctagaatctgcatctgactcagttgcttgttagacttcttagagggcagccatgccaggctcctgtcacaccacagtatcagtgtcagggccctgtgcctccccttccttgatctgaatcctaatttgggcctgtccatggacatcctttctctcatgttcttctcaagttttgtccctgcagttccttcaaatagggacaattctggatcaaagactatgcgtataggacagcaactccacttgatacctgtccctccactggaggtggactctacaagttcccccttgcctctccctttgagtcctgggagtctctcacctcctaggtctttagaacctgtgagatggacctcgatagcctacatcctgaggctgtctatttccatttctttctactgggcctcagggtttcaggtccccccccccaatccctcacaatgactgatcatgtttccccttcccctctatgtccctgctcccactcaggtcctttcttcctttttcccccatgactgctttcttctctttaccaagtgggatcgatatgtcttcacttggaaccttgaggtttttaaccttctttagtcatttaggttgtattatatacatttttttttggctgatatccatttattagtgagtacacactatgcatgtcctttcggatctgagttacctcacctaggatggaatttgctagttcagtccatttgcctgcaaagctcatgatgtcattgttctcaagagatgaataatattccattgtgaaaatgaaccatatttctgtatcagttcgcccattgtggggtatctggtttgtttccagcctctggttatcacaaacaagacaactctgaacatagtggaacacaagcccctgtgtcatggtggggcatcttttgtgtatatgcccaagagtggtatagctgggatttcaggtatatctatttccaattttctgaggaagctccagattgatttccagaatggttttaccagtttttgtgggaagccacatgtgccgttgctgagtggcactgactactgctggccaccacgcataagattggacaaacaaccaatgtgtacatatgcagtaaagttttttgcaaagacacggcctggcccaggcatgataatgaggttcagtaaggtactgagagtataaccaatcagatgtgagacatgcaaatgaggtatgataatgaggttctgtaaggtactgagagagagtagccaatcagatgaggaacatgcaaatgaggcttagtgcataaccaatccgggtgtgagacacgcccctcctaggcctataaaagcagcaccagttctgggctcgaagtcttttcgcctctataatcaagctctcccaataaacgtgtgcagaaggatcctgttgcagcgtcgttcttcctggccagtcaagcgcgcgcaagaagttttcaattccacaagcaatggaggagtggtcctctttctccacattttggccagcatgtgctgtcacctgagtatcttagccattctgattggtgtaaggtggaatctcagtgttgctttgatttatatttcctgatctctaaggacttggaacatttcttttgaagtttctcagccttccacagttgctccattgtgaattctctgtttaggtatctaccccattttttgattgggttatttggtttcttggtggttagcttcttgtatcttttctatatagtggatattagccctctatcaagtgtggggatagggaagattttttttcccaatctgtaggttaccactttgtcctatttactatgtcctttgccttacaaaattttctagtttcatgaggtcccatttgtcaattcctgaccttagagcctgagccattggagttttatttttaggaaatttcccactgtgacagcaactttgaggctgtttcccactttatcttctatttcctggattgtgtctttttttatgttgaggtccttgatccacttcaacttgagctttgtgcaaggtgtccaatgtggatctattttcatttttctacatgcagactgccagttagaccagcactggttattgaagatgttttcttttttctgttttcgagtgactcattttcatgcttgtaagccctcatgtacataattatgtgaaaatgtctttcacaaccagtgtcccactgccaaatttctcaaaatatctttctcacctcacttatgtgcaagtgtctttcctgactgtgctggcacttaccctggcactctaagaaggtagccttcatgctccatgaatcctgtcccaatatttattgatttatgtttccacggcagctaattgagaatcaaagatgtggctctccagttaagggcacttcttgcactatgcaggtccagaatatcttttaccattgtcgtggtgctatagcttctgcatttctgaagtctacagagctacatgcagtcaaagatcatgttccctaaaaaattgaaataaataaactttatttaaaaattaaaaatgatctggaagtgttgtgtaggacacaagaaacagtacaggaaagagagtgagaggaaatgtgaggcctggatatgttaaaggacagctgacccttcatatcaatattttaccaattaggaaggatccctatgtatgataaaactattttgtatccatggaacccagagctggagactcttatgtgttcattgtaatgtgagaaaagaagatttatcctattgatgaagtatttaggtattcacttttatgaggaggcaccctaattgtgaaggaatttataacacatgaaaatgctgttatctagcattccatcaaccaagaaatctgctccagaaggaaaatgggttgtatcagattccaccattttcttaatgtaaggtataagcatgagactcagatcttaatcctcaccactgatgttcccacactataaaatagttcatggttattaaacaagaatcattcatgactaatataaattgggttatatgttacatgtttagagatggatgaaatttgaagagaagttgttgctcttgcaaaggaacaggattagattgttagcaccacatcacgttccataaccacctagacttccagtttgtgggaatctgacctcctcttctgaggtccactgagagaaagcatgcaagcgtggcacactcatacacatacaggaagaacattcataaataagactaaacaaaataaaataaaatgaacaatttaatattaaaattgtctaaaagccgtctagaagaatagtatgacatgcttctgcatgtgtatgggaaggtctttccacaaggcatagggaattgaagaattgtttagcctaatcagttaagagtccatgtgttaactcataatgaatctgcttgatggaagcttgtaaagaaagcaggaagcagatctaagagaggatatagtcacagggacaagcttaaaagcatgttctttggtgctataaggtcctgaacactaatttctctctggcactcagtagctggattgtcctatacatccaacaatgatttagcattcacatgaagttttaagcagatttttatgagctgaattgtaacattctaccttttaaatagcccaggtaagtttcaattgataagtgacctcacaccaagttttgcatgcaagtaaagcagtaacaagtccatcttgaaggaggagtaagttagaaagctacacttttcttctcaacagtgtgcactagacactgatatgagtggttataagtaaatatgatgacaagtttatcatattgaagaaatccatgtgtcttagtcagggtttctattcctgcacaaacatcatgaccaagaagcaagttagggaggaaagggtttattcggcttacacttccatactgctgttcatcaccaaaggaagtcaggactggaactcaatgaggtcagaaagcaggagctgatgcagaggccatggagggatgttctttaatgacttgcctcccctggcttgctcagcctgctctcttatagaacccaagactaccagcccagagatggtcccacccacaaggggccattcccccttgatcactaattgagaaaatgccttacagttggatctcatggaggcatttcctcaactgaagctcctttctctgtgataactccagctgtgtcaagttgacacaaaactagccagtacaattgaccccttgtcaacttgacacacaaaaacatcactagtaagcctcaacccttacaatcttattcatctccaaggtctaaataactttaaacatcccacagcctttacatattcttaaaatttcaatctctttaaaatatccatctcttttaaaatccaaagtctttttacaattaaaagtctcttaactgtgggctccactaaaatagtttcttccttcaagagggaaaatatcagggcacagtcacaatcaaaagcaaaaataaatgtccaaccttccagtgtctgggatccaactcacaatcttctgggctcctccaagggcttgggtcacttctccagccatgccctttgtagtacacgcgtcgtcctctaggctccagatgcctgtactccactgctgctgctgctcttggtggtcatctcatggtactggcatctccaaaacactgcatgacccctttagtcctgggccttcaattgcaactgcggctgcaccttcaccaatggccttccatggcctctcacagagtcgagccttagctgctcttcgtgaccccttcatgccttcaaaaccagtaccacctgggtgacccttacatattaccaagtcccgctgcagcaggagtacaaccttggctatctctggaacacagcctctttgtgctttcagaaaacacttcccagaagatgtcacctcaatgatgctggtctcttcttaatcactgctaatttcttagctccagctaaccagcatcaatagtcccagtaatgcaaagtttttgctttagtagttctggtatcttgttaatcacaactgattcttcagccccagctaaccaaaattacagaatcttcacaatcaaaacagcaatggccctgaaaagagtctttaattttccctctgaaatttcacaaaccagacctccatcttctgcagtgttctcaacattatcttccaagctcctacacagcatctgacagagctcttaacaacaaatggatcttcaagcccaaagttccaaagtccttccacagtcctccccaaaacatggtcaggttgtcacaggaataccccacttttggtaccaacttctgtattagtcagggttctctagagtcacagaacttatggatagtctctagatagtaaaggaatttattgatgacttacagtcggcagcccaattcccaacaattgttcagtcgcagctgtgaatggaagtccaaggatctagtagttactcagtctcacacagcaagcaggtgaaggagcaagagctagattcccttcttccaatgtccttatattgtctctagcagaaggtgtagcccagattaaaggtgtgttccttaaactcggagattcaatcttctggaatccatagccactatggctcaagatctccaaaccaagatccagataaggatctccaagcctccagataagggtcactggtgagccttccaattctggattgtagttcattccaaatatagtcaagttgacaaccaggaatagcaactacaccatgatatttgccatttagattgagccattgcctgaggtggttttctgtaaaaaagtacaacacacttaataaatacatgtactgtttctgcaggtcaaatgaaataaggtgaattctaaacatgttctatgaggtagaaatgctcccagcaattttcagacaggctttaagcattctgattgctatctctatgttgtatcatgtggtttatatcagtaagaattttctatagatattaatgggatactgtgctgaagactcctattcaaaagcattaaggaatatcccatttaatgactttgctcttttattttggagttataaggctctcctactccatgtttttccccttcctgtagctatggttcatgtaggttgagattctgaagagcaatcatggtggacagatgcagagaagctgccttgggtgggaaagggtcctaaggagctaatgggagtggtggagaatgacttgttgttaatgatggatgcaagctgacagttctgtactctgtggcgacaagtctctaaatagctctttgcatatgaaaactcctttgcataagctacttccttaggaattacaaatcattacaatcatttactccaggttctctcttgattattctgagtcagcattttaaaaccttagaacctttactcctagaaaaaacaacaatacaaaaacagaagtacatttgtttttgtttgtttgctttgttttgttcttaagcatagcagctcctatgtatgttgcttggatgcactttctgggcatagagattattttattattactcttttcttttctttctctttcttccttccttccttcctttcattttttccacactctagattttattgccctcctggtccatcctctaattattccacatcccacacttcctgcccacctctctgtctccataaggatttcccctcctcctccccacctggccagacctctaaccaccctggaacctccaatctctccaggggttagatgcatgctccctgattgaacccagacccagcattcttccactgcatatgtgctaggggcctcttatcagcaggtgcatgcttcctggttgatgatcgagtgtctgagaggtcttgggggttcaggttaattgagactgctggtcctcctacagggtgcccttcttcctcagcttcttccagctttcccctaactcaaccacaggggtcaggagcttctgtccatttgttcggtgcaaatatctgtatccagctgctcttgggtgtttcagaagacagtctttgtgattgctccatagcctcagtaataatgttaggcctaggggcctccccttgaaaggttacagggttgggagggaatcataatctgatattgggtgggggaagaggactgaagccctgagggccagcagaaagaatggaaacaggcaactttgggcctgtttagcaactttgggatcctactttggacctgttattggaccttcttttcctcaggctcttctccatttccatcagtgtaattctttcagtcaaaattatggatcagaattttgactggggttgcaaccctatccctcactcaatgccctgtttctctgctggagatgggctccaaaagttctttctcgcctctgaagggcatttaatctagggtctctccttttgggtttcttgagtatctcagctcctcttcccccacccaatatcagattatgattccccccaaccctgtcacttttctctcccatgtcagtcccttcctccctcctcactttggctctttatcttgttgacctgtttgagttctgtgggctgtatcttgggtattctggactttttttttatgactaatatccacttattagtgaatatatgccatgcatgtccttttgggtctgagttacctcactcaggatgataatgtctagttccatccattcgcctaaaaaacttaggatgtcctcattcttaatagctgagtaatattccattgtgtaaatgaaccacagtttctgtatccatccttttgtcatgggacatatgggttgtttccagcttctggctatcacagataaggccactatgagtatagtggagcacatgccccatgacatgttggggcatctttttggtatattcccaaggatggtattgccggggcatcagatctatttatttccaattttctgaggaaactccacattgatttctagagtggttgtacaggtttgcaatcccagcagcaatggaggagtgttcttctttctctgcatcctctccaacatgtgttgtcaccagaggttttgatcttagccattctgtttgcaataaggtggaatctcagggtcattttgatttacatttcttttatcactaaggactttgaacatttctttaagtggttttcagccattggggtgtccttagttgtgaattctcagtttactcaccattttttcattgggttgtctgggtttttttggtggttatcctcttaagttcttaatatattttggatattagccctctattgcatatggagttagtgatggttttttcccaatctgtaggttgttgatttgtcttattgactatgccgtttaccttaaagaagctttctagtcaggaggtcccatttatcaactcttttttgttgttgttgttggttttttttgttttgtttttgttttttcgagacagggtttctctgtatagccccggctgtcctggaactcactttgtagacaaggctggcctcgaacccagaaatccgtctgtctctgtctcccaagtgctgggattaaaggcatacaccaccaccgccccgctcaattcttgatcttagagcatgagacatttgagttctgtttaggaaatatcccctggtgcctgatgagttcaaggctttttcccactttctcttcttttaggttgtgtgtatttgattttatgttcaggtccttgatcaacttagccttgggctttgtgcaaggtgacaaatatgggtctatttccatttttctacatacagacagccaaattagactagcaccacttattgaagatgcttcctttttttccattgtatatttttggcttctttgtcaaaaatcacgtgtgtgtaagtgtgtggttttatttctgggtcttcaattccatttcattgatcaacttgtctgcctgtgtaccaataccttgctgtttttatcactatagctgtgaagacagagttagactgtgtttcctttcaggaatagcaaatgccatttacccctgagtcatctcttctttccagggatttacacttctggtacacttttatgatagagcctgaatataatcctgagttctgttttataaaaattgagtgaagaatcctaaatgatacttatatgtacaaccgctaaccatgttagatggatgagctcaaataattaagaaaagaacaggagggcccccagtggaggagctagagaaagtacccaaggagctaaagggatctgcaaacctataggtggaacaacaatatgaactaaccagtacttctggagctcgtgtctctagctgcatatgtatcagaagatggcctagttggccttcattgggaagagaggccccttggtcttgcaaactttatatgccgcagtatgggggaatgccagggccaagaagtgggagtggatgggtaggggagtggggggctctcagggacttttggcatagcatttgaaatttaaattaagaaaatttgaaatgtaaattaagaaaatacctaatttaaaacaataaaataaaataaaaaaagaaaagaataggaatgaagtaaaagaaccttagatgattccttttttgtgtaatctataatcatgttagatcaatgacctcaaataataaagagaagaacattgctgaagtcaaaagtttcatatttttagttgtggcagtaatagacacatgagtaataatgtatccataaaaaatgaagtgttagtatgattcttatacatcttaatatggttatttccattataaaaatcattttactttatcacttttttcacatatgtcatttagttatacatgtatgtctaagcattctgaagggaaaccactgtgtaaattatgaaattattatctgtattgattttgtcatatagtcacaaacattacattatattaatgctacctattgctaactttttatttttatcattaaatattctcaaattaattcttcattaaataatcatttaactcttcttcatataaaattcttataaaatcatatcacaagattgtatgtcttgtttgtaattttgtttgtatacactgactttacacttcctaactgctacaatagaaagaaacgtatttcttttaagtcattcttgtatttggtgttctaactctctttctttcttctagaaaggatgctccattgtatataggtcttacaatccaaactgagcatcttagagtagctgttgacacccaacttcagataagagagatacagggtttctgtctgagcaaaactgacagttgtagaatttggaagcacagttttactcaccatcactttactatctgtaaactagatgtaacactggaattgttctttttatcaaaaaatgttcataaacgtatattcctggatgtagacctcatatatatacattacaatgtctaaattatgctgtgagtctgagtccattaactcatctaccttttactgagagaagacaacacaattatgactatgataattttagatgataccatttcttaaaacggcctcatagttcccatgacctaacatacttcctgttcttgattaggattcagaatatgacatgaattctctctctgaaaggcagccttaaatccaatcagaatatgttttactgtaattggttttttttctgctgctttcataaagcaccatgttcaaggaaactaatagaagaaaaagactactttgggtaatgcttccagaggatagccatcaaccatgacagggaggactgatagaacattgccatgttgttgaagtagaaaggtgaaagatcacatcttcaaccccagtcactaaagaggaagaaagaattaagatggcttggatctatctatccttttttctcatagtcaacccccagtgtcatactttattcagtaatgttccaacagctaaattcctcaaacgattgtgacccactgaggacccaactttaaaagataaaagtattatccaataggagaatcagccttctaatatccttgtactttttaaattgattttgatatcaatgtagaagacaaagctctaatttttttgtatgggtttcctgtttgtttgtttgtgtgtttgtttgtttgtaaaacagggtcccacactctatttctaactttcacatgtcctgatatagagaccagaatggcttttaggtcacatccctgacagctaggatgaaagacctttcattgatgagctgattttttgtttgtttgtttgtttgattgtttgtttgaatggtgtatcttcacatattggccattgagttaccaccaggcttacagaatttatttcagagtgagcattccttagatttttatatctctggataagatgttcacatcctgcatatgtataattattctcttacccacttgtaggaattctctggaatttcattaagtttgtttctgccttctttgaattcctgtgcttgttccctctttatgtcatttgtccacattgaatggtgttcagattatattttgagtttgtttcataattcattttgtcatgagaattggtattgcattagtgatttggggtagggaaattttattaacattgtcaaattgctttagctacagcctctcaattttcttttgctgtgtgtcatttaggtcaggtgacagggatttccatatcaggtgttgtgaataaactttgagaatctagggtggtgggaggaactaggttacacttacagtctaaatatatcattacttactttcatgactgcacattttcaagattcctggtatcattttgcttttaatgtttatatatatataaatgttgtttaccattgtctgtaatggtgttgtatttatttcatctctgaatcattcagaccttgatgtgaaatttcaagaagaattcaaactttgctcttcacagagaccctgggagaaggacaacaacaagaatgagtgtgtctctggtaaatacaccacaggtcagtgtcctttccacatttcttttttaaaaaatctctttttattcaagtcatccaaaacttttaatctctctatgtggaatggtatctaaagggcttattttctatgatctatatcttttttaataatgagaatttaaaatttttccctttcatgcatatactggctttatattttatcttgatttttatattgtgaggatatataattcccttggaatagagacctgcatgtctcaaataggatctattagaatgatgctcaaagaatagattgatggacattttctatgttgaataagttctgtccctttgtattagtgtgaagtaaggtctcttgtgccacatgaattgcatttcagggatggtcaggtttctaaacacaagcttgtgaatgagggtatagaaataagtataaattcacatcactaaagaacatatgaaagagtagaatttgtagaaggtaaaattataagagatccactgtcttgaatcctaatagtaaatgtattattagctccctagggtcacagataatggaaggaaaatgtctttcttaccattagtgtgattgtgagctgatacagatttcaatattctgacacttttatcacacctcatgtcacacagtaatcaatgttgacacctgaaatctttttatctcgagagacactgtccctgtggaaaattcacaatatatagatatttatccctccttttggtttcagaaataattttaagtcctgttttcttcacctttgtatttcatcacatgaactatattagtaaaatttttctagagaggatagctatggtgctgtgcataaaccatcaattttcgaaaataaatgaatgtcctttcttatttttttgtctttttctttagaagggaaaggcttgaatcagtctatgctaatcctcttcagtcaagctgtgcattacatagggaaaactgaagggttgtggcaatgtttctatttttcattacgatactattttctttacgtacataagtgtatatctgaaggtttttacgtacactgaatgatacattatgcccctaaaaccatgagtacagcaccaaaccctgagactgaattcagacataatagtgagctgcaatatatttagagagaattagattagtttttaaagtagaaacagcaagtacctttaccctttaatcatttgttcatggagcaggtttacattttttgaggcatatttgcaataaagacagtatatagtctgtatattataatttttgataaacaaaggaagaatgatagatcacacttctctatgaaaagtgcaattgtgatatacatatggtcaaattctgaagaaaaaagttaaaattagaatactgaaattttcagttaggttaatacaatgaggaataatttattagattttaatgaatatttagtataattctccctcaatttaaaaacacagtttgatcaaaaattattatacttcattggaatgcattgccacatatgatatttgcttaaacatacatagctaatcattttatagtgaaagaccatatggtattagagaaattgttattaagcatatttatttatgtctccacaggagctaattaagagtcaaagatgtggctctgcagttaagctctcttcttcttgcagtattcagattcagttttctgtacctgcctggggacttcttttccttccagaactcttttttttcgagattatcttttaccattgcctgcgtttctcatgtgcacagagctacatgccagcaaaaataacattccatatgaaattaaagtcaataaacattatttaaaaattataaatgatctggaaatattacacaggacacaagaaaccatctaggaaagagaatgagaggaaatgtgaagcctgaatgagtttcaggacagctgacccctcatatcaacattttaacaattaggaatgattcctatgtatgataaaaatgtgttgtattcgtggaacccagagctggagactcttatgtgttcattgtaatgtaggaaaagatttatcccatcaatgctgtttttgtgtcaatttttatgaggaggcaccgtaattgtgaaggaatttattatacaggaatacattgttatccagcatcccatcaaccaagaaatctgctccagaaggaaagtgaattttatcagattccaccattttttttaatattttatttatttattatatgtaagtgcactgtagctgtcttcagaaactccagaagaaggcatcagatttcgttatggatggttgtgagccaccatgtggttaaataattttaaagctctcttaaactgtttatttctattttatggttttgaatacattctcataaataatttccaaaagcatttgattttctgtgtcatatggaatgttcagtgtatgatgccctgatgttgcagttctaatgtgtttaaagaaaaaacttagtcatttagtccatccattatttctgcatttagtattctaccagtttcttctagaacgtgtgtagcattgaacgtaggcctcagattgtcaaatggacatgttgttatacagacgtgagacacagctgcacataagactaagctagtgtccatacttgaacaaagtggacattgtaaaatttgaaagcatattttttatcataactttactatctttaatgggtcagtgggattctgtttgatatcaacccatatttcataaaggtacattactgcatctagacatcaaaagtacatgttatattctataaatgtttactgcttttgaaattacatcatgcattctcagtgaaaaagaaatataaggaagtctattagtagtttagaaagtttctttgaataaagtcaaagttcatttttcttcaatatatgttgcttacatttgcctgtatgcctatgtgctatgtattcttttccttttttttttatttagagagcctttctaaatgtgagcattatagtaagtcattctatagattgacagtggaagagcagcaattcgtatcttcagacacatctcaatcacactttcagaaaacatttatccttaaatattttccttcctcatttacatcaaaaaaaggatatctttttgttgttgttcttgtttgttgttgttgttgttgttgttttcaagacaggatttctctgtgcagccctggctgtcctatcctggaactcactctgtagaccaggcctggaactcagaaatccgcctgcctctccctcccaagtgctgggattaaaggcattcgccaccacgcccagcaaaaaaggatatcttaattacttctttttttaaagtagaaaattatttttgtccagtatcaagtaggtagttttccattccagggtctgttaaccttcaaggatgtggccttgtacttctcactggaggaatgggaatgtctcagttttgctcagaggacactgtacaaggatgtaatgttggagaattacaacaatcttttgttcgtgggtaagaatgaacttcttgttgaattcctgtttctttctttcagttttcctactatatgtttatgtaaattctctgagatatccagagacccctgaatgcgggaaattctagttaaaatcataacttgttcattgtgtttccattacatttctctgctttctttggaaaagtaaccagtgctatattctctgagatcactccttatctcttatctagcttcagtgaagttaaaaaagttcaagtaaaaatttaaatatctagaacaagaaattacatttctatacatataatagttggaattgtaaaaatcttactattgctttaaaatgttcccttatttatgaatctaaaaatatacaaggtttcaagtggatatagagctgttggtttgggcaatttttttttatttaactttttgacatttgatctctgtgtttagatctgggacaacataatcattatcctagcattttagatgttgaaacaaatctatttagtgatttccctgacactatcggttatatcataaatttatacttgaccaaatttatacctgattcagtgtcactctgaattgaactgtaaccatagaattagagatctattgcttagagttttactttcgggaaattcactacagatggatccttatttgtcccagcttatgcaaagtacaattttgttttttatttattggtcttttatttatctacatgtcaaatgttatgccccttctgtttcctgtctggaaactctaaatcccacccctccgcctggcttttatgatgattctcccaccacagatccacctactcccacctcatgcccctaggattctcctatgctgggatactgaaccttcacagtaccaagggactcctctcctgttgatgccacagaaggcaatcctctgctgtatataaagctggagccatttgtacttccatgtatactctttgtttggtgatttgatccttgagagctttgtgggtcttgatattgtttttcctcctacacagttgcaaagcccttcagcttcttcaggccttcccttaactccttcattgtggtccccttgctcagtccaatggttggcagcaagtatctgcatctctttggtccagtctctggatggccttcccttcagcctcttttccattctttgtccctctttttcttaagagaggagcaattctgggttaatataatctgggtgggtatgatgtctaatttgaaaataaaatttagcaggctattatcattttcaatcacttgatatagatcatatttgaggttctttgaggatacatgtaataattccaaaaaaaaaaggagagagagagagagaaacctctcttgagagtatgaatccataagctcactggttattgagtcccttattccttatataagtaattcatgtcacctctaattgccccattttgtttttgtttttgtttttttcagaaaatcattgcatatgtggaaagtataggaaggtcttggatcaagacagccagtacattgtccatgaacacatgaatattcaagagaagtcttctaaatgggacaagcttagcaaggtgattcttgaatccccccaatgtacaccttacaaaacttatcacagctctcttcaatactcgaaccaaaaaagacttaagcccaggaacactaaagaagtttgcaaatacaatgactctgtaaacagtgtaagtttgttttctaccattagtctcaatcaaggaatccacatgcagaagaaaaaacacaaccgaaatgcagaatttgagaaggtttttgtttctaaacataaagtcatggtgaaacgaaacaatactggagtgaacccttacaaatgtagtgaatttgacaaatatcttacccagagagaaaaacttcaaagtcagcagagaatttatcatggaaagaaaccttacaaaagtagtaaaagtgacaaatgctttacccatcagatccatcttagtatccatcagggaattcatgcagaagagaaaatttacaaatgtagtgaatgtgacaaatgctttacccacaaatcccatcttaatattcatcagagaattcatacaggagagaacccttacaaatgcagtgaatgtgacaaatgttttaaacacaaattcagttttagtatgcatcagagaattcatacaggagagaaaccttacaaatgtagtgaatgtgacaaatgctttaatgaaaaaggcagcctgagaattcatcagagaattcatacaggagagaatccttacaaatgtagtgaatgtgacaaatgctttacccacaaatcccatcttaatagtcatcagagaattcatacaggagagaaaccttacaaatgtagtgaatgtgacaaatgctttactaaaaacggcagtctgagaattcatcagagaattcatacaggagagaacccttacaaatgcagtgaatgtgacaaatgctttacccaaaaatccgatcttaatattcatcagagaattcatacaggagagaaaccttacaaatgtagtgaatgtgacaaatgctttacccacaaatcccatcttaatagtcatcagagaattcatacaggagagaaaccttacaaatgtagtgaatgtgacaaatgctttacccgaaaattccatcttagtattcatcagagaattcatacaggagagaacccttacaaatgcagtgaatgtgacaaatgctttacccaaaaatccgatcttaatattcatcagagaattcatacaggagagaaaccttacaaatgtagtgaatgtgacaaatgctttacccacaaatcccatcttaatagtcatcagagaattcatacaggagagaaaccttacaaatgtagtgaatgtgacaaatgctttacccgaaaattccatcttagtattcatcagagaattcatacaggagagaaaccttacaaatgtagtgaatgtgacaaatgctttacccgaaaattccatcttagtattcatcagagaattcatacaggagagaacccttacaaatgcagtgaatgtgacaaatgctttacccgaaaattccatcttagtattcatcagagaattcatacaggagagaaaccttacaaatgtagtgaatgtgacaaatgctttacccgaaaattccatcttagtattcatcagagaattcatacaggagagaacccttacaaatgcagtgaatgtgacaaatgctttacccaaaaatccgatcttaatattcatcagagaattcatacaggagagaaaccttacaaatgtagtgaatgtgacaaatgctttacccacaaatcccatcttaatagtcatcagagaattcatacaggagagaaaccttacaaatgtagtgaatgtgacaaatgctttacccgaaaattccatcttagtattcatcagagaattcatacaggagagaacccttacaaatgcagtgaatgtgacaaatgctttacccaaaaatccaatcttaatattcatcagagaattcatacaggagagaaaccttataaatgcagtgaatgtgacaaatgctttaatgaaaaaggcagcctgagaattcatcagagaattcatacaggagagaatccttacaaatgcagtgaatgtgacaaatgctttacccgaaaattccatcttagtattcatcagaaaatccatacaggagagaaaccttacaaatagtttacatgtgacaaatacaatactcatcatgtcagtctgagaaatcatcagttacttcatacagtagagaatctttataaatgaagtgaacgagacaatcctttaccaaaatatatcatcttataattcattagagaatacttagagaagacaaacttttcaaatatattgtaggtatgaatcctttccttttggcctatttcctagaatataacagtgaatatacttacaggctagaaacttaactcatgcattgtatgaagaaatatctttgacttcatttcaggtcagagaaaacatctaagaactttttaagggatactatttctgttgggaaaaatgtggcatatgttttattcacggtgtattcttgacaacacttgaggctccactctagagaattagtatgattatgaaaatcttgtgaaaattttcatgcaatgttcaaatcttgagtaatgtcaactatttatgctggaggacctctgtacatgtgaaaatgtagaaagcctttcatgacaccttttacttgttcaccctcaaatgttacaacatgaagaaaagtggggaagtcagaagatagtattgcataacacactgagaaagaaataatccatttcaaagaaaacttattaaggtctttaatacaatcctcacaatatctaataaaactggtaacattctgtatatttaattcacatgaactaattcagaaaaattatacttaaaagagtatctggcaaactgagccacccagacagcatattctttatcctataagtatgcttacagatgttaagtgtgcttcgagtatccagaaatcataattcttctcaattgcttgtttcacattataggataacaactgagtatgagtctcttgtgatctggtcaaccattcctttcctattgtcctgtaactaactccaataaagctgaaagtttcaacaagtttgctttggttgttttcaatttgcacttgggatactcagatgaatatatgttgcatcttcccagaaaatgcctcacataaaaaatacgtggaagtcataaatatttttgcaaggctgtatcataaagttaatagttattttcaagtgatagataaccatccctttggggtgtaaagactctttcacagtggttgcttaaaagcataggaaaacacatatttccaattgtcttataactgagaaatcattcattgaactgcagggtagtctgctcacctaagaataatttgaattctatatcagtgtttagcattacaaaagttagaaacactgttcagttcaatgttccaggcaagtattactaggttaagataaaaaggctcaagaaagcaaatatgtagaagctttcagagcctcagcagtaagtctgctctctcttgaattcaaggaagcatgagagaaaaatttacaaaaataaatgaaaacatggcttcatagatttcaaggatagctagccagacttttctgtgtctctgcatggttctgaagtcattaatacccatttattaaacaaaagtcttaaactctcagaaaaatgctgcccattgacacatattacaaaacattttggtgtctggtcctgttgttacttaatattccactctaccgtaagtaatgaaatagatttccattcttttttaaatcatctacagaatgttaatattttgtacatctcagaatatacattctgaacaaaacctcaaaaactcactattagggtattcaacttaatttcatgtatgagttcattcatataaatatcatgaatctgtaaatcttagagaaaaatcctttttagagtagatgaggtgcatactcatgcacagtttagaaatccaaccatcctggaaatatatttggaagtactgggaaaattacttttactccaagttcaagtatattagaatatttatcctaaattcaggaagtctcagaaaattaggatctaagaaaaaacattaaatgctacaatgaacaaatccatatcactccatgtattttccttgatttaaaaaaaaaaccacggaaattgttcaacttgtgtagaagtactgaatgataacaattcattggtctcaatactggaatttgatgaaacaggacttcctcattagtagaatctaagtatgagtagaagcagtagtggcccttgatttcaaataatcctaggtagtttctgccaattgctccatcagggatgttgaaactcacacaccaggcaaatgaaaattaggggacttgagtagctcttatcagtctggaaattgcaaccagttagacagtctctcttgattctcattgcacatgatcagtggatttatgcctcacttcttaatgacttagagatcattaaccaaatctgaagtgacttccaggttcatgtaaaaatttctagaagtgcataaacatttttacacacattccttgtctgtggtacagcaagcatatggtgatggttgacaaaataggtccaggtagactgactgagttttgtggaaggcaacatgtgtagattgagaaagatgcaagtcattggctcaggaaaattaccatatcatgtttgaaaaacatggagactgaagatcagtggatttggaacattaactatttgtggaatagcattttaagatacaaagtaagagccacactataggagcctgatgggcatttctggaagaacttccagtggctagattttaaggaacccactaggtctatatcaataccttgcagggaaaggaaacttctcttcagctacaggacaactgatgggacagcctggggatgggaaacatatggagcaggtggaaagttattccttggttgaaattgattatgttacaggagaactcagaagagggactgagggcctgaaggaagagagtgggatcagcagcccatccttgtcagtaggagtctggagctgcatggtgtggaactaggagtagagaacactgccttgggtcttacaaccatgtaaaaattccctttctctgcagttgtccccaattttcagtcaccagagcagtggcaggaaatgcaaacaagaagacttggaaactccaaggtcacagaagctactaggctagtggacagacaggcactggaccaagattgaaatcccttactctgctgctcataataacactgatcctcaaattctattgtgcatttcgtaactgtgtttttaaattgctgactatgtaaatgtgactaatcctgatttttttattcatcttattgttgcttgatacttacataataatttctgatagaatggtcttgtcggttccaaacatggttatatttttctggtggcaggtaaagctggtacaattcacatccatccatggtttttaacgctgctatttaatcactgtgctagtcaagatctttgccattggagattatacatccactggaaggtttaaatattagtcccataaggatccctggagttttcattgaatcttaagcatattttagcaatttttaagttagctgtctttagatttatcattatataaataattatttattttattttatttttttccaatttttattaggaagtccccccttccccccgctcccctatctacacactcccacttcttgatcctgtggtgttacgctgtactggggtatataaagtttgcaagaccaaggggcctctcttctcaatggtggccaactaggccatcttctgatacatatgcagctagagacaggagttctggggatagtgcttagttcatgttgttgttccacctatagggttgcagaccccttcagctccttgggtactttctctagctcctacgttgggagccctgtgtgccatccagtagctgactgtgagcatccacttctgtgtttgccaggcaccggcatagcctcacaggagagagctatatcaggttcctttcagcaaaatcttgctggtgtatgcaatagtttctgtgtttggtggctgattatgggatggatccccaggtgcggcagtctcttgatggtccattctttcatctcagctccaaatgttgtctctgtatctccttccatgggtgttttgttcccaattccaagaagggaagaagtgtctacactttggtcttcgttcttgaggttcatgtgttttgcaaattgtatcttggatattctaagtttctgggctaatatccacttatcagtgagtacatatcatgttagttcttttgtgattgggttacctcactaaggatgataccctccagatacatccattagcctaggaatttcataaattcattgtttttgatagctgagtagtactccattgtgtaaaagtaccacattttctgtatccattcctctgttgagggatatctgggctctttccagcttctgactattataagtaaggctgctatgaacatagtggagcatgtgtccttcttaccagttagaacatcttctggatatatatatatgcccaggagtggtattgctggatcctccggtagtaccatgtccacttttctgaggaacctccagactgatttccagaatggttgtacaagcttgcaatcccaccaacaatggaggagtgtcctctttctccacatcctcatcagcatctgctgtcacctgaatttttgatcttacccattctaactggtgtgaggtagaatctcagggttgttttgtttttttttgtttttgtttttgttttgtttttcgagacaggctttctctgtagccctggctctcctggaactcactctgtagaccaggctggccttgaactcagaaatctgcctgcctctgcctcccaagtgctgggattaaaggcgtgtgccaccactcagggatgctcagggtcatttgatttgcattccgctgatgattaagaaaggtgagcattgttttaggtgattctcaaccatttgatattcctcagttgagaattttttgcttagctctgtgccgcatattttaatgaggttatttgattttctgtagtccaccttcctgagttctttatatatattggatattagtcccctatctgaattatggttggtaaagatcctttcccagtctgttggtggcctttttgtcttattgacagtgtcttttgccttacagaagctttgcaattttacgaggtcccgtttgtcaattcttgatcttacagcacaagccattgctgttcaattcaggaattttccccctgtgctcatatttttgcggctttttctaaacataataaaagcaatctacagcaaaccagtaaccaacatcaaagtaaatggagagaagctggaagcaatcccactaaaatcagggactagacaaggctgcccacttctccctatctattcaatatagtacttgatgtcccattcagagcaattagacaacaaaaggaggtcaaggggatacaaattgggaaggaagacgtcaaagtatcactatttacagatgatatgatagtatatataagtgaccctaaaaattccaccagagaattccagaccttataaaccgctttagtgaagtagctggatataaaattaactcaaacaaatcaatggcctttctctacacaaaggataaacaggctgagatagaaattagggaaaaaacacccttctcaatagtcacaaataatataaaataccttggtgtgactcttaactaaggaagtgaaagatctgtatgatcagaacttcaagtttattaagaaagaaaccaaagaagatctcagaagatggaaagatctcccatgctcatgaattggcaggatcaatatagtaaaaatggctgtcatgctgaaagcaatcagaatcaatgcaatcctcagcaaaattccaactcaactactcaaaatatcaacttcaacgaattaggaaagacattctgcaaattcatctggaataacaagaaacctagcatagcaaaaactcttctaaatgataaaagaatctctgatggaatcaccatgcctgacctaaagatgtagtacagagcaattgtgataaaaactgcaaggtactggtatagcgactgacaggtagaccaatggaatagaattgaagacccagaaatgaacccacacaccaatggtcacttgacctttgacaagggagctaaaaccatccagtggaaaaaaagacggcattttcaacaaatggtgctggcacaactggcggttaacatgtagaagaatgcgaattgatccattcctatctccttgtactaaggtcaaatctaagtggatcaaggaactccacataaaaccatagacagtgaaacttatagaggagaaagtggggaaaagcctcgaagatatgggcacaggagaaaaattcctgaatagaacagcaatggcttgtgctgtaagttcgagaattgacaaaaggaaaaaaagacagcattttcaacaaatggtgctggcacaactggccattaacatgtagaagaatgtgaattaatccattcttatctccttgtactaaggtcaagtgtatgtggatcaaggaactccacataaaacaggagacactgaaacttatagaggagaaaatggggaaaagcctcgaagatataaacatttattaagcagcgaaacactctgtattaagtttgtacctgaaatgtatgaactgtctgatataaatataaatatccccttgatctcttttagttgccttattgcttgagctagaacgtctgatactgtacgaaagagacttgaggacagtcgacagccttttcttgtgatagagaattctttcttgaaaactttgctgttaaaatggtggttttttaaaatgaaattcccaagcccatagtacacttcctatcaataactggtcaatttcattattaccctgtgccagagagcctggcaaacctgtatgggttcttatatgtcttatatatagtcaattactcttatttctgattatttattgtagttgaataaatagtgaagtcaattcagaatcatcctaagtaagatcaacagtctctgtgtaaaacaaacgtttctgtatactgacagttagttactatgttaagacacttgaaaatctgagaacaccatgagtattgcacgtaattaagatttttgaactgatttctagggactgtcagccaccttacttaaatcttctgcctttcctgatttattagcctcagtgtaaaatgtagtggctccagatattggaattccctttagtgtatgagggaaaatccaagtagtccattttatgaactgaagccacttgtttttagggtatctgttgttaataactccaagaaattactgcatgctttttaccaaagttcgtgttgtgtccatagtgattcaatctctgcattaataaatggtaccacgatttcagctggatccattccaactaatttttgaagtctctctctttttttaataacaattcagagaccatctctatgtaggcttttaatttcttaccctgtttatgtgctaaaaatatccattctaatatataatcttccatctgcatgagcattcctgtatgggaatgagtacaaggtaagataactaagatgcaggccattttggaacaatatgaactagttgtgtatcctgcatttacctttcttccagagctaagtccttctcagtcttggctggtaatttcctcgggctatttatatctttatcaccttgtaaggtttgaaataaattgcttagcacttgattggccaagccaattgtaggccacagccagttagtatctcccaataatttctgaaaatcattgagagtcctcaaatggtctttcctgatttgcaccttttgtgacctatcctgttgcagacttattttaggtaataaacaattaatagaagccactcgttatatttttttcaggggtgatttgcaatcttcagcaaggcaagttgttttgttgttgttgtttggttttttttttttcatcaaacattctttccatgatatttaaatctgaattagcaaatagaatgtcatctatataatgacagataatggattggggaaattgtgaatcatctctaatggttgttgtactaaatattgaccatggccgagactgaggagcagagcctggacaacttcttcaccaagagggacaagaagaagaaggaatggagcagtcgggcggccaatgcggcgagcagcatggacgggagcagcgcgtccggagggctccaagacgggtgatggcgggagctcgggctctggtgctaggacaggagacagcaggagcgcgggccctgctggcaaggatataatgaaggatgaaaatgagtggaaagaatttgagcaaagagaggttgattacagtggattaagagttcaggcaatgcaaataagtgaaaaggaagaagatgataatgagaagagagaagatccatctctctttggaagaaggtggaggtggcaatggagcagaaaaatcttcaggtccctggaataaaaccgttccggtacaggcgcttccttgctccagtaacagttacagaaaccccggagccagcaatgcccagtggtgtatttaggcctcctggggcaaggctaaccacaacaaggaaaacaccacaaggaccaccagaaatacacagtgacacacagttcccatccctgcactccactgccaagcatgtagagagccggaaggataaagaaatggagaagagctttgaagtagtaagacacaaaaatagagacagggaggatgtttcaaaaaaccaggcccttaaacttcagctagacaaccagtatgctgtgcttgaaaatcagaagtacagccacacacagtacagctaaggaatggtctttgctaagccttccaaggtaactagaccacagctaaccaccaagaacagccattcatcgttttgatttctggatctacagtgactgactgaagacctcaagtccagtgactgtccctgttgcactatggaagttcaagtgtcacgactgatcttgatgtgtgttggatttaggggtgtttcattgtcttaagtatttgtgaattagattcaacagtgtttccatagttgctctgtgtataaagccaaacctgcagccagtggtcattcaaacatctttatgttcagatactgagccttcacaaggttgactacctcagacttgctgtccttagttgtgaatttcatgtggatcacatcttctatataaggttacagctactagtgtctgtgtgaactttgaaaccaactctacaggattcctgtcagaaagccttcagaagtcagccatctgggttctgatctgctgtaaaagatgaagaggtaagtgaccttaattaacctgttctgtgccccatcctaaggcatactctgtaggctgtggctatgttagactccctggatcaagctgctgtctgaaatgatgtgtttgtgtggagagctgtgccgcgagcaatcgcgtgtgtgcgtgccgtgagcaatcgccattataagatggtgctggcttccactgcgcctaactagtaaataagccttatgcgcaagtgcaagagtgaactcacgcctagtcactgcccatctcgcagcgcgtagtaatggggtgatgggcgaacaacgaatcaggagctgtcacaccacatcaggtgctgaaacgtcacactgcaggctacagaagcagcaccattttcccagttcggggtcttccctcctgataagtaagcaataaaagctttgccgcagaagattccagttgtcctgagtgtgttattgccgccggggacaaaagctcgggataagtggcactgagaagcccaggaactaccatcacaccggcacaagggagatccctcgttcgggaggcggaaccagaacggcgggacaaattacagctttacgaggtatgtctagccttgaactttctccagtgttagaagcctttttgttccttttcacatgtcaccaagtggttaaggcagggcagagaattctggacgaaattcaagacagtctatcagaggtaaagcggggagacagagtaggagcaaagaggaattatggtgcaccaattaagcatacaggcctttccacgggtcttgaacctgatgaaaagttaatgtcagggaagaatacctggggagagattggaaggaaggagaaggaaaaagaaaagaaaaaagatcaatcagcagaggtttctaggagaaggaacttatacccgccactagatgagtttaagcagctagctcttagtagctcagaatcagatgaaggacttagctcctctgaagaaacggacttggaggaggaagcagttcgttataagggagaaaggtaccagcaagataaaaagcgagctactcagtccagaaaaaggcaaaaagcggctggcgaaagccagcttgctgctcagcctccagacagtcggcttcagggtcctagtgcacctcagccctatgtgcagaggtaccattcagaaccttatgtgcagaggtaccattcagagccttatgtgcagaggtatcattcagattcattcattccaaaagaggaacagagaaaagtgcagcaagcattcccagtttttgaaggagctgagggagggtgtgttcacgctccactagagtatatacagattaaggagcttgcagaagcagttctcaattatggagtcaagcgctaatttcactatagcacaagtcgaaaggcttgggaatcacgctatgactcctggtgattggcagactgtagtaaaagctgcagcccccagtatgggaatgtatcttgagtggaaagccttgtggcaggactcctgccagacgcaggcaagggccaatgccaccatggaaggggaccaaagaacgtggatgtttgaattgcttacaggtcagggacagcatgctgctaaccaaacagattatcattggggagcgtacgcccaagtctcagctgctgctgttaaggcatggtaggcactaagaagggagaggcaagtgggcatttgaccaagattactcagggtgcacaggagtcattctcagattttgtggccagaatgaaggaggcagcagggaggatatttggtgatccagaagcagctaagcctttaattgaacaattggtttatgaacaagctacacaggaatgcagatcagcaattacacctagaaagagtaaggggttacaggactggttaaaggtttgccatgagcttgggggaccgcttactaatgctggattggcagcagccattctgcagggaggaggcgctcggattcaactgagctcaaactttgctttaattgtggcaaaccaggacatttaaaaaaggactgcagagcccctataaaaaggtcagcaccaggattgtgtactaaatgtggaaaaggatatcattgggcttaggactgtcgttcaattaagatatacgaggcaggctcttgcagcctacaaggtcttattgtccaccctggagttgtagatcaggattataaaggggaacttcaggttctctgttcttgtcctcaaggtgtcttttctatatcacaaggggacagaataactcaactaattattttgccaagcctacttggctgttttccttcctctggtattccttgagctgccagagggattggttctactggaaatgattctgcttacttaataatgcctttagattccaggccatccttggagttagttatagaagggaaacaatttaagggaattttagatacaggagcagacaaaagtattatttcttctcactggtggccaaaaacctggcccgtaactcagtcatcacactctttacaagggctaggctatcagtcctgctccactattagctcccgttctttgagctggcaaatggatgttacacatatttcctcctttgggaaaaatcaatatttacatgtttcctaatctgtctaggcagatttctttgtatcttgcaggaaattggtctgaaagattcgatgagacccttgaggccctgagagcggctgttctcaggatcaactcgacacgagtcgacctgtcattgacagagggtctctcctcctggatttcatctgctttttcttattttaaggaatgggtgggggtggttttgtttgctgctgcgatctgctgtggacttgtgtttatgctctggttggtttgtaagctcagaacccaacaaaaccgtgacaaggtcgttatcgctcaagcacttgcagccattgaacaaggggcctcccctgaaatttggctgtccatgcttcagacctaaatggcatctgaattctctgctattgcgtcccacggatttgtggatacattgcactgggatgtaagagactcaacgctcattgatcagcacttacacctcgctgaggtttactaattcgttttttggctggcctcttttatagagttcgccctagataatttagcagttactgtcacacagtactgcagtatctagagacgggcaactttcctcatgcacagaccaacctaagacacgggacccagtggtgataggttaccctatgacaggaaaggctgtgacattggaggaatgacctaagacaggagccacagcagatggacatgactgcagaggcctagaccagcctcaaattttaataaaatgaaaagggggagatgtggagagccatgccgcgagcaatcgagtgcgtgccatgagcaatcgccattataagatggcgctggcttccactgcgcctaactagtaaataagccttatgcgcaagtgcaagagtaaactcacgcctagtcactgcccatctcgcggcatagtaatgggatgatgggcaagcaatgaatcaaaccacatcaggtgctgaaacatcacgctgcaggctatataagcagcgccattttcccggttcggggtcttccctcttgataagtaagcaataaaagctttgccgcagaagattccggttgtcctgagtgtgttcttgccagcggggacaaaagttcgggatatgtttgaatcatctgtgtggggcttatgatttataatttaagtttttagttgtatgaggtaactgtggatttaattcagccaaactcagttccaccaaatgggggatagtcttatttctttgaataatttttcattcagatagtgcttgttcgattccactttaaggccttgctttgacttggagtaagttctttaagggcatattgtgtggagaaatagtctgaaagaatcattggaattgtgaaatgccctatgaatttgccaatccttaggtggaaccagatagcttttgatacatataaaggacagcaaatcagctgcactccagttgctgctcaagcctcctaatcaggtctaattgaactgctgtggacagagtacggtgtctgctcacttctgtggactgagtgtggccactgctcactgctgtggacagagtgttgcgtctgctcaggaggagagggtttcactgacctggcttttaacagttcaaagcaacaggagcaaaacacccaagttgcgcatgaatattgcatggtgtctgataaatccttgtgtgtgccccaaatgtgaaggttatggggtattctgtaggttcattcattgtttagccagctcttgacattcacctttggaatatttttggtaataacttggagatgcaggggaatagccagtagtgtagcatttctgttgtttgtaatttcaatgtaactatctagtagtacttggctcttagaagatgttactgctaaatttctttctacctaatgaactagcctgtcggttacctactctgtcactacatatagttcagtacacataccctatgttggcatatgactatgtgatacgatagtagtgcctgggtttctctatgtaaacgaatccctttgccaaacacagttcagacttgctcactactgacaggagtggaacaggaaatgaatgttttcccagcttgggagcctgtttattggatttagggcagcagtgtgggaagcaggaggttgaggccagtatctactaccagactgtatgccacttctgggcaataatgttggcatgatctgaactagccaggaggagggggggtgactagagacttgagattcttagttaaactgaagagttcatttgggcaccagaaaccttaacaaataatctcacaccttgagccacaaacgtcccttaaagtatgctttactcaagcatgacacacaaacacacattctgtttggggttatggtttaagatgtgaacagaaacatgatgaggtttgtttaatggcattctgtactggaacgctgaagacctgcagcgatgtaaattccaagtcttgttttttgtttttttttgttttgttttgttttgttttcggttttttgagacagggtttctctgtttagccctggctgtcctggaactcactttgtagaccaggctggcctcgaattcagaaatccccttgcctctgcctcccgagtgctaggattaaaggcgtgcaccacaacacccaggtttgttatttttttaagattgtgaaattataaaaatgcatatgaatcaagttttaatgcactgggtggatgaggctgccattgcacaatttctatctttgggttctcaggcatggttccgacagtgtaagaactctgtaacatttaactttaaataaacagtaaacctatgaaaaaaagaaatgacataaaaaggaaaggatatggcttctcctaaatatggtgaagtagaatgtgtcttatcatcaaaagaaagagaatagccggacacaggaacagtctacaatggacagaaccatgagcctcatgaggagagggagcaggaaagccagacccagaggccaggagggtaaatgaccagtaaaaaagaccaggtagccaaatggatgctttacatgaaaaaaagcagctgggaggacatttgcccaacctctgtgctaggggtctagaaaggaaggcattgcactgtagcaggtagggatagaggactgtttggagaacctggaaccaaggactgatttgatttgttaaataggcacgttggccttttgttccagggtttaatattcaacattagggatgactgaagagattgaaatgatttaattgtaatctcaaaagttatttttaaaaaaaaaatgaactagttcttttatttcttctctgcctaagtgatcaatggaggtagagggagggagggagggacttaggtgggaaaagtgagagggagggaaaaaggggagcagaatgagttatgggtgggagacaagagagagcccagagggccagaagaatgaatggaaatatggagcagtagaatttggagattggagagaaacctctagaaagtcttatagacctggggtgtgagaggcttcctagatcctgccatgtccccatattgatgataatggactgaacctctgaacctgttagccatccccactgaaatgttcttttgtccttattttgccttggtcacctttctgttcacaacagtaaaacctatgacagtaattcttaattatagagcttgatgaaaggctgagctacaggagatgttgctctaaacagacacatgtatgaaagtagctgatcaaaggaatgaaatttctcatgactgggaaacattagggatagaaacaattaagaggtcagatcagagatgcataaaggtaacaaaattgaaagatcaataccaagacaatataattgaaaaatccccaaggtacaacaactttgttttggtaggaccttttccctcaagaatttgagaagttgctgtttcatgcaaaacttgccatcatttatctgccttcatctgctgccattctaacagggcagcgcgtcttctgccttaacttgaacttgcaaacgctgaactctctaaacgaagccgactgaaggagcgaacacgcagactttttaattctgaggtgatttttcctctcagaagtccaacgtcacttaatgtcacgcccgtgagcgaagtaggcaggacgacgaaggccagctcaggcctttgctccttgcctaacagtcgcgccgttcccaagagggacccctagcacggtgggagacagcgagcccagccgttaagggagctctgaagacccagctcgctttactaggaggagaggaggcgcaaagcaccgctgacacgcttcctcgaggccccgcccactcggctccacagcttgctagaggcctggaggaggcggggccaaggaggagcatgcgcacgcgccctcgcaagccggccttctaagggggaacgagcgatctcgcgagggttgagagcgggtggcgtaggtagctgtcctggttggctggagtagagaatccactcccggagaggagaaggcgccgggaggcctctgagaaccttccgttttcctttccctttccctcggccctccgcctcctcagagtcagcccgccttccctgacctccgtgaccccactggccccgcccactcccgtcgacgtgtttcccgccgtgaggtaaacgccagtggagcagagtcccgcggaagaggacggcgaggcgagcagcgcggctgggctggctcgggtcggtggcggagccctcgcgggtgagagcttccgggcgcgtctcgctcctccggcggccccgacgccagtgtcgcgcaggcccaagccgcttccctcggcgccgcgccttcccgtggccgcggcgggtgacgcagccggaacatgtcgtccgcggtggagcctccgccgctcccgcctcccgagagcgcgccttccaagccctcggcgcccggcgggagcagcagcggcaacaaaggcggccccgagggctgcgggctcgtgccccggccccgcggacaccgagatggaggaagtatttgataatggatcacctggaaagcaaaaagaaatccaagaaccagatcctacatatgaagaaaaaatgcaaactgaccgagcaaatagatttgagtatttattaaagcagacagagctgttcgctcatttcattcagcctgctgctcagaagactccaacctcacccttgaagatgaaaccagggcgcccacgggtaaaaaaggatgaaaaacagaatttgctttcagttggagattaccgacactgtagaacagagcaagaggaggatgaagagctattaacagaaagttccaaagcaactgtactcgatttgaagattctccatcatatgtaaaatggggtaaactgagagattatcaggtgcgaggattgaattggctcatctctctgtatgagaatggcatcaatgggatccttgcagatgaaatgggtttgggaaagacacttctaacaatttctcttcttggatacatgaaacactatagaaatattcctggtcctcatatggttttggttcccaagtctacattacacaactggatgagtgaattcaagagatggataccaacacttaggtctgtttgcttgataggagatgaagagcaaagagctgtatttgtcagggatgttttattaccaggagagtgggatgtgtgtgtcacatcttatgaaatgcttattaaagagaaagtctgtgttcaaaaaaattcaactggagatacttagttatagatgaagctcacaggataaaaaaaatgaaaaaatctaagttgtcagaaatagagaattcaaaactacaaatcggctgttgctaacaggcacgcctctccagacctgcatgagctctggtcacttctaaactttttgttaccagatgtgtttaattcagctgatgactttgattcctggtttgatacaaataattgccttggggatcaaaagctagttgagaggcttcatatggttttgtgtccattcctccttcgtcgaattaaagctgatgttgaaaagagtttgcctccaaaaaaagaagtaaaaatctatgtgggtcttagcaaaatgcaaagagaatggtatactcggatattaataaaagatatagacatattaaactcagcagggaagatggacaaaatgaggctattgaacattttgatgcaattgaggaaatgctgcaatcatccgtatctcttcgatggagctgaacctggtccactgtacacaacagatatgcatctagttaccaacagtggcaagatggtggtgttagacaagctactccctaaactgaaagaacaaggttcaagagtactaatctttagtcagatgacaagagtattagacattttggaagattattgcatgtggagaaattatgagtactgcaggttggatgaacagacacccccatgatgagagacaagactccatcaatgcatacaatgaaccaaatagcacaaagtttgtatttatgctaagcacacgtgctggtggtctgggcatcaatcttgcaactgctgatgtagtaattttatatgattcagattggaatcctcaagttgatcttcagcctatggaccatgcccatagaattggacaaaggaagactgtccgagtgtttcgctttataactgataacactgtggaagaaagaatagtggagggctggtgagatggctcagtgggtaagagcacccgactgctcttccgaaggtccatagttcaaatcccagcaaccacatggtggctcacaaccatccgtaacgagatctgactccctcttctggagtgtctgaagacagctacaatgtacttaaatataataaataaataaatcttttaaaaaaaaaatagtggaacgtgctgagatgaaacttagactggattcgatagtaattcaacaagggaggcttgtagatcagaacctgaacaaaattgggaaagatgaaatgcttcaaatgattcaacgtggtgccacacatgtgtttgcttcaaaagaaagtgaaatcactgatgaggatattgatggtattttagaaagaggtgcaaagaagactgcagaaatgaatgaaaagctctccaagatgggtgaaagttcacttagaaactttacgatggatacagagtccagtgtttataactttgaagaagactatagagaaaaacaaaagagtgcattcacagagtggattgaaccaccaaaaaaataaagaaaagccaactatgctgttgatgcatatttcagggaagctctctgtgttagtgagcctaaagcacccaaggcaccttgacctccaaaacaactaaatgttcaggatttccagttctttcctccaggtttatgtgaattactggaaaaagaaattctgtattacaggaaaactattgggtataaggtaccttggagtcctgatctacctaatgcagcacaggcatagaaagaacagctaaaaattgatgaagcagagcccctcaatgacgaggaattagaggaaaaagagaagtttctgacacaggggtttacaaattggaataagagagattttaaccagtttatcaaggctaatgagaagtggggtcgtgatgatattgaaaatatagccagagaagtagaaggaaaaactccagaagaagtcattgaatactcagctgtgttctgggaaagatgcaatgagcttcaggacatagagaagataatggctcagattgaaaggggagaggcaagaattcaaagaagaataagtatcaagaaagcactagatacaaagattggacggtacaaaccacccttttatcagctaaaaatatcatatggtactaacaaaggaaaaaactatactgaagaataggatcgttttctcatttgtatgctgcacaagcttggcttcaacaaggaaaatgtgtatgatgaattatgacaatgcatccgcaactcccctcagtttagatttgattggtttctcaagtccagaactgcgatggagctccagaggaggtgtaataccttaattactttgattgaaagagaaaatatggaactagaagaaaaggagaaggcagagaaaaaagaaaagaggaccaaaaccttccacacagaaacgtaagatggacggtgcccttgatggccgtggaagaaaaaagaagctgaaactatgaatgcatttttgtcttataatcactaactagtagttctttaatttacaggtcttcataagatgtgctggacagtgctcaactgttctgtcattcagatatcaggtccatctgcttactgagatagaaacatagtatgtagtttcacttttttaaaatgcaacagctgtgctgaaatttttttatcattaacaattgaagtaataaaacaggcttcatttatttaaaaaaaagaatttgagaagtttaatcatgagaaaaagcaatgtcattgtaacagggggcacagactgtgatcaaggtgacctgagccaccacagcttatctcagaaacattattgtaaatatttctttttgtaaaaagactgcagataaagctgatggaaataatatacgttgttagagtgaaatcactccatacacaagcagaagatgaattaagaaaagttgctttagtgaatgtgtgcattcatgacaggctaattatcagactaatcagcctagcataaatctgaattcaacatatgctgtcagtcttaagtttcttttaggttgagttcccagattatgctttgaaccagttaaatatggactggatactgcatatctaggctcttaggtagatggaaggtttacatagtacagatattgtaagactcatttcttacatagccattttcctaaaaaaaaaaaaccccacaaagataacagtatataattttcgtttgtacctaagatttattattcaaattgttttgttttcctccatgttgggatgaccatatgtttgtaaaaaaaagactatattttgatgtaattcctaaccatttttgaacatatgttagaagactcagagtgaaatgtctatagggtgcaaatcgaacaacctgaccttgatcactatataaaaaatgtccatatttcctcccttgaatattttgttccccaatctaggtaggactaaagcatccacactttgatcttccttattcttgagcttcatgtgtactgtaaattatatcttagttactctgagctgtggagcagagaatgacagaaaagccatccagacactgacccacctgggaatccatcccatatacagacatcaaacccagatactaatgtggatgccaagaagtgcttgctgagaggagcctgatatatccctctcctgagaggctctgccaaagcctgacaaatacagaggtggatgcttgaagccacccattggactgagcttgggttcctgatggagaagctagagacaagactcaaggagctgaaggggtttacaacccataggaagaacaacaatatcaaccaaccagaccctccagagcttacagggactaaaccaccatccaaagagtacacatggaaggatccaaggctccatctgcctacgtagcagatggatggccttatcaggcatcaatgagaggagaggcccttggtcctgtgaaggctccatacccagtgtaggggaatgtcaaggtgggaaggcaggagtcggtgtgtgtgggagcacctgtacagaagcacagggagggaggatgggatagggggcttccagaagggaaaacctggaaaggggattacatgaaatataaataaataaaatatcagcatcaaccaacattagccactgtgaaaattctctggcaatcatttccggttctaagaatgaaacatctatttagaattaagtatgaactaatacacttgaaaaaaatatatttgaagcataaaaatataattgaagcataaaaaatgtccaaagtagattccacaaacttgtgttccaatttgcacatatctctcctggcctaaatccttgtaaaaatacacacatacaccatacacacacacacacacatactcatgaatgcattcatttctgttaaggtttcttaaagcctatctgcagaatttctcttcagcatgaacttgttcaagtaacagataccaagcaacaaggcttcaagtcagaaaagtcaatccttcctcaagagtggcatcataatatttgaatagattgtttacccttatcagacttctttcttcagaatcaataatcttgtgttactggatataagtgtgttacctaagaatatgagcaaattctttatagacatatattcccctcagtatgcatattttcagatgctcaaaactacagtaatatgcaaaatatctaagaggttcattatgcactaaagtttgtactcttgtgtaaaggtatcaggaggtacaattcaggtacaggttcagctctttattggacaagttaacaaaagcagtttagtcaaaaagaccaaagcccctgtcatcttcggactcctcgggctcttccttctttgcttccactttcttctcctcagctggggcggcagcagtggatggagcaggaccaccagaaggtgcagctccagcagctggagtgggcccagcagccccaacattgcagattaggctaccagtgttgacattggccagagcctttgcaaacgagccaggccagaaaggttcaatgctgacaccagctgctttaatgagggcattgatcttaacttccctgaccatcacctctttgtcttgcaggatgaggtcagagtagatgcaggtgagctcggagacagacaccatgttgtggactgctgacatggtgctagtcgttggatgaagtgagggcctcaccccaacgtggcattagcaaactgaccacattaacagggtttgtctgtagacatcccaatggctatcttaggaagctgacagtgacctatggggacctgtgctgccccatgcctatgtatgcttcacccgtgcagtgccttcctggctgtgttaaatcaccagtgctgtggactggactcagcccctcaacttgcaggtgccccttaagtgtcgggagactcagggtcctggtacacaggcgtgaaggagtcagtggggtgacaaacagatgcaaacataaaagagtgttgatctgaatgtaatttctcaaaggaagcatcagacttatgatacagaagaaaataaggaagttaggtgacacatcacccaaggtacgttgaggttacccgatgcttaatgactctttacacaaaacagaagaatgcatacataaagactgacaggaactaagtaacataacaactgagacaaagtcatctccatctaaggtcagctatattcctaaaagccagatgtgaggtcattatgttcccagggcaagtcctttcttgcccaagccatagttctaattctgatttattgtttagcccaccaccagccagctcttagtaaatatctaactatgctatgcttctgggctagtgaaagtatgtgctagggagttctgctctaggtaaccttctcatgaataatgcaatactctagctcctccttaaaccacatctcgacctacttcctaaaccattgtaaattcttgtatatttaagtgactggactattattctaagtgattttgtcggggactttcttctattaagtaatgtagtctgccatatataactataataagaactctaatcttactttgctaagcttgccctgagatttctaactctatttagtagatgataatgcctgctttctttcactatctctttttcaatactggaggcaatctgtcttaatctgtaacattcttatgaaatcccaagtccagggctggctcaagtgctggctaggacattggtgaaggccaggaagcaaagttcaacctaatttaggtatttgacaaatcattccttggaggcactgataataaaacaatactgaaagaaagcacacagacccattcacctattaaccaagtttataggaacatcatggtatgggatgccaaggctccaggagactaagtttccatgaaagtttttgactcaggacttttcccaagcttttgggcttgcttcatagatttcactgaagtggctatgatgcaccagcacctggatatataaggttctgcaaagaaaggctttccacgttcactcttctgcctcaccaatcttgatttctgaacttataaatttgaccataagctacttgtgaagtaaaagatgtttaatggaacagaagaatgagggctggtgatgacttaaaagttaatagcaggggtgggtgtggggggtgggtgtgcaagggacatagctcagcggttaagagtgctgactgctcttccaaaaatcctgagttcaatcccagcaaccacatggtggctcaccaccatctgtaatgggatccaatgccctcttcaggtgtgtctgaagagagctacagtgtagtcatatacataaatacaaaataaaaaaaagttaagagcactggcctgctcttgcagaagactcaaaattgattccaagcatcaacatggtggctcccaaacatctgcagggacctgattccctctcctaacttctgagtgcaccagacactaagtggtgtacatatatgcaggttggcaaaatgttcatacttgacaatagaccagagaaataagtttgaaaatggccagaaacataataaaaacaataatataataaatcttgaaaaataataaaggctgagaggggagtcatcccttcaggctcatttatgaagggggatacctgcagcagataccatcaacaaactccctggcacattttcttacatcacaccaagaaaacaatctagacttggccatgtgtcccctaagagtttgacattgggcatcagggacagaatgctcaataccacgaatgtgtctgcttcagagctctgtgaagtgagctcagtcagtgcttacctacacacacatcccatgagggatgggaacacaaagcagactgttctcaactttgaaatgtcatgtcttggagagctgcagccggagagcctggttcaaagggaacatacttagtaaagcttgtggtcttagacaaactcatctgtccttccacatacatgtatggagtactggtgtgtcccaagcactgaactagccagggcacttgggagagaaatggacaagatcaccattcctgatgacatgcagctgacatgctctctgaaatattttccccaccagggatggtatggtgagaccagaagccatggacaggtggccataaggagcccaggagaagttgggacactgtcagttcactgagagtgagctactgccacctcacaagacatctccaatcttgtcatcacagcagactcagtaccattgcaaaaacaacctcagcataagtctccagaataagccttgctcaatcccagaataatctgaagtgtgagggaattgaataacaacttatgtaagtagatacatatttcccacagaatattaaacttaagaacatacattaacatttttaaaaattacatttattgttgggtatagtggctcatgtttttaatgccagcacgcaagaggcagaggcaggtggatttctgagttccaggccagcctggtccatagagttctaggacagccagagctaagtaataagatcctgtcttgaaaaaataatcaaaacaaaacaaaacaaaaataactgaatttttaaaaatctatttgtggagggggaacacagcttacaggaggccattctttccttcctcctgggatcagggatccagttggggagtaggtgcctttacccagcgaaccatcttgctgggtcaggaaaacatatttttaaacatgctacatatgattccactgtttacatggacacagcagacattccatacaagactctgaaccaagcactgctttactcctttggatggtgtttttattttgtttttattttaattatcattactgagggtggggcttggggtggagcttgcaacccacagccttatgcatgggatacaggtgctctactactgagcaaacatccccagtcttcaagagtgaatttaagctcttcaactcatatagacaaacaaatgtgcccaagccttaggaagggcattggaattcttctgtttacagatgatgaaactgaggggtaaagctgaccttggtggtgcatgtctttaatcccagtgctcaggtggagggtgcatctttgagttcaaggccagcctggtatacagggcgaatttctggacagtcaggactacacagagaaatcatgtctcaaaaaacaaaacaaaaatacttcgtttttatttatgtgtgatgtttctttgcatataagtcagtgtaccatatgcgtgcctgggactcacagaggctgaaagagagcatcagttccctaggaactgcagtaatagttggtggtcatgagccactatgtgggtacctgagaacaacctttggttccctgaagagcagccagtgctcttaaccaccaagtcatctatccagatcctagttcttctctttaaaatgtggctggcaaaaagcatccttgcttcaagtggtggagaattaaatacaactttttatttctaaagcatttggaaaagtgcctggcctttcttcttgatgccaaggagcaaaagcattattagctgtgaggtgggttctgatcactgcatactgtacacagctggtggtttgtaaatcaaagctgggggcagtgaccccagaatcctggaccacagtcattctttgcctcctttgtgtttcaagagagggtctcatgtagctcaggctggtcttcctcaaactgactatgtcacagaggatgtgcctgactctttaatccttcggcttccacctcacaaattctgaggggactaaaagcgtgtaccatctcaacatgtgacatgggtctgagctctgaatgcaaggtttgtggtaccaggctagcacattcccagcctgagttactactttccttttaaacatttttcttattttattgaaaacatattattttttggtataagggtgttttcgcctacatgtgtatctatgccccatcacatacatgcctggtgcccacagaggtcagaagaggacattgtacttcctggaattggagtttcagttctgatccaccatgtgagtcctgggaattcaaccctgctccacaagtgcagcagagtgcttttaattactgagctgcctccccaagcctctaaatcacttcttaatgtgcaggaatgtatataaactggcaacatatccttggcaacctcactaaaactgtgatatagctctaaatgtcacacaggatgagcaatgataaatacttacaaagtttaaaaaaaaaaaaaagaaaaagactggagctggacacttagagctagcttcaaagcacaaggccctctcctgtcctctgcagctacctgcacttgtgtgtgtgtgtggcctgcgtactgtccgtaggtgtgtgggtctatttttgggtctcctattgaattccattaatccacctacttatttctttctataccagtaccatacaaatttttattactatttttctgccatacatctttaagttacagaaattgatagctccagattttttttgttgttcaagaatattttatctatcctgtggtttttgttttgtttactgttccatacaacattgagaatatttctttcaagatctgtgaagatttgtgctaaatttttgataagaattgtactgagtgtctagattgctttttggtaagatggacatattcattatgttaatcctattgatacatgaacaagggagatcttttcatgttctgatatcttcctgtttctttcttaagatactttaagttcttctcctacaggttttcacttgcttgtttagaggtaactgaaggtattttattttgtttgtggctaaagtggagggttctgtttccataacttctttttcaacccttttaatcaattgtgtgtagcagggctaaggctttctttaagtcaattgtgtatgcagacactttgctaaaatgtttatcaactgtaattttttggtagaattttttgtctcacttatatacattatcataatatctgagtttcttcttttccaaattgtattcccttgatctcttaagctgctttattgcttgagctaatactttcagtactatatcaaagagatgaggggatagtggacagcttttccttgttcctgatttaatggaaatgcttaaaatttctctctatttagtttgattttgggtgatagattgctgaacattgcctatattttgtttaggtataccccttgcattctgtccctccaaacgtatcctaaaggggggttgaattttccaaatacctttttggcatttggtgagatatttatgtgggcttatctttcacttttttttcctatggtgcattattgtgattgcttatcctggttgtcaacttgactaaacctggaatgcactaccatccataaatacaggaaatacctgtgattaagatctgcggctttaagaaacaggcttctgccttacatcgtgaaatgggatgagaacacttttattcagtccttgaggccatagaggccatgagatggttaggcctagataaggttgtatatggctttaatttcaggagactaaggaaagcagaactctgagatcaaggccagcctggcacagatcaaattccaaagcaagtcatagttgtatacaccattaatgtagagcatcccttctgctggaggcctgcataaagctgatgaaagaaggacgtctcactcttcttcacctgcttgcacttacttgccagcacatctgttggaacttacttcttcaggaatcctggttattcagaagaccaggcaagacatgtagcatcatgggactgcgctagattcttggacttcttgttcactgatttccattgtagggcttgttggactgtagactgcaagttattagtataaagtctcttaatatagagagatataccataacttctgtcactccagaaaaccatgagtaatacaattatgttggtatatttttaaaaaagattaacttatttattgtgtatggttttctgcctgcatatatgcctgagtaccacaagagggtgccagatcacattatagatggctctgagccaccatgagccaccatgtgtttcctgggaattgaactgatgatctctagaagagcagtcagttctcttacctctctgagccatctcttgagccgtgtggatttttacatattgaatcacccctgcattcctggaaatattggcattagttcttctttgacagtcggttagaattgtgcactaaaatcatctagcccaggacatttctcttttggttcagagagacttttttctttttttttttttgagacaaggtttctctttatagccctggctgccctggaactcactttgtagaccaggctggcctcaaactcagaagtccgccttcctctacctcctgagtgctgagattaaaggcgtgtgccaccacgcccggctggttcagagactattaatgactacttctattctgttaggggttataagataattcagatattttaccttttcttgattaagctttggtaattgttatatgtctagaaagtcatccatttccttcccaattttgtggagtatgggtttttcaagaaagacataattattttttaaacatcctcactgtccttagttgtgactcttttgcaatttccaatatccttaaattggatactgtctctctgacttttagttagtttggctaagggtttgtgtaagttgttgatttttttcccaaagaatcagctcatggttttcttgattctttctgttttttgttgtttctttctcactacttttttttttgccttcattcattttatcaattacttcatgtatttacattccaaatattggccgctcttcttagtcccatgaattcttcactacataagccctagcctttgcatctgagagtgctcacccaccaatccacccactcctacctcatactacttgcatgatacatcactggggcatcaagtatgggaccctcttttttatttcttaatgtcatttgtcttatacattctgctttattttcattcctcctgacatcttcacattaggactgaccattcaggagatggtactaaggacttgtttcagtaaaactccaacaccaatagctaagcaaagaacacgccactcagttacaatatatataagctgcatgtcttgggcagatattccactacactattctattctccagcttttagaacccttgctatctgtggcttttcaggcaatgtgttcttctccatctttcctccaccttttcttcctctaacttcctctgcctccttcatctcctcgtctccctcttctttttctgtctttgccctctctaaaatctccagccccacctttcccttctattgcccaatcacaagctctggcctttattcgaccagttaaaatggagagaaggttcacatgaaattacatgagtatatagtccactgttcattggggcagcccctcttgaggaagcagaataagcattaaagtacaaacagcaccagggaaatccacattttgttcaatcccttttgttcaactaaaaggatcttttctctcacatataaattgagcacagcacttgaattatgaaattttaaaagtaaaagtaccctaaacacccaggccacccatcatctccatttagataaagcactaccatctatcctaacttaaaaggcttacaattctatacctgaattatctcctggttttaacttgtatctgaaaaccatcctctcaaatatatatcatgtcagtcaatgctaaacatcttgagttagctatgagagtacaacaagacttcagcagctgtaagatagaaatccaagcatgtcctaaatattacctgaacatataggaagcataaaacatagcttccaaaacccaaccaaactgtggacacagttgacaacctggacagtccctcattccttcaaaatggtggagcatcagtcttcagccttctggccaggatcatctgtcagaactttgtaaagcagaattttgaaggagtgcttagcctgtcttggcagatctattagttgctcttccacatagtatgtccttttcctggacaggacttttgtctgtagatgaagtgaggcaattcttctctggtggctatttcgccacaactggagcaactccactgatgcgcacttcatgtttatacaaagaatggatgctgtcaggagcagatatgtctctagtcgagtgatctttaataatgaaattgccttaactgtagtattctgtggacttctgtctatctatgcaaagtatatctgaactgttaagccttgactactctcaaccatttctgattgaaatatctcaaaaacaaaaactttataattaactcaggactatgattctgttatctgacccttaacttgtattttcaatcatctaaaaatatttagtaatagcagacatagagggacccagtctaagctttgtatttgtaaatgtgttgactgggtacaaatcctatctaataacaataatattactccaaatttttacatcaatctatgaatttcataccattgaaaaccttaactctattgaaataaattctgtagaaatgtaagaaattataagttcaatgctacataaattataaagatttctatctgtaagatatggccatgtaatgttttaagagtaaagttgacaacctattcttatttgtctaatattctaatttctatattactatatcccatctttatcttccctgtgacttttatttacctaagaaggaaggatagagaagaggaaaggaaaggtagaagtccctgagtctaagctctctagctccctccctgtctaaatctacaatatttgtaaaatattccttaaaatgataacatatctatgattcataaaataaccagaaccatccaccacaacataagatactgatacgatgatcttcttttgtctgcttatagctgaattgaggtgaaaaaatcccttctgtgggctgaagggaaaaaacaggaaaattggtttggtcaaaggaggactagttagtgtcatttgccttccaggcattatgtgctgagaaagttcatcaattagatgaaatcttgactatggcagtctgaaaggctgaataggtgatctagatattcttgaaaagttttggaaacaactatttagaagaaacagcttcaatgtacttgaggtagaatcaaacaaggagacagaagggaaggtcgcataatctcaacatcctggagtgtgaatcttagcagtgctgtctttctcttctttcatcctgcactataccaaacttacaagcaacatataattctggaaagacattcatatggagcatgcagggtgcacagactggttagttaagatcaataaaggaagacaactgcctttcttcagagattagtttgatcacatagtcaaactacaatatacattaccattcatgccatcttaaaggatggtatgtaaaaagtcatgagaattttgtacccagtaggggttattgggtgtgtatagacattttagtcaaagccagttccagagctgtctctatatacagagacataaacatcaccacgtatatagcacctagcttgttgattgtgttagtctccctttccttctccatagccaaggtattcaggaggtcttcctttgacatgtctcatttttatcaacttgaaaggaacccatagcttttcttttcctgtggaaatataaggataacccctccacttgtataacacatttgttattttccattctgatttcataatatccttaatataaacaggctggtttagtttagtagttctttccacaatcgaatgacttttagcatctgcaatgttttcttcattagcatttaaaaacttaggtaataaagcattatataatcaattttggagacttttgttgtccccttttgcttgttaagtatcccctttagagttttcttagacatctccacaatcaattgtcatgtagggttatatgatattcctttagtgtattttatgtaataacattttaaaaagctgcttcatcatactagagacgtatgctggaccattgtgtgttttgatttgtatgggtattcccagaatggccataacctctaacaaatgggtagttacagattcagccttttctgatgctgaggacgaggacgtttcccattgaaatccttaataagtgtcgatagtatgatgcacacatttcagtttaccaaactttgtaaaatggaatacatccatttgccaaatgacatttctttttgtacccttatgcttagttcctgaaggtaatggaatttgattgtataatgagcaagtaggacattgcctcacatttcccttggctctttctttaagacttgctgttaacatgatttgtttatggaattctaaagtctcttttattctttctatcagtagctggtcaatttcattatcaccttgtgccagagggcctggcaaacctgtatgcgatcttatgagtgatttatatagtgaatgactcctatttcttatcaattgtggtagctgaaaaaatagtgaagtcaattcagattcctcctgaataagatcaacagtctgtattggaaaaacaaccctttctgcatattgagagtcagttactatattaagagactctagagaatctgacaacactgggagtattgcacataattcagatatttgagctgatttataaggacattcagtgacctacaccttctgatttatatcctgcctttcctgatttattagtctcagcataacatgtaggggctccagataatggagtttcctttattttatgagggagaatccaagtagttctttttatgaaatgaaatcatttgcttttatggtatccatcactaatctctccaagaagttactgcatgttctttaccaagattcaccttgtacccctaaggaggcaatctctgcattagtaaaaggtaccactatttcaggtgggtccattccaactaattgtcaaagtctcatttttttctttttagtataaattcaaagaccttttccatgtagggatttcttactctgtttacgtgctaaaatcatccattctttttttttaaattcacatatttgtttgtttgtttgtttgttttgttttgttttgtttttgagcctgtttccctgtatagttagtgctggctttccaggaactcactgtatagatcaggctggcctcaaactcagaaatctgcctgtttctgtgtcccaagtgctgggatcaaaggcatgtgccaccactgcccagcaaatattcattctaatttatcttccctctgcatgggaattccttgagggaaatgagtagaagttaagataactaagatgcaggtcatctttggataaatactggttagttgtgtagatcccttgctccttgtgtcttctctaggccacgtggttttgctccatcttccttccacctccttttcttccatcttccactatctcctttgtttacttgtctgcctctcctccttcccctcttcttcctttctaaaacctccagccccacgttttccttccactgcccaatcacaggcttcagtctttatttgaccaatttgagcaatttaaatggggagaagtttcacattaaatcaccagagtatgtgatccactcctccttggggcagctccatttgaggaagcagaattagcatcaaaatacaaacaacaccagggcaatccacaacaatgactaccctacacaccacccatgacattcctccattgggccaaccatgtggacacagagccatggcctaactaccatggaagtccctcactaagcacaaaacaactgagtccaacatccactttcctccttccacaatttttccctttcttatgaatttacacctgtgtctcatctggccattggtagacttccttcccacttaagggaaccccaaataaaatcccttaggttcttccttttcatcagtggcatgaatgtaagtttctctgttctggaaacatggactgaggcaggaggtctatccccatgaattttgctctgagaacatttgagaccctgatacgtcgacgagggttttctttcaagccaagaaattcatggtgaattcgggtgacacatactgaactcaggcggtccctcaacccgtgggagaatcaagatttcagtattcaggtgggcaaggagtcagtgtcgagtgtcaatcagacaagaacacaagggagtgttgatctgaatgtaagttctcaaagtgagcatcagccttataatacagaagaaaaaaaggaagtgaggtgacacatcactcaaggtacattgaggttactcgattcttaatgactctttacacaaaacagaagaatgtatacataaagactggcgggatctaggcaatgaaacaattgagacaaagtcagctctatctaaggtcagctatattcttagaagccaggtgtgaagtcgttacgctcctgggacaagggctttcatgtgcaagccatagttctatttctgatttattgtttatcccaccaccacccagctcttagtaaatacctagctatgttattcctctgggctagtgaaagtatgtgctagggaattctggtctagctaatgttctcatgaataatgcaatgctctagttcctccttaaaccacagtaggatcttcttcctaaaccattgtaaattcctgaatatgggagtgacttggctgttattctaagtgattttatggcggaatttcttctattaagtaatgaaatctgccatacataactataataagaattctaaacttactttgttaagcttgctctgaaatttctaactctgtatatcgtaaatagtaatgctttatttctttcaatatctctctttcaatactggagtcaattcgtctgtataggtcatagttactaaattccaagcccagtgtaggctcaaggactgcctaggacattgatgaaggccaggaagcaaagttcaacctaattaagtatttgagaaatcattctttggaggcacctataataaaacaaaagtgaaagaaagtacacagaaccattcaccaactattgcaaggacaaatctgaaacaaatttgtttatgggacgccagaatcattccaggagacaagtttccttgaaataatatgcgtcaggactgaggccaaggttttgggcctgtcatgcaatttttactgtagtgggtgtggcattattgtatagttccccaccacctctttagttctgattctttttgacatcattactaatttaaattttttccaaagaggaagttgttgctactcacaatacatattgttagaaataggcaagtgtatatgtgtgcataactgcctcttctccagccatcttagccttggcagactcattggatggtgatgagaaggagtgaaatgatttgaaggcatttgaatgcttggtgttaactgcaagcctcccacctccaccagatgcatggcatgaactttgtgccagagataattctgccttcccacacttaagaatccttcatcaaattcgcagcctactctggttggactccaacaatctcctgccttgcagctgcctctttaggcccacaggacctgacttgaggctcaaaaaggggaacacccacaattgtacggactgctgtctatgcagggcctcattcccctgagtccaaatgtgatccttatcttacccaggtagaggctttgtttcacctaaacttcctcagctttgatgaccagggactaaaccctgtctataaacattgggctttcctacccaggaaaacccacttccattagtatagtggagtggtgccctaacatcataacgtcagtcacctgctcccttgctgacacagggctgaggatatgtttgtgtttttccccaggaatccacaacaccaggatgaatggcagtatgggacacccaaccatccaaggaaaagtagaaaagggacgaaccctgctcctcctcagaactttttcgtgaggagtctgcacttgtaggagataagtctctacttgtctgtgatccctgtattcataccatttgctttatatgctattaagtacaaaatatttcccaggcctatgaacaaactgtcccatttcagcaaggaaacttgagctaacatagtcttaaatgattcagtactctcagaaaaagtatatccttgctcaatgagagcagggtgtccattcttgcttttgatatggggtttattggaaaagtttgggacaacttaaaaaggtcttttgacacatcctggatagtatcttatgctataattgtaataataataataataataagtattgcttaattgtcttgtacaacacatctcttggcaatgctctatttgcataggtatgcttcaactactgatggttcttgagcatctagaataaggcctacccagaataatagaataaggctattatagcttagctcatagaaattccccagggttctgtttaggttccctccttacaccctgatatgccctctgggatggctgtcctttcagggctggtagtcaatgaagggtaagaaactgtttggcagctcaacataagacacacatagtcaaccatatggaaggacatctgagatggggccaaaaaactctgactcctactgtgctatcaaaaattaaaataagccaggcaatggtgacacatgcctttaatctcagcacttgggaggcagaggcagtggatttctgagtttggggacagcctgttccacagagtgagttctaggacagccagggctatacagagaaacaatcttattttcaaataagatttattattcaaattgttcttttagtacatcttgaaatgataatatctttaaaagaagaaagaagacaatatttattgttttaaagactaagctttttttgagcatctgtgagaaggctcagtgtaaaatgtctgtaggatggaaaggtagaaacctgaccttaatcaatatataaaaaatgtgcaggggctagaattatggctctgtgggtaagaacactgaatactcttcctgaggttatgagttcaatttccagccaccacatggtggttcacaaccatctgtaatgggatttggtgccctgttctggtgtgtctaaagagagctatagtgttctcatatacataaaataaataaatctttaacgaaatgttcaatgtagactgtacaaagttgtcttccaatctgcatatatcagttatgccgaaaatcactgtaaaaatatgagtgtgtgtgtctctctctctcccttatattactaatggccaaaatcactgtattaataccatacaaacgcgcatgcacacacacataccataaaagtttctatttaatttttgctgttgcagtatctaccatttctagataattcccttagaagtcactatttaaagatgcagttccaaaacacaactaatgggaacatgaagaaacatgaagtatcaaataatattcacatagccatagcaagtgagatatattgtgagatatgcagttgattgctgattattctacttggttccatctctgattgatgagctatttaatgtttttgatattctcttctattaaacatctgaacatgaaaattgttaaatatgttgacaaaacggtaaatgttagggttacatcttctaccattggacatgtactcaggaggctgacacataaaaataaagagttcaaatgtagccttgcctaatgattgacatccaaatcaggctggatagcaagcatcatctctagggattttgtgaaaatctgaaaaacaaaaccaggaaccaccacacaacactcttcacaagcaccttacttggaaagtatgagtatacacagtctgatatttaaataaacagtggatgacagagatgatcagtatgcatgctatacattgggggcgggtatcaccaagtgaaaatgcaaaagaagatgaccaggatccacagaaggaatataacaatggcctaataaagttttgtgaatggatttgcctcacatacattaaaatttaaaatcggcttcaaataattcaaaatacaagctcccacaactattaatgatcacgagagacaactatgatgtttagtcttcatcaaaaggtcacatgaatagtgtgtttctcttgtgtgagttctttcctacatttacttgtgaatgcattcattcctgtcaaggcatctagaagcttacttacagaaattttctttatcgtgaatttgtttatgtaacagaaacaatactgcatgagtcacaagggtaacagaaatcatttcttcatatttgttagaagaggcaggcaaaatcctggacatatcacaccaagcttcaggtgccatgtgagaggatttattggcagaagcagcccctgagaatggtgagaggtcagaaaaagagaagggtctgtgggaagagggaatactcttttattcagtgcacaagaatgggaagcatgtgaaagggaagtggtgccatgttgggtgccatggcaacagatgcagcggaagtgctgttgcctacagatgaggagtgtcctcacagggtccagaagatggctgtaaagacacttctcgctgtccacagatgcacctgatgcacattgcttgtatttgtaggatttctcttcaatataaattcttttatgacatttttgtgatagtgaaagcaaaggctttactggattgattactttcatatggtttggcttcggtgtgaattcttttctttttgtagactctagagaccaggtttttttccatattgtgtcccagtctaatcttgtaggacatttgtctgagggaaatgcaaaggcagatacagattaatacattctcttttccttgggaatgtcgacataaaggaagcacaaatgttttatgtaaacttccattaatatgcagcattgataaaatgagtttcaataacaacaacaataaacagactccttaacagaggtggaatgctcctcatgtgcaaaatttaatatttgtaacccttgtgactcacgcagtactgttgcaaaatcatgttttgcacattagtaacactcacgaccctagtttgagaggctgaagtatgctcatgtcattatggacactttcagaacaattacccttatgtacattgatgcaaaatactcaataaaatactcaaatacggaagccagaaaacatcacaaagaatctatccaaaatgatgaagattgttttctcatccaatatatcttgaagagtttccattccctctactcttctcagttcctgtccacttttcatttgttctggatcaaaccccttttatgtctcttaataggaaaacaaacaaacaaacaaacaatgaaacaaaaaaatccatagactcactaattgacaaatctgccccccaaaagccaaagtaaaagttataatatatttcaaaagaactggtgcaggcattagtatttgtacattagaaattctagtctcaaatttctggtatatatttggacaattttgtgtgaagcattttgctgggtgttgataaagtatatgataaagtatattttctatgggtcattataagttaagatatcaaaaagctaaaatttcaaaggggtaagaaattttttggctcagctctgagttcattaatcagaatgaaagactatgattgatgtttactggataggtgatataaatgtgggcgtctctgcaaacactacttctggtagagtaacaatccatgagacaaaaaagaaatctagttctataccgctctgtaattatttccgcactggttgtgggtgtgttgtgggttatagccaatgaaattcctacagcactcagagaaaatttttcccagtgactgtgttaacatctgaagtaaaaagtctcctggtactcagaagtcaagataaactacaaagccccatgggacaattaaccacacacaagataatgactgggaagaacactggagggaggctgcctctgctcagatgagaagcagaagagaaatgggtgggaggcaggctttgtatagggtttagttgtaggtgatggattttcaggattggaaatatctgcggttggagattgctggtattttatgtcctgagcttgagcaaactcagggatttgtgagttgttaaaaccagtaagtatgctattcattctccctgtagacaatgttgagtgtaactttagattctgaccccagggtggctaattttaggaataattaagcacagtataattttggaaagaaatttcttggtaataattgtctcaatcctctgtgcacagtgaagatgaaagtgtgactacctcaaaagtcttttgcaaagtctatgtgagtctttcttaaagttggattctaaaactaaagggcctagaggaggatcgagcatacggtgtaaaggacaccaagctacaagatacatgtcacatctcttgcaaggctggtttgtattgcctgagaaacaatgatcaagggaagattgtctgggacaactttatagtttgggactttcaggtgttttgtggcaccacatctagcacagctcaccataccacttactacatccattccctcacttctgatcagaaaaaaaaagtgtacttcttttccactgaagagagagacctctgtggttttatattcctggctaccttagagcttatttttgaccacaagttccttttgctctcttcagaaaaaaatatattttatggatgtttatagttttaggatgttaatgttgtgttagtgtaaatagaaaaacagtcaaatatttttaaagaatataaattatgttgttctgacccatccagcaggtccagttattcgagggtctccaggggaccttctcctaagaaccaaatggggggagagaaaagaaggacacccagtgcgaggaacccttctgaataacatcaaggtgtcactgtattagcaaggtttaaggcttaaatgcacaagcaaaaaggggaagtacttctcagcaggaggaatggggcagcagaaatttttcttttggcgactaaacgggggaagcaggaacttggtgatatcagggtacatcttgaggtcaggacatcctgcactgacttgaggctggaacaatctgtggttgttctctgagcggtgcgttggtggcccgcttttgacccccttttcttttcaggggaagaggcccaattcagagatcaggacaattgtgttgtcttaatagctcccaacattgttcagatatacaaggtgtgattacattgtttgactctatagacatcaaacatgcaagtgctgctggcataatcccagcaatcagaacactggggcagatgtattattcttcatttggggtcagactattctaaatcaaagtgactttccatcctgtggtctccaatttcctcttttggcctttctgaagtctctacatgggttgaaattaattttctaaacttttatgcaggtgtgtctgtgtatttttaaatgtttattgctatattgctagagaactaagtgctagcaggatcttgatattgtcatttctatggcccatcaccaggcttacatttgtaaatacttgtctccacacctgctgagatatttgaatggcaggcagttttctatgcccattggtaatccacagaattctggagatgtctcacacctgattgcttgtaagaaaaaacgctaacatccaattcctgggacaagaattggagggtggaatttcttgatggaaaaagtgatgtagggaatagaaagcaggtggaagtgatttatgggagacagagaagagaacagataaatgggaacaggggcagagaggtaaagagcaagttacacataatgtcataggcttgaatagtctgaaatttaaatgatcattggtagactgctccaatgaaaggcctatgctttaaattatatagaaacctccttctcataatttataacactggtgtatccaccagtactcacgctacactcatgtacatatgcaatgtgcatatatatatatatatgtacatatatacatatatatataacacttttcacaagggtgctttgggtatttaagtcaaattagatattgattggttattcacaataaattcatgacatcattgacctagcatattttggaggaaggacaaattttagatcaatgtctttttggttggttctgtatatatatttcactttttgtagatagcaaagcccttcccattaccagtactgtggaacataaaagccaatgtgcttggaggcaccagcttgacctcttcacacatagtgagttgtgtaagtctgctccttagcaatgaagacttattgtcagtttgtaaaaagcaacacctttgttgtcaatgccatgcagtgtttgcttatttttatgaaaccactttgtagaacaactcagttgataaaacccagtggaaaagacaagatcaactggaactccatctctgtcagaattcagagacttcattagaatcaccttcatacacttataagctggttctttaaaaaaaaaattccaaatatcttactaagaatacagccagccgaagtccatggagtcttgtaccatggtgcttttctacgcattggcaggaccacaagtgtggcaatgcagtgtacaaaagttcttaccttctaatagacggtgacttttcttggaccttacaactatagttagtgcaacttgaagaaatttaagatttaaaactgcagttctactgtgtattcaactttatggtttagcttttttttttcaaagaacaatgtaaaaacaaacattattttccttgtatttcaatcaacttttataacctaatgtgatgccttggtgcaatgataatttattgatacaatggtaatttatgtactttttccaggcatgtccagaaactgcctgagtgtcatttgctgaaagcttgaaatgcagaggcttagcataaccttccaaaatgaatataccattatgtgtactgattgataaacggtaatgtctataatcacttggatccagttacctcatcctttttaaaattctgttaaagatttctgtatactatgccattccttctccatgtaatggggttttcttgatgttcctgaaaatattgcaaaggtctttcttaagaccggcaatggtgatacaaaagccaacagacatacatacacagtacacagatagacacaaacacggagacagaaggcagacacacaggaagagagagatacacaaggcagtattcagcaagttacagatttaaattaactgaatagacacacaggttggaaggctcagataagagaaagtagcgaattcaactttggactcacagttagttaaattacctctgagggaaaggctgttgattctttccttaactcagatgcattattaatcaccagtgtgtttaatgtattcacatatgcagaatcaattaacttttgatgtaatttttttttgcataagcacaatatgagaaaatataaaactcaccacaatgtgtaacaagtagccctgcattgtgaaaggtgtccatgggctcagaaccctgttctctaaagaaagaccatcaggtctgggcttgtgcttctgagctctcacttccatgctggcctagaatccattttaactctcaccgtcatcacaaagtttttgaacctcagaactcacaagagaatcctggaactcattacttttatgaaaagagttgacctcatgccatattctctaaggggactttggtaattcttgagtcttcttttcccagcctatgaagatatgcatgggtgtacatagagtattatagagcacagtcagggaatcttctataaacaaatggctaaatagtgcagtatgtattgtaggtctttttctatttccttccttccttccttccttccttccttccttccttccttccttccttccttccttccttccttccttccttccttcctaccttccttcctaccttccttccttccttcctaccttccttcctacctaccttccttccttcctctcttcctcccttccttctttcctttctttattctttcttttgacaaaaatctagacgcttattcaaagaaatttttctttattgcctcacccttcaagcagtaaataatattgtgcctaaacctaacatcattttaattcatcattttctttgactaaggtatccagctcctctaccttttgtccaagtctaataatctgtctttcacacgttctctatgagacattattatttgccttattgcattttcttttcaggctcttttccttgtttatttctaagcacatattgaactcaattttcatatcctatgttgtcctcctttccttcaggcttttgctattattctcttgcccacgaatcattttgttcctgtcctctatcagttgacatatgtggcttacacactttgatctctttgatcatgactctgggttttcaattctttacctaggatatcatgtaaattgctctctttataagatacattcacagttgatagtttgagcaaaagacattgtatcttagttttactttgttttgggtattgagcatcagaattcagagggactgcttattgtgtgcatttttagactagactcataatgtgagaagttaggcaggatctattgtatctgaaggattcagaacccagatgcagtgtcctactacattcagttctggtctagtctggcagtaaccttgtgggaagctgagcagagtagatcctgagaagttgtgtttccacaacagagttggaggagtggttcctgatggggagggtgggcctcctgaatgattagataagtttaagaaaaagacaaaataaaaacaaagaatcaatcaatcaaaaaaaaatcaatcaatgaattaaataagcaagcaaggaggcaaaaatccaaaccaacaaaaattgctctgaagaactgggaagctaattaattaaaaattcctgaaggaggtgggcttagaagaacatcaggaagctggtgagtattgggcgggtccagaaggagtggctctgaggaaccaagaggaagtgacaggaatttccaccattccagcattctcaatgtatctcggctgcctcgtggtcaggaagtcatggagggagactagtgcctagtgtgtggggaacctgaaaacttccttaagctgcagttgctgtgctggcctcctaggatattcagcagctggtcctgtcatctgccagatcagaggtgctgttgggctgggaaatgggtaggagcgggacaggtgtgtggagcaggggtgcattttctgttgccactcttacaattctgttgtggatatcttaccattatcaggaagtttgagttcctgtgaattgagtttatggtgatgttttaattaattttatggttgccagaatatttttctaaaacaaccctgtagatccttggccctctctggactttgtatactataccgggagggttgtctttgcaaaggccttaataaagctcctcgaattcaaattcgttcatgctttcttaactcccctgttcctcaatttgccatttaatttccctttctccagggaactgagtaggcatcccgagagcgctttgtaggtatttgtcatatggggaccagtacagatttgatcgaattagaaaatattccttataaagcaccatcatatggctgtaaatattaacattaaccaagcaaagttatagtctccgttatctgaacacagaggtatatgcatactttgatgtaaatacatcattgagaaatgtgtctacatatgctttgttattaatgtcacaccttaggtttgaataaaacatgaagacaggattgcagcaaggtacttgtgaggagaaatttccttaaggaaatgaggacaacataggatatgaaaattgaattcaataggtggttataaatacaaaagaaaagaaaagaaaagaaaagaaaagaaaagaaaagaaaagaaaagaaaagaaaagaaaagaaagaagaccctgaaaagaaaatgtagtcaggtgaataataatcattcatagagaatgtgtgtgagacagattatcagacttgtagatatatagtaggttctgttaaccctgagtgtcaccagagaaaaaccaattccaccatgtgggccagctttatcaaataatacatcgagaccaagagatatactttggtcaaatgctacaggcattttatagtccactgtagtttcctatgaggctttattattttcctaagacatgcaacccgcagcacttcaagaagatacctggtgaggtgaatttttgacgtttcagtctgagggagaaagcattcagagatatctggctggttccaaactgcaccaggctatcaggtggggggaggggaattgaggatgtgttggaggatagaggggcaggtcaagagataaccagcagccaagaaagcacctatccaactctgacttaattgatatgttaacaggtactccaggtagccattcttcctgaatttctttgaatttttccaaggttcagcccagcgtgctgtgtggtgatgatttcaggagtaggtattttaataagtggaaaatttactatggatttttttcttttctttttttttttttgttttttgttaattgtttttttcgagacagggtttctctgtgtagccctggctgtcctggaactcactttgtagactaggcaggcctcgaactcagaaatctgcctgcctctgcctcccaagtgctgggattaaaggtgtgccaccgccaggcttttactatggattaagacaaaattagacaacatcctttgaataatcttgatcacttacttactggattactgtctggattctgggtcagaataattttcttccagtcttccctcctcctcttctgtgttgcttggaaaaagactctgtatgtgtgttaactgtgtggctgactctcacatctttagggtaaactggaatactcggagaaaaataggtattctcatgatatcttctctttccttcatatttatccttttctctggcattgacgtctttcatttttgttccatgaacagttccatgttcattctaaactatatttcctcactttcaggtctccatatgctcagtcaaatctccataactgtaaatcaacactaagagcactggatagttaaggtcaaggacactctcacaaaggatccaggtatgttagaggtattgaacaaggggtggagtggggctcacctgtcagtacaaagaggacatgaatttgattttgccagattctatttccttaatgattctggaaaagaataatactagatgtgatgatatggatttaccatggaaggcaatgctgtcagctgtcacttgatgtcaatatttaattaattttaatcctgggaaattgctgctgcccattgaaatcaaagtttcttttatccagattgaaagcagcatcaggctatgggtgtgacaagggcaatttatacataaagcaaatatcatcagtagattccctcctagggcctgtgaccttccttttcggatttttaggcagattttcactgtaatctatggattttttttttcctgtggagcttgaaacagaaaacctgttacccacagatagtcttgccagtatcataaaaatttccatgccttgtctggcagattcagattgcagcaagtaggttgaaaacctgagtatatacattgataactctgcttcctgccccaatttgcctatcagtttttgttactatggaagttaccaccagcgtgtctaagatgtctgttgacagtgtctgatatgaggtggttttctccagaaggtctacttgctttctgaatcacctattctgtccactctaaatgttttcctgtccttgacctgtgttcttattgatgttctgtgttgcattaatccccattagagtggaataattatttttgaccttctctgtcctgtttgctttagttttgagtctgcttgccttatttctgtggtatgcttcttctcttatattcttgagaacttttatactgagcagtgtgtactttttaccacagggctgtataagtaagtttcattctcctattgtcactgtaatttgggaggattcctgcctacatctattaacctaggcctagtcatgtaagcttctactctccatacagtattatctaggcctgttgtgttttcagcctctgaaacttgctgctgaaaaagcccctcctcccccaccttcttattccttctcaatgtttacctggctgattcaatttggtttttccagctcaaactcctctccgagcagagttcttctctcagacactgaattgttccacttggaattaaattaactgtagaagtcttttctcatcttctggctccttctctttctcctgctcattctgtctttgcctgtgcctagcatgttgtctcttcagtctgagtctgtaaaactctcagaacccaggtgcagtgtcctagtacatccagctctggtctagtctggcagcaacattgtggggaagctgtgcagagaaattccagagaagttgtgtgaaaggcagcctgcaaccgagttggaggagtggttcctgctggggagggtgggcttcatgcatgattagataagtttaagaaaaagacaaaataaaaatgaagaatcaaccaaccaatcaatcaatgaattaagtaagcaagcaattaaaaatccaaaacaataaaaattgctgtgaagaactgggaagctaattaaaaaggtcctgaagtaggtgggcttagaagaattgcaggaagttgctgaatattgggcgggttcagaaggaggggctctgaggagccaggcagaagtgacaggaagttccatcttttcagcattctccttgtaccttggctgcctcatggtcaggaagtcctggaggaagactagtgcctagtatttgcagaacctgaaaacttccttgctgacctcctaggacattgagcagctggtcctgtcacctttcaggtcagaggagctgttgggctatgaaatagggaggagcagggcaggcttgtggagcagggtgcattttctgtcgctactcttcacaattctgttgtggatatcttactattgtcaggaagtttgagatcctgtgaattgggttcatggtgatgttttaatcaattttctggttgccagaatatttttctaaagtatccttgtagatccttggctgcatctggagtttgtataccgggaggtttgtctttgcaaaagcctttataaagctcctgtaattcaaattcgttcatgctttcttaactcccctgttcctcaatttgccatttcatttccctttctccagggaactgagtaggcatcccgagagagctttgtagatatttgtcatatgggcattggtggagatttgattgaattagaaaatttacattataaagcaccatcatatggctgtaaacattaacattaacctaacaaagttatagtctccattagtttcacactgaggcatatgcactctttgatgtaaatacagcatccagagatgcatcttcatagtcttagttattaatgttacaccttaggtttcattgaagcatgaagacaggattgcagcaatgtacaattgaggagaagatatatagtaggttctgttaacccttagtgtcgtcagagaaaaaacaattctacaatgttggaaagctttttaaaatattacatcttgaccaagagatggactttggtcacttcctactgccagttttatatgccctgtcgttttctgtaaggctttattattttcctaagacctgcaacctgcagagctgcaagaagatagttggtttttgggctaataattgggttcttgggtggggttaatttttggcatttcagcgtgagggagaaagcatttagagttatctctttgggtccagactgaaccagttcagcaggtggggagaagggaattgaaaatgagaaggagaatagaggtcaggccaagagttaaccaggagccaagaaagcaccatcccaatccctgtcttcattgatatgttaatagttaccccagttagcctttcctcctgaattctaatcctcccaggttcagcccagcatgctgtgagaggatgactctaggccaagctatttttataaatagaaaacttactatggattaggacaaaattaaacagcacctttaaaataattataattgctcactttcttaagaaaaatgactccttgtttcatgaaaagcactttgcccatacacagtcatggtttgttgagtgctacactgtggacttcttgcaggtgtggtaattgttagaccctgcattcagggctttttcagagatctcttgttggagaagttcaacagtttggatcctgcatgtcataatagttttctcacattcttccttgttcctcagtgtttctgggaaagggactctgtgtgttaactgtgtgactgactctaggtaaactgaaatcctcagggaaaaagagacattctcatgatatcttctctttccttcatgtttatcctttcgcctggtgttggcctccttcattttttgtcacatgaaaaggtccaggttcttttgaatgatattttcccattttcaggtctccattttctcagccaaatctgcataaatataaatcaattctaagagccctagatggtaaaggccaaggagactctattgaaggatccaggtgtgttagaggctttgaacaagggctggggtggggctcacctgccaggacatgaatttggaagacaaagacaaagaggacatgaatttggtcttgacagcttctgtttcattaatgattctgaaagatttcactaagaatattagatgtgatgatatggatttcccatggtaggcagtgctgtcagctgtcacttcatgtcaatatttaattaattttgatgctgggaaattgctgttgcccattgaaatcaaagtttcttttacccagactgaaaacagcatcagctaatgtgtttgaaaagggccatttacacaggaagcaaatgtcagtcttggattccctcccagggcctgtgaccttcctcattggattttagccagattctctgtttagtctatgtatgtttctcctgaggagccggcctcagcttgaacaggaaagccttttgttacccacagatagccttgccactatgatactggaggccatgccttgccttgcagattgagattgtagcacacaggatacaaatctgggtatggccattgataactctgcctcctgccccagtttgcatagcagtttctggacactgaatgctaccaccagagagtccatccacaatatttgttgacagagtggatggtctgatctgagttgttcttctccagaagatgcacttgctttctgaatcacatcttcggtccagtctacacgagtttaagtccttgaattgtgttcacactgatgcagtttgttgaatttggccttattttattgtggatgccaacaagagcttccttacaggaggctgatatagctgtctcctgagaggctctattagtgtctgacaaatacagaagtgggtgctcacagtcatccattggacagtgcagagggtccccaatgaaagagctagtgaaattacccaaagagctgaagtggattacagccccagagtaggaacaaaaatatgaactaaccagtatccctagagctcctggagactaaaccaccaaccaaagaaaacacatggtgggactcatggctctagctacatatgtaggtgatgatggcctagatggtcatcaatgggaggagaggcctttggtcctgtgaaagttctatgccagagtaaaggggaacacctgggccaggaagccggagagggtcagttggttagcagggggagaggcaataggataggggatttttggagaggaaacgaggaaagtggttaacatttgaaatgtaaatgaagaaaatatcaaataaaaaaatgaaaaaaaaaagggtggaataatgacttttctgccttttctggactgtttggtttagtttcaagtctctttccatttgttttctgaggtgtgtttctctctccttacattctagaaagcttttatagtgagtggtattagattttccacaggactgtaaaattaacctttattctcctattataattattgtctgggaggctgactgcctctgtctaattaccatggcctagtcctgtaagcctctagcctctaagtaatcttatttagtcctagagtgttttcagcctctgaaatttcctgctgagtaagctccccctttcttctttgttcatttcaaatcctttttttttttttaattttatttttttggtttttctgacagggtttctctgggtagagtccttgctgctctggaactcactctgcagaccaggttggcctggaactcagaaaagtgctgggattaaaggcatgcaccaccactgcccagcctcatttgaactcttaactggatggttcatttcagctgttcaggctcaaactactcttccagctgactcattcagcctggttctcagacactgaattgctctgcttggccttaaattaactgtagcaatctcatttttaaatcctctggctccttctctttctcctgctcattctgtctttgcccgtgtctagcatgttccctcttcaatctgagtctgtaaaactctcccagtaaaactgtgtccttctccctctctgtggctctactctctcaactgtactgtactgcagcccatccactctactgtattcctttaccattctcttcttcctgtactgtctttctctcccttaagtagcttccccttcctctctcacctcaggagtgttgggcatatcctgttctctaagatctttctctgatatttcacattttctgccattcaattagacaacactttcaaacatgtgcacctccttctacttagtaaatgtactttcgttgtttgggattagagcaaatcctaaaggcttgcttgtattccaaccacagtgaggaaagctgtgtgccttgtgaaccacaccctaagtcggaacaggcttgaatatccctacacaatagtttagtttggcagaatttcttcctgaactgaaaaccaagattcacaaataatagtcttcattatgtagatagctgtgctatctattctgacttctaccaagagtttcattttgaacttctttgctgattggtcaatgaaaatctgttctttgcgagactgtattccttagcatttgcaatctaggtttgcgggcattgtaagtggcaaaaatatggttcctattgtctccattctttgtatgagagagagctttactatgtaggacatgaggaatatttcctacttttcttatattcattcattcttcacaaaaaagatgtgttattcccaaagttctaatgaaaatgttatgtcttattcttttgtgcatattttcattagtttattttctatgtaggtttttgagtaaaaaggtgtctaaacttatatatactaagttcaaatatatgttttacactgtcaatacttgtagccacttttctgaatttaacattacagttgccagttattttctctcaggacttgaaaaatatgattccatgctctcctgattttaagctatggataaatatttagtactactgtatgctaatataatatcacctcttttgatggtaagggctaggacaagacatctggaaagagataaacattgttacagcacttggatgtgacaataggcagatacaccagagagtacaggaatccaatatctgagagactttcctcgggaatgtgaggctagaatgctatggccttctagtactcaagagtcccaatgtttgcacactgcatgttgctatttgagtttatctactgtaaaacagatgtgatgaaacaagtgatagtaaactttgactggaaggctcaagcatttggaattgtgtctattcagaatcaggtatgtatttgaggaaatgtcagttgcaagatttaaagtcgaagccctagtgttcatattgacttcatggtggaagtaggtaaacccatgggttattcttcccattctagaatgagctcttgttcagtctccatgaaatggaagatgtgcttttcctgttatacaattagacaaaacaattccaggacacacatttattttatgtatttcttccttttgaacttaaagtacagcatctgtcactgaagcaggaatttatgttctgttggtggtagaaatgacaacgatactcagcctgtatgtcacaggtaagagtcatgaagtgacatactttgaaaaatgtcctcattactccctgaaaattcatgtattcctatgcccattttttaattatacacttgatgctgtctgtctacaaatgcccagggcatcaagttttgagtattgtaaatttatgacagcaatgtatttttccctgcatctccaatttctgttttacagaaattcctgttgtcagtaaattttccatcacacggattacggattatactcagttcatgcatattacaattgttagaatattcacagagaaacgttctggtagaggatcttcattatctggtttctttggtattgcagatattacaaagctcctagagttcactttaatctgtgatctctaaatcccctagtgcttgtgttttcaggtgaatggccttcgcacatgacttgccccagagtgcttgccaagttaacatctcttctttccctgtcccatcccttgttattcatgttttcatcctatccttgtgtttcatgtatgttctgaggaaggttttgaatgggtatccatgctgtcgtatattcataattccatgttccatggtatatgacagcatggatttccataactccacttcctccttcttttacagtgttgccttttccccactgctggctttttattcagctctctctgaattggcagtttccctctacaattcatgtttgtttgacttaggctgaaaacaccaacaatttaaatgtatttctgtatttctacatatatcagtgtgtcagttaaaattcacttttgggcctgtgatatttagagtgacttttgaccagcttccagtgccatgtctgtatttcctttgtaggctgacctcaattcaaagcagtaaagtttctttacccacttgtcactactacactggtcgacatacattgtcagacaggatggtattacagcacaagggtcagcatctagggagaaccattaatgacaccttacacccatcagcctacagagccccttttagcagtttgtatgcaaaaccagtatatccaagatcctttagacactgaatggtcttctgacttctcagattattctttaggaatgtataaaaccaagtcatatttttcttgtatttttctgtagcttattaaatatattatcagattgaattattctctggggatattgccagctcttgagttgaagtattatgtttcttgtaatgtgagaatatgtgccttccttgtatccttatttgaacattaaaatattctaagtcttacttgctctttgcaagcattgctgcactgagataagttagtgtggaggctttgcacatccttgtctgtcttctgagtagagtagaatgatgacagctgtcttcagtatgtgtagtgataggtttatgatgttggctattatcctcattagactcagtaatgttccttctgttccacattcttcagagctttcatagtgatccactgtgatattttgccctaggctttcatagatatattgatatatatctatcagtgagctttctcccactgattatacatagtttatgccttgagttgtttgatttgtacttgctaaaacagttttgaatctctgtcatgaaatcaagttgagtttactttctgcatctattagagagaaactttttaaaagttgccctgtagcacccatactgttattattttctgtgcgcatgttttcgtggtcatttgcttttggacccaggtaaggtcagctttgtgtgatggctgtaccatattccccttctttctgtgttctgcactgttttctgggcaaatttcttgtgggatttttcagaagacatttgtgactttggtgcagcatttgattattcctgagaaagtgctagaaggaacactgagagcctgggtttctgcacttgattattccctagcctagtgtttgttgttcctaggaaatcaatatttccctcgtcaattctcattcattttctgactttccaaggtactttataatctgctttttctcattgtcaatgcatacttctgaggccagggcgttgaaagagatcattcatatacctgttaaatgccaagagaaatatttgacatgagagaaatataaggtcaaagaaatacataaaaagcactgaatatttgctgatatcatgtgtccctgtgtctctgaatctcgccggcaagaacacacacacaggacaaactcggatccttctgcagcaaagctttaatgcatctcgagagatagatgatcagcttctggggaggaggagacccagagcaccggaaactcggtccttttatagaccacgaagagcggttggagatgtgccttgccctgattggctgctcaccatcaacccagatgatgccacgggacaggcagggcacaaggaatggaaaaataccccagcacatgcgcagactacttgtttaccagttagaacaccgaatgtcagcactatcttgtaatggtgactgcaagggcggctcctcacaatcatggtcatgacaactttcttcagcaatagtatctccatgttcagaatgaattcttatgtttttatttatgcataaacatatgtatgtatgtgtgcatatatgtgtatgtatgtgtattggtatgtatgccaggagaccattatcacacattctttctttcatgttaacctttaagagtggtggctagagatgaaatctgtaacagctaggctccgaagagtgtcattgcattcatatttattactgattgggaacctcagaactgcctggaacaatgccacaatgcagatacatgcttgttgaggatgatgttccaacggtgatattatttaacagatttgatataaggagggaatccttccaagggcataccctcaaatgattcattttatctctgtgcatatatattctccctggcagccatcagtgagtttctaccatgtcttctccttgattttgtatgtcaatatattttatgaaatatgctctcaacatgaaatataatcatagtaacactattcataaaattgcatatgaagttatatacaagtcaaatgtcatttttacactaaagacacttaacttgattatttttaattaaatttataaaattttttccacaccccatcccatcccttctccccttcctccaagaggatgtctgcatgccccaccatcccaccaggcctccccaatactacgtgcatcttctttcactgaggtcagaccaggcagtcatccactgtttatttgtcatggtcttcatgtcagctgctgtatgctgcctggttgttggccctttttctgagagaccttgggggcgggtgtcccgttcagttgagactgctggtatatggatggggccaccctcctcctcacctccttctggctttcccccaaatcaaccataggggtcattggcttccatccattggctaagtgctagaatctgcatctgactcagctgtttgttggacctcttagagggcagccatgctagcctcctgtctacaagcacaacacagtatgagtaacagtgtcactgctctttgcctcccctggatatggatcctaatttgggtttgtccatggacctcctttctctcatgtgcttctccagttttgtccctggagatccttcaaacaggaacaattgcaactccatcactccacttgaagctggacagcactttatccaaagtctctccctttgagtcctgggagtctctcacctcctaggtctttggaacatgtgagatggacctccatagcctacttgctgaggctgtctatttccatttttttctactgttcctcagggcttcagtcctccccctatccctcataatgtctgatcgtgtttccccttcccttctctgtccctactcccactcaggtccctccctccttcttcacccatgactgctttcttctctctcccaagtgggattgagacatcctcacttggaaccttgaacttattaaccctctttcatcatttacattttattatatactttttttggctgatatccgtttattagtgtgtacatactatgcatgtcctttctgggtttgagttacctcactcaggatggaatttcctagttcaatccattttcctccaaacctcctgatgtcattgttcttaatagatgaataatattccattgtgtaaatgaaccatatttcagtattgattcttccattgtggggcatatgggttgtttccagctcctggctatcacaaataaggccactctgaacatagtgaaacactagcccctgtgtcatggtggggcatcttttgtgtatatgcccaagagtggtgtagctgggttttcaggtatatctatttccaattttcttaggaatctccagattgatttccagaatggttgaccagtttgcaattccacaagcaatggaggagtggtcctctttctccacatcctggccagcatgtgctgtcacctgagtttttgatcttagccattctgattggtggaaggtggaatctcagtgttgctttgatttatatttttctgatcactaaagactttgaacatttcttttgaagtttctcagccttccacagttgcttcattgtgaattctctgtttaggtattgtactggctagttttgtgtcaacttgacacagctggagttatcacagagaaaggagcttcagttgaggaaatgcctccatgagatccaactgtaaggcattttctcaattagtgatcaagggggaaaggcccttgtgggtgggaccatctcagggctggtagtcttggttctataagaaagcaggctgagcaagccaggggaggcaagccagtacagaacatccctccatggcctctgcatcagctcctgctccctgacctgcttgagttccagtcctgacttcctttggtgatgaacagcagtatggaagtgtaagccaaataaaccctttcctccccaacttgcttcttggtcatgatgtttgtgcaggaatagaaaccctgactaagacaggtatctaccccattttttgattaggttgtttggtttcttggtgtttaggttcttgagtcctgtacatattttggatattagccttctatcaagtgtggggatacagaagatttttttcccaatttgtaggttgccactttgtcctatttactatgtcctttgccttacaaaactatctagtttcatgaggtcccatttttccattcctgatcatagagcctgaggcattagaattctttctaggaaattttttcactgtgacattaagtttgagactctttttctactttatcttctattttattgattctatcttgttttatgttaaggtccttgatccacctggacttgtgctttgtgcacgtttatacaaatgtatctattttcagttttccacatacagactgtcagttagaccaacatcaggtatggaagattttttcttttatccattatatatttttggcttctttgtcaaagatcaattgtctgtaagtttgtggtttaattactaggccttcaattgtattccattgatcaatctgtctgtctctgtatcagtacatgtagtttttatcactattgctctgaagtaacctgtaacgtttacaaaaagaaatgaagtccactgttttgtaaacatagcagctcctatgtagtttgcttgggtgtgctttctggttgctaaatctagatatagaggctagttttaagtgagaaattacctttctgtttttcagttccttcacagactaagtttggctgtcctggaaatatctctctggatagatcttgtacacttaggtgtgtcttgctctgtctcctgaatcctggagttaaagatgtgtcccatgatacctggacctaacattttcctcattagaatttgatctgttccaggcttttcttggactttgaaaactgccttcattttcaaactcaaaccagaatcttaagtgggtcaaattttgtctgagatcatcactctctcacttcctggtactcctttattcctcacaccatgagccttatttttaaaccatgcctttccctttactgactcattagtgtagctacctctgtaattttaggtacttcgagccccttatacaaatcatattgcatgtttatattttggatagttgagaaatgttgggcagtgagtgcagggaatttaaagggaatcccatgtcccaccagagctccagtgctctgggcaagtggacagcactctctatgaggcccaggtgggtgtctggccgtgggaagctatggatctccagtcattaggggtagagagggagcagtttgtggtgcatcacacaggagtcagacaaaaatcataccttgttttgtgtgtagaaagaattagtctgtgtttcttttcatgaacagcaagtgccctttacccctgagtcatctctctagcccagaggtttacatttctgctacagttttttttttaagatttatttattcattatatgttcgtacactttagctgtcttcagacactccagaagagggagtcagatctcgttacggatggttgtgagccaccatgtggttgctgggttttgaactctagacctttggaagagcagtcgggtgctcttacccactgagccatctcaccagcccttctgctacaattttatgatagaacctgaatataaccctgagttctattttttgtttaaaaatgaaggaagagtcagaaatgatagtaatctgtgccacccataatcatgttagatgaatgagctcaaataaaaagataagaatagtgatcaagtcaaagaatcataaatggttctgatccttgcagtctataatcatgttagatgagtgagctcaaataataaatcaaagaatatttctggagtcaaaagattcagactttaagttggacagtcatagatttatgagcaataatgtatccataattaatgacaaattagtataattcttatacaacttaaaacgttcctttccattataaaaaaacactctacattatcattgtgttgtcacataacccatttatttacaaatatacttctaactattctgaaggtaaacctgtgtggaatttatgaaattattatctgttttgattttgtcatgtattagaaaatggcacatgatattaatgctatgaaatgttttgttttgttttgttttgttttgttttgttttgttttgttttttttctgagacagggttttctgtgtagccctggctgtcctgtaactcactctgtagaacaggctggcctccaactcagaaatccgcatgcctctgcctcctgagtgttgggattaaaggtgcgagccaccacaaccggcttaatttttctatttattttactaaatatcctcaaattaattgttcaatacatatttcaattcttcatgaaaatatgcttatggaattggatcacaaggtattttattctatgtcttgcttctaatggtggttttatactctgattttacagtttttatctgcttagatacaaagaaaattatttcttttaagtaatccttgaatttttactccctactctatttctttggtctagaaaggatacagcattgtatataggccttaggatctcaactgagcattttagactagagtctagctgttgacacccaactgcatacaggatagatacagggtccacatttgatcaaagctgacagttgtagatttttttagtcaccatcatttataatctgagatgtgatactgtgatcaatattgttattaaaaactgttcttaaagatatatataaagtgttcttaaagatattcctgcatccagacctcacatgtatactttattatgtctcagtatttgctgactgtgaggccattatgtcacctactcgttcctaaaacaagaagacacaatatacactatgatgattttagatgatatcatttcttaaaatggcctcataattcttatgacctaacatatattctgttcttgattagcttccagaatatgacatgatttgttttcctctgaaagggaaccttaaatccaatcataatatgtttttctatattttcgtctgatgctttcctaaagcactatgatcaaggaaagtaatagaagaaaaagaccactttgggtaatgcttccagaggataactatccaccatggtaacgaggcctgacagcaaataaccatgtttttgaaatagacagctgagagatcacatcctcacctccagtcactaaggaggaaaagagaactaaggtggctttggtctactgtttttctcagagcctaccaccagtttcattctttattcagtaaggttccacagctaaattttttaaaacattgtgaccaactggggttccaacttcaaaagggagacatactcattcagaactatatcggcagtcttctaacattctttcacattttagccagttttgatatcaacatagtaaatataactttaatttctcgtttgggtttcctgtttggtttgttttttggtttgtttgtttgtgagacagaatctcactctgcagacttaactctcatgtatcctgatatagatccaggaatggcttctagttcacatgaatttgcctgcctgagcacccacagtgctaagatgaaagaccttcccccactgtattatgcttgaatcaaacatttatcttttaatatttctgctaacatgcaacaagaattttgttcatttgtgtcatctaggacttacttgattgagctagctccttcagcttccattggaacattgatgtttgtcttctgcatgctctatctttgtgaattggccctccattgagttaccatccggcttagagttcatttctcatttcattcagattgaggattccttagatgtttatatgtctggatgcaatatcaacatcctgcattatcaaaattatttccttagccacttgcaggggttctcttgtatttcattcagttagttcctgtcctctttgagttcctgtgcttgtttcctctttatgtccgttgacctcattgaatggtgttcaaattgtactttttgttctgtctcttgagtttgtttcatcattcttcttgtcatgagcaatggtattgcatttttgatttggggtaggtaagttctatcaccattgtcaaattgtttttgttccagcctctcagtttccttttgctgtgtggcattaggtcagttggcagggatatccatatgagatgttatgtttaatcattgaaaatctgagatggtggacaggaacttggttacagcttcttactaagtccagttctgttctatgcaggtagcaaacatgcattgttgtagagcaggccttgaacatcctggcagctatttggaagtctgcttgagcctgagtgggaagaataggtctgggtgtgctgtgtaaaattggtttggtgaatttcctagtctgcgcagagttagagatgaaacataacctcaagcacagacattttgggttgtgcttgtagagtctctttgccctcaaagtcttgagggacttaaaaaagaatctctcctgaggaacgtcgaggatcctcaagctctgcctctgtctccagagtgtagcgaatcaaatcctgagtctctatgcgcagttttgtattcattaccaggattccttatcaaactttgttcatatgtgcatgctgtgtatgaattaattttgtgttagatggcgtacagtgaaattctgaaaatataaaaaacacttcatgggaaagcgagagccaaaagggcactgggcaactctgttctttgcagaggaaaatcaactaaatgtgggcaaaaagatcctaagaagctgagaggcaaaatgtcctcatatgcattctttttgcaaaccttttgggtgtagcacaagaagaagcacctggatgcttcttcaacttttcagagttctctatgaagtgctcagagaggtgggagaccatgactgctaaagaaaaggggaaatttgaagatatggggaaggctgacaaggctcgttatgaaagagaaatgaaaacctacatctcccccaaggggagaccaaaaagaagttcaaggaccccaaagaacccaacaggcctccttcagccttcttcttgttccattctgagtactgcctcaaaatcaaaggtgagtatcctggcttatccatttgtgatgttgcaaagagatgtggaacaacactgcagtgtgtgacaagcagccgtacaagaagaaggctgccaaactgaagaagtgtgagaaggatattgctgcctacagagctaaaggaaaacctgatgcagtgaaaatgggggtggtcaaggctgaaaagagcaagaaaaagaaggaagaggaagatgaggaggatgaagaggaagatgaggtggaggaggaggaggaagaggaagaagagttagatgaagaagaagatgatgatgaataagttggttttagcagttttattttcttgtctataaagcatttaaccccctgtacacaactcactccttttaaggaaaaaaattgaaatgtaaggctgtgtaagatttgtttttaaacggtacagtgtctttttttgtatagttaatacactaccgaatgtgtctttagatagccctgtcctggtggtattttcaatagccactaaccttgcctggtacagtctgggggttgtaaattgacatggaaatttaaagcattttatggttggtgcacagcacgtattagttatatatgggttcagtagtttgggtttttttttcttttggttttatttttgtgtttaattttttttttatcttcagttgtgtctgatgcagtttatacaaagataactgttgttctgttaactgattaccactctgtaattaaaaaaaacttgcggctgttttgttgacattctgaatgcttttaagtaaatacatttttttttattagtattgttgtccttttcataggtctgaaagttttcttcccgaggggcagtcttttgcttttgcccattttgggtcacatggattattacagtgtgtatcttttcatctagttagctggaagaaagctttggtccacagaccctgctattgtggtaggggtaacattttcatccatagttgaagaatctcctaaatcgtcaccagttggataagagatattatataacctacttggcaaagcaaggagtggtcaattctgtcacaccgtgggattattagaatcaagcaatctgaaagtttgtccttgaacactaatagaaaagtatgttctaatccttacgggagcactctcctttaactgccattactatgtatattttgcagtttcccctactaaagaagacctgagaatttatcctcaaaaaatacaagcttaaaatacaagagtttaaatacaagactgtcgtactatttgttgaccttagtcgcagcgaaggctatcacaagaatgctggctgtaatgcctttgcccatctatctaaatacagattgctcaggaaacttgactgtttaaaggtgtttttaattagttgagtcagcttttaaaattatgccacatttaatatgaagggtacattttcctatattgtggtttgtccctttataaatcagatataagggaagaggataaactttgcataatagtagcagtggcccaatccaattgctttttctttataaaatccaaactcattaattaatcatgtttaatctgcaacattttggcagtttgtgggttgttttttgagattatcattctcttaaagtgtcagtgttttaaaatagcgttcttgtaattttatgtgcttttgtgatggagtgcttttatataattctgacttgggttgtttacatttgcatttgttaatgtaatttgaggaggaatactgaacatgagtcctggatgatactaataaactaataattacagaggtttaaaaaaaggaacatttcaaggaagctatggtgtttttcttaatgtgtgtccttttagaagttgttagactcctttcattgttgttccatgattaattcagaaactgagcagggtaaaatattatcaccattaacttaaagattctctatgcctctgagatttgagtgatctctgattagaagtgggtctcatgatatccaacctaaaatgctacctaaatatcagtcttaattgtatcactcttaggaaagtgtttctagtattctcaatcttttctttttatctactgagaacagtactatgttagaaattcaggtcctttctgaagattgtcaatcatatgtgtgtgtgtgtgtgtgtgtgtgtatttacagtgattcaggattttaaatcataaattcttcaatgtcaaagaatttgacaagaacaaagattctgcttgtttattaatgcaatcataccatcattgaaaaggttaaatgaaatatcttccttttctattgtatctgttttctttgtgtttttcaaatgtttgtagctagttgttttctttcatgttttttttgttgttgttttcttgttcttttatgaatatgagtgttagtctgcattcctgtctgtgaatcacacatgtgcagggtatgcagagtatggaagaaggcattgaatactctggcatgagagctgccatttgtgtgttgttatgagactccagtcacctggaagaaaacacagtgctcctaaacagtaatcctcactccatcccctgtaggtagattagaaatatattaagttcagttgagaagactgtgaacctttgtcttgttatgctatctgtttgtttttggacattttcttcttcctgaactgaaaaccaggattcacaaatagtgcagttcattacatacatatatgtttcattgaatctgatttgtagtagggattttatagtgaagtttttagaggatgctgaatgaagtaatgatatttctgagattttattccttgggatttgtaatctataagatgtttcttgcattgtgggttttatattatatttcacattgttctccattccttatatatatatagctttcctgtgttgtacttgagttctattacattcatttattccacataagaattttcttatttcctgtgcgctcatagaaaatttatatctacttcttttgtgcatattttcatatatttattatctaagttggttcttgactttaaaacttgtcttaatttactacattcacgtgttccttaaacacagtcaatatgagtagccactttttcagaaagtaacactagagtttgcaggcattttcattcagggcttgaaaaatgtcattccctactctactgattttaatcaatgaataagcatttattagtactgtatggcatcacaatgtagcccattttggtgataaggaataggacaagacaactggaataagatgcacattgtttcagcacttagatgtgacactatctgggtacatctgggagttgcagaaccaaatttatagagacattcctcaggaacactagatgagtgttgggaacaaaataaaaagggggggccctgcggaagaatggaaggaaaaagatgcccacaccccaccagagtttccctattctctggtcagtcaggtgtaggaggactgctatctaccctattcactcatccctgggtgggtattcctctatcccactcttcagggggtggtcaaggggaaggcctacctggggaccccccccagctactttgctaaagccagcagggttgtgggagagagggaaaagggaagaatttctcaacactgtccacagtgcccagcggaactttaaggagcagagactctatggtttaagagctttattagagaaatgcagggggaaagagagaagggagaaggagagagagagagagagagagagagagagagagagagagagagagagagagagagagagagagagagagagaggaggggagggaggagaaggatagtagaggagaggagagaacaaagatagagagagaagacaaagagaaagggaaaagaagagagaagtgagaggttagaggacaaaggagtgagagagagcaaggtgggggctgagcacacctttttatggtcttcactgttgctaggtaactggggaggagtttagcctgaaggacagaagcttgggccattgcttacttgactactgaccatgcttctcttgtgggggctgtgggaggttgtgccttatgcaggggcctgagttccaggagcatgagggaacgcctactgtgtcatgtaggtgaattatgaccaccggggttcagacctcagctcgactggagaccagcctgcaattccccacagatgagaaggttatggccttgtctgaccaatacatatagctatttgacctttgtctactttaaaaatatttgatatagcaagtgatagtaagccaggcggtggtggtgcatgcctttaatcccagcacttgggagacagaggcaggcggatttctgagttcaaggccagccaggtctacagagtgaattccaggatagccagggctatacagagaaaccttgtctccaaaacaacaacaacaaaaacaaaaagcaagtgatagtaaattaactggaaggctaaaaagtggacttatgcctattcagaaaaaggtgtgtattggaggaaatgtcagtttcaagttttaaagtagaagctgtattttttctggtgacttcatggaggaagcatgtaaaaccatgggtgcactggtagacatacactgtcagacagacagtttggtatttcagaacacaggaaaagcatgtagggagagcgatcgactccttacgtctagcagacaagagaggtcttttattagtttttatgttacagcagcatatccaagacctttttagacactaaggggtcttctgatatctcagattattctttaggaatgtataaaaccaagtgatattttcttgtattttcagtagcttattaagtgtattatcagattggagtgttctctttaaatatttgtagttcttgagttgaagaattatgttccttgtaatttgagaaaatgtaccttctctgtatccttatttgacacattgaaaatattccaggtcttatttgctctttgtaagcactactgtactgtgaaaaggtattgtggtggctttgcacatccttgtctctctttagaaaaaaggagtagaatgatgacagctgtctttatcttttgtagtgagaggtgtaggatgttggctattatcttccttagactgaggaatattccttttgttctcaaaatacccagagctttcacagtgatcccctgtgatatttttccctaggctttttgtaactatatcatggttatgagccctctctcactgtacatacattgtgctgtgacttgttttgtttgtgcctgttgaaatagtcttgcatctctggcatgaaattaagtagagtttcctttctgcatccacagaaaaagtctttgtttaatgtactttggtgcactttgttacttttttcattgtacatattttatggtcatttttttgggaatacaaataaagtcatttttttgtgaggagtctacaacatacccctttttctgttttctgcaatatactttatgcaatattattttggtgttttctaaagcaacttgcgaattcagtggtacatctatttagttcttacgcagtctttgaagaaacacttgggacccgagtaggcttttttttattacatagcctagtgttatgacctagaaagtttacttgtttctaagaaatcattattttcctcatcaattctcattaattggcatccactagccctttgtctttgactctagtccagaaatattagttttcagtaataaccctgagtatcagtactttacagcaggtatccatgtgctctgtgtttgtgcctgatgactcctgaaattagaaatcatcctcagattgtactcatactctttatcagtcaaaatgtatcatgtcggtagaaacattggcaagagccctggtattactttgctttatttgttttttaatgtggtttagcattgtctctaatggcatttcatttatttcattgttcaatccttgatgtgaaatttaagaagaacttgaatgtttgctcctcaccaagaatctgggagaagaacaactaaaagaatgagtgcttctctggaaaacactgcacaggtcagtatcctgtcttcatttcttttttaaatcccttttatattcaaaacattcaaaagttctatcatatgtatgtgtaatattacctaggaggattattttctatgctcttcattttcctttgtgatgatgaaaatataacaatttggtttctcatgtatacaatagctttatattttcactggtatgtatactatgaagacatgtaattcccatagaactgtaggtgtcaaagagcatctattggaagtgatgcctcaaaaatatattgatgactatttcctatgtttgataaggttatatatatccttttatattagtatggaggaagtaaggtttcttgtcacacataaattgcacttcagggatattcaggtttccagacacaaggctatgaatgtggatatggaaatatatagaaactcatatcagtaagcaacacatatcagagtagaatttgtaatagagtaaaattatatgaggcccactgtcttgaatcctaataataagtgtatcagctccctagaagcacagatgatggaagggaattatctctcattttgtctttgatgtgattattagctgatgcagatttcagtattctgacaattctttttaacattttaagtcatacagtactcattgaagtgttgacacctgaaatatgacttgagagatactattcccgagatacatactcaatgtagacatgcttattttcctttcatttttgtttcagtctttagaagtagtgtaggccctgtggttttcacctttgtattttatcacatgaaatatatttgtaacatttatctaaagaggatagccttggtactgtgcataatccatcaattttcaagcataaatgaatatccttcctattttctgtctccttttttttagaaggaagacagtttgatgtagcctatgttattcctcttcagccaagcaatgcattacatagggaaagctgaagggttgtggcaatgtttctatttttttattgcaatactattttctttaggtatatatgtgctcatctgaatatttttatgtgtatagaattacacattatgcccctaaaacattgagttcagcgccaaaccttggagactgaagtcaggcataatagtgagctgcaatatactttgagagaattaaattcggtttctatgcagaaacagcaagcacctttacatgttagtaatttttttttcatgccccaggtttacaattttaggctcatttgtaaaatagacagtatataacctgtgtattttagtttttgataaacaaaggaagaaatagaaatcatgcttttctatgcaagctacaactctgatacacaaatggttaaattctgatgaaaagaaagttaagattagaagattaaaaatttcaattaagatgataccatgaggaataaattattaaatattcatggagagttagaataattcttcatcaatttgaaaacacagtttgagcaaagaaaatgattgtagttcattggaatgcattgccacctatgacatttgcttacacacccataactaatcattcttcagtgaaaggccatatggcagttatgaaattgttatgttgtgtattgctcatgccaacttacataaaatgttcaggaattttaatgctcacaaatactggttttcttactttatggttttggaaatgttttcctaaaatatcttcccaaagcattggttctgtgttatacagaacgttcaatgctctgatattgcagttttatgttttttaacaccaaaactctgacattcaatccatccattaattctgcatttcatattctacctgtttgctctagagaggatgtagcattttgcataggcatcagattgtcaaataaatatattataataccgtcatggaagacacagctgcacacaggactcagctcgtgtccatatttgagaaagatggacactgtaaaattttaaagcatattttttctcattataattgatgatttatgattcttttttatatcagtccatatttcataaatattcattattgcatcttgacatcaaatgtacatcttatatgtgtttactgtttttgagatggttatatcatgcattctcagagaaatagaaatctaaacaagtctgagtattttagagtgtatctgttaataaagttaaactttatttttcttcagtatatgttggttacatgtgcctgaatgtatgcatttgtggtatgtatttctcctgcctgtagtgttaagtagagatcattggattttaaagaactggatttaacaatccattgtgtagtgccatgttggtgctgggaaacaaatttcataatagaggccttgaaaagatattatacaatccaaactgcacacaaaacttttgtaaatggtgatggtggcaaatctttttttttttaaagatttacttatttattttatgtatttgagtacactgtagctgtacaggtggttgttaaccatcatgtggttgctgggaattaaaatcaggacctctgcttgctccagctctgctccctctggcccaagaatttctttattcttatacataagtacactgtagctgtcttcagacaccagaagagggtgtcagatatcattacagatggttgtgagccaccatgtggctgctggtatttacactcaggaccttctgaagagctcttaactgttgagccatcactctagcccaatggtggcaaatctttcatttgctgcttaaggtctcagtaaatcaaagaaaattggttaagacaagagcctttctgaatgtaagcattatagtaaatcattgtataggttgtctatggaagagcagcaattcatgtcttgaaacacaactccataaactttaagaaaatatcattcaatattcttgcctcatttatatcacgaggtgtatcttaattagttctctttaacataataaatcattcttgtctagtaacacctaggtagtttttcattacagtgtctattaaccttcaaggacgtgtttttggacttctcatcggaggaatgggaatgtctcaattttgctcagaggacattgtacatggatgtgatgttggagaattacaacaatctgttgtttgtgggtaagaatgtactttttgttgaattacggatacttttttaaaattttcctaatttgtataaactctctgaaatacttagagacctcaaatgagggaaataattcttaaattcataacttttcctttacatttctctgattactttggaaaggtaaccagtgctatattctctgagatctctcttccccacttatctagcttcagtcaagacttttaatttgaaaaaaatttaaacattcagaataaggaattgtatttctgtacatataataattggagtatttcttcttaccattgctttaaaagtctcttatttatgattttagaaagtggacaagattcaagtggacacagtgccgttggtttggagggttttttattaagtgtttgacatttggtctctgtttttttctggggcaacctgatctttatcctatattttggatgttgaaacaaaactatttaatgatttctcatgacagtttcagttacatcataaatttatacctgaccaaagctatacaatgtcactctaaatccaattgtaattttaaaattagagctatattgttcagagatctactttctgacatttcactacagatcaatcacttagaagttctagattctgcaaagtagaatattcttttttttcttttctaaattggttattttaattattatatttcaaatgatatagcactttccagttccccctccacaaaccccttattctatcccccctaccccatgcttctatgagggtacttcccccacccacccacatctgcttcactgctctaggtttcttctctgctggggcattgaggcttcataggtctaagtgcctctcttccaattgatgaaagttaagacagtgctcttttacctaaacagctggagtcattggtccctccatgtgtgtactctggttggtggtttagtccttgggagctctggggtatctggtttgttgatgtttttctttttatgaggttgtaaacacctttagctccttcagtccttcccataactttactttggggtctctgtgcatagtcagatcgttgcctgcaagcatctgcatctgtattggtcaggctctgcagaaactctcaggagaaactatatcaggttcctgaaaacaagcactttatggcatcagcaataatatcagtgtttggtgtgtgcagatggaatggatgcccaggtttggcagtctctggatggacttttcttcagtttctgctccactctttgtccctgtagataaagggacactctttatttcctttagataggagcaattccgggttaaccttttttatatgggttggtggtacaatcttagaaggctattatcacttttgccatttgatatagatcagatttgaggtacttctgaggatccatgcaatgattaaaaaaaggaaaacctctcttgagaatatgaatacatagaacagtgattattggatcatacttactcctcatataagtaatccctgttatccctaattcccccttttttcagaaaatcactgcatatgtggaaactatgagaaggagaaggtcttggaacaagacacacagcacattgtcaatgagcatgggcataaccgaaagaagtcttctaaatgtaatgagcttagaaatgtgatccatgaatcctccgaaagtacaccttataacactaatcacagagatgccactctccaatcctcaaacctaaaaagacataaaactgggaccactaaagaagtttgcacatataaagactgtgtaaactgtttaaaggggtcttctatcattagtctcaatcaaggaacccacatagagaagaaagaacacaacagaaataaaaatcttgatgaggttttggtttctagacaaaacaatagtgaaatgagcacttacacttgtggtgaatttgacaaatgctttactcagagtgacaatcttcaaagtcagcagagaatttatccaggaaagaaatcttacatatatagtgaaagtgacaaatgctttacccaactttcccatcttagtattcatcatacaattcattcaggagagaaaccttacaaatgtagtgaatgcgacaaatgctttactgacaaattcactctgagaaagcatcagagaattcatacaggagagaaaccttacaaatgtaatgagtgtgacaaatgctttactgacaaaggcagtctgagagttcatcagagaattcatacaggagagaaaccttacaaatgcagtgagtgtgacaaatgctttacccaaccatcccatcttagtattcatcgtagaattcattcaggagagaaaccttacaaatgtagtgaatgcgacaaatgctttactgacaaaagcagtctgagagttcatcagagaattcatacaggagagaaaccgtaccaatgcagtgagtgtgacaaatgctttactgacaaaggcagtcttagagttcatcatagaattcatgcaggagagaaaccgtaccaatgcagtgagtgtgacaaatgctttactgacaaaggcagtcttagagttcatcatagaattcatgcaggagagaaaccttacaaatgtagtgaatgtgacaaatgctttactcacaaagactctctgagagttcatcatagaattcatgcaggagagaaaccttacaaatgtagtgaatgtgacaaatgttttactgagaaaaacggtctgagaaggcatcagagaattcatacaggagagaaaccttataaatgcagtgaatgtgacaaatgctttactgacaaaagcagtctgagagttcatcagagaattcatacaggagagaaaccgtaccaatgcagtgagtgtgacaaatgctttactgacaaaggcagtcttagagttcatcatagaattcatgcaggagagaaaccttacaaatgtagtgaatgcgacaaatgctttactgacaaaggctatctgagagttcatcatagaattcatgcaggagagaaaccttacaaatgtagtgaatgtgacaaatgctttactcacaaaggctctctgagagttcatcatagaattcatgcaggagagaaaccttacaaatgtagtgaatgtgacaaatgttttactgagaaaaacggtctgagaaggcatcagagaattcatacaggagagaaaccttataaatgcagtgaatgtgacaaatgctttacccgaaaatcacatcttagtattcatcagaattcatacaggagagaaactgtacaaatgcagtgaatgtgacaaatgctttacccaacaatgccatcttagtattcatcagaaaattcattcaggagagaaccttacaaatgcaatgaatgtgacaaatgctttagtgacaaacacagtctgagaaggcatcagagaattcatacaggagagacaccttacaaatgtaatgaatgtgacaaatgctttacctgaaaatcacatcttagtattcatcagataattcatacaggagagaaaccttacaaatgtaatgaatgtgacaaattctttactgaaaatggctgtctgagaattcatcagagaattcatacaggagagaaaccttacaaatgtagtgaatgtgacaaatgctttactaaaaaatccagtttgaggattcatcagagatttcatacaggagagaaaccttacaaatgtagtgaatgtgacaaatgttttattcaaaaatgcagtctgataattcatcagagaattcatacaggagagaaaccttacaaatgtagtgaatgtgacaaagctttactgagaaagtcaatctgagaaggcatcagagaactcatacaggggagaattcttacaaatgtattgaatgtgacaaatgttttgcccagaaatcctatcttgtttttaatcacagaaatcatacattaaagaagccttacaaatgcagtcaatgtgacaaatgattttcccacaaacttagtctgagaatgcatcagagaattcatacagtagagaaaacttacaaaaatgcagtgaatgtgataaatgctttactaataaaggcagactgagaattaatcagataatttatacatttaaaaaaacccttacaagtattttgtatgtgataaatgcagtacccacaacatcagtctgacaaatcaacagatatttcaaacagtagagcaacattataaatgaaatgaatgagatagtcctttaacaagaaatatcatcttaaaattcactggagaattcttccaaaagggaaacttttcaaatacattgacggtttgaatcctttattttggcctatctcttagaatgtaatagataatttatacagtcaagaatcttaacaaatataatatatgctgaaatatctttgacttcatttcagtgcagaaaaaatatgtaaaaaaatttttttatgggaaaaatagttctcctggggaaatgtggcatatgttttacacgggtaatattcttttcaacagtcagtgctctaaactagagaattattatgaatctgaaaacttttgaaaaccttcatgcaatgttcaaatcttagataatgtcaactattatgctggcagtaactctgaatatatgatagtgaagaaacattttcattaaacttttacttgttcaccctcaaatattatatgatgaagtcaggtgtgaaagccagaagaatatgatgttgtgcaacaattcatggagatagaaatgatccattccaaaaggaaactaaataaagagtgtactatcgccttcaaaatgtctaataaaactggcagcattttgtatatttaattcaaatgaggaaattgacacagattgtacttgatagtgtatttgacaaactgagccaccaagactgcatgttcttaatcctataatatgcctacagatatgaagtgtgctttgagtatccagtattcattattcttatcacgtcaatgtgacaaatgatttattggtttcacgtttcaggatagtgactgactatgagtcccttatgctctgtcaacatctccttcctcattgccctgtaaataaagctgaatattttaacaaggttgacttggctgttttcagtttgcacttataattagatgaataaatgttgcatcatcgctggaactatttctcataaagtatttgctgaagtcatgaatattttctgtaaacctgtaacttaaacttaatatttgtgattttcaactggtcaataacaaccttgacccacatacgaataatatgaattgtatataagtgtttagcattagaaaatttagcaacagtgtattagagatgatgatttgtgttaactaaaacagggatgattctatgcaatattccaggcttactgctcgattagtactagtttattaaaacaaacacacaatcaaacaaagacaacaacaaaaatcaaaaccaaacaacaacaaaacaggaaacagaaaacatgtaaaggcatttagaacctcaacagtaagtctggtctctctctctctctctctctctctctctctctctctctctctctctctctcttttgactcaagggaatatgagataaaatactatcaaaaataaatgaaaatatagcttcatagttttcagggatatccatcctaactgtgctatgtccctgcacaactccaaagctctctccagggacacgtataacaagtccttatggtgtcctgtcctattgttcctcatacttcactctgaaccttcatattccactctacctcaaggactgactaagatttccattcttgtcctaaatcatttagggaatgctcacattttacacaccttagaatgtacattttggagaaaaatacaacaactcactattaaggtattaatctcctttttatttcatatctgagtttatccatacaaatagcatgaatctgtaaatcttaaaagaagtgcctttgtatggtagatgaggtaaaatctcatgcacagtttagaaatccaaacatccaggaaatacatttggaaatactgaaaaaagatgaaaaatatttatgccaagcaaaagcattttattagaatatttatagtaaattcaggaagactcagaaaattaggatctaagaaaatgtcatatgttaaaatgaacaaatctatttacacattttccttgatataaaaaaataaggacaaatttcaacttgtgagaaacttagtgataacattatgttattctcagaagtggaaattgttgaacaaatctatatcactatacatttttccttgatttaaaaaaataaggaaaattctcaacttttgagaaacttagtgataactaatatgttattcttagtattggaaattgttgacctcttccttagtaggatcaaactactaatagacactttagaggcccttgttttcaaatgatcattagtattttctatcaagtgctgcatcatggatgctgatgctcacacaccaggcaatttaaatttaggcttctgaagtagcccttaacagtcaggaaattacaaccacctggacagtctctggatattccagtttcttatgttgcatgattctaggccccactgcctgatgacttagagataattatcccaaatcttcagatatttccagtgtcagtgaaaagttccaaattgtgcacagcaaatacacaacttaccttttgcccctcacacaatatgattgtcttcattctataaacatttatacacctgcttcttgtctatggtacaacaagaatatggtgagggtgtacaacataggttcaggtagactcactgttggaattatgtggaaggcatcatgtgcagattgaaaaagatgaaagtcattggcttagggaaattaataatatcatgtttgaagaccaagaaaacaggctcaccaaatttggaaacattcactatttgtggatgagcattgtaagatacacaattagagccacactacagaagactaatgaacattcccagaagatcttccagtggctacaattttagtaacccagcaggactagggcagtaccttgcatggaaagaaaatatctctttagcagcaagacaactggtgggagaacatggggatgggaaacattaggagtaggtaggaagactcatttcttgattgaaactgcttttttagcaggaggattcctaagagaaactgaaggcctgaaggaagtggagtgggatcagaatcccctccttgtcaggagtctgcaagctgcaaggtgtggaactaggagtagagcacgctgccatgggtctcacaacaatggaaaaattcccttcatctgcactgttgccagtttaggccttaggaatcttttttcagtcactagagcagtggcaggaactgcaaccaagaagtcatggaaactcccaggtcaaaggaattgctaggctagtgggcagaaaggaattgtaccaagattgagacgactttctctgctgctcataagaactctgaccctcaaatttctactgggcatttcttaactgtgttggtaaattactatgtatgtttgacttgtcctgatatttttttattgtgaggatatttccagagtaatttctaagaggatgaacttgtcttttttttttttcattttttatcatagttatatttccctggtggttggaacaaagttggtattattcacatacatccatggtttctaactcttctattgtatcacttccctagtcaagattattggagattatggagattatgcatccccatgatgtctttaaatattattctcttaaagactatttgaattttgattgaatctcaagcaatattttagcaattatgttttaggttttacctgtctttaagttgtggttgtataaatatggcttaaacaacaaaacactcctggacttcagctcaatggttggctctatgtatctgcaacattgtcaataagctcctgatagagtctgtcagaggacagtcatgccaggttcctttcttagcacaacatggcttcagtaatagtgtcaaggttttttttttttctgcccataggatggattgataaaggcaatggatggcattttcttcagtctctgctccacttttgtcactacatataattagatatgaacaattctgggtccaaattttgaagatggtcaggtgcccccatgcctcaaatgggggccatgctctctgctggagatattctatttaggttccgtctacccactcttggacatttcggctaaggtcattcccaatgaggtttgggagacttccacatccatcttgtctgggactttctagatatttgccctgctcttcattcccacacggttgtatgtttctattaatactcctggccctctgtccttctctcctgtctccccacatacctgatcctgccaccgattgtccctgactctccctcttttatccacatccctcccttcttctgcctcctgggattattttgtttctccttctatgttgaattgaagtatccacaatttgaccttccttctaattaaattttatgtggtcatggatattctgatctttttgccaaataactacttatcagtgaggacataacatgtaagtccttttgagcctgggttcctcactcaggatgacattttctagttctctccatttgcctgcaaatttcatgatgtcctcagttttaatagatgagcagtattccattgtgttgttgaaccacattttttctacattcattccttggttgaagaacatctggtttccagcttctggctaatacaaatatggcagctttggacatagtggagcatgtgtccttgtgttattgtgcatcttcttttgtgtatatgcccagtagtagaatatctgggtcttcatgtagaattatttccaattttctgaggtactgccagattgatttccagagtggttgtaccagtttgcaatcccaccagcaatagtggagtgtaactctttctccacacccttgtcaccatgtgctgtcacttgagttcatgatcttttcaattccaatcggtgtatggtagaatctcagggtaatctgatcttactagaaaagcatatactcaacaacactgctttaatctagaagaaacagatgatattctagattgatatattgtgtccagttaaatcaagatgaggtaaactatctaaacagtccagaaacccctaaggcattggactctgctgccctcagaactagggtacacccataaccatgacagtgaccccttctgtgaggtcatagaggccaagcctcactctgtttaggaaagctcaaagggtgtccaggcacacaggtgccttttggactggtatcaaattgattgaaattttggcctctaacctgtctcttcaccaccattaaacacagcttgtaataggatttcccagaaagcagcatttcaggaagtttccctcccaggcctcatcatgatagtcgatgacttctgagaatgtcactaaagaaacaactgatatgatcctacacacacacacacgtacacagattcattcacaaatacattaacagccatgaatataaatatgttaagtagatgaagaagggatgtgatatcaatgtctgtggccatgcaggaaagggcctgtgagttgaaaataaagatttctaggaaggttcacatgtttaaaagaaaacacagagaaggtcctgggaaagcacttccttatgaacctgtgtaatatatgttccctgaaataatggcatagggggcaatgtgagtagttgatcacttatgagcgtgagttttgagtcttaaaagcaggtactgacttgagtttcttccagaggcctcccttcctggcacatgtatggtgtcttctccctgagtctatgtctagcatgccattcggcaggcacccttgtatttactgctgctctggcttaacagaactcctgttgtgttaaacaaggaacacctcaagaacttcacggagcccctgtcactgccattcaggtccttgctcctgctctttcctgcatgcctttatacctgaaggcacatgtactcccgtatatacactcccagaccatgcacactaacatacaatttaaatataattatgtatagtgtgcagggttatgtagagtgctgaaataatatgccctgtttgtgggacaatgggctatacacagacagtctggtctccagtcaagctgaggtctgaactctgggacccggtggtgataattcacctacatgggacggaaggagttctctcatgtctcctggaactctggctcctgtcaaagttaccatcccctcagcccccacaggagaagcatggttagtagtcatataggcaatgtcccaagcttctgaccttcaggctagactcctccctagttacctagcaacagaaaagataacagcataccataaaaagggctgtttgacccctcctcactctctcactcctcttgctcttaatccccctactctcctccctcctttcctctctctttgtctctctcttactcgctagactttcttctctatctccctttcccctttgtctccttttggccatggccggtctctctctcttttaccttctatcctttctccctgcctttctataataaagctcttaaaccatagagtgtctctgctcatcaaggcccactgcacagactcttacctgtgtgggaacctctctccctcagccctcactcccataaccccagggctacagggtgtcactctgggaccccctgttgggggctgtctcttgtccaccccccatttaatggggtcagtggcttagatgcccacctggggctcagtggaaagtgtctggcaaccctcccatgtctgcctgcccagagcataggtggaactctggctgggtgtgggctatcttctctccctcttcttccccagcctcccttttagttcccacacctgttgaatacctgctttcagtcatgctggagacaacccctggacatacaagacaagattattactgtgaagaagcaaagtcccttaagaagcccagacagtaggactctgcaccatctcctacctgccctggacacaatgggctgccatagctgatagttgtccatggcttagggcacaacagcagagcttcatcctgcactagtctggaggctggagtcttttcatgtggtacaagctggatgtgaccattccctaggcttattctctggtgagttgtaggtgttgtctccctgagtacttgtttggcaagttctttagcatgtgcatatgcacacacacacacacacacacacacacacacacacacacacacacacacacacacaccctgctgatacttactgcaacagtttctactgctttagcacaggccctgctaaaggtcacttcaaggaccacattaggcttcatacacttcctcactcctatctcccagtacagcacaatgatgtttagtcaggacttcatcccagggatctgtatatatttctcccaacatacagcccaacaaacctgcagttccttccagatcccagcccatccctgagctccctcacaccaacaccacagcctttaaccatggcaacaggctatatgaggtaacagaggctgaccacacctctctccagcttcttcccatgtgcctagatgtaacatgaggaacgaccgtgctttctctcttaatataaagtaccctgacttgtgtaacaactggtgagttgtaggtgttgtctccgtgagtacttgtttggcaagttctttagcatgcgcatatgcacacacacacacacacacacacacacctttctgatacttacagcaactgtttatacatatttgtagcaagatatatagcatcattccatgtcctcctcatgcactttcacacatatggaagtggacctgcagacatgagcacatacataagaacatatacaacacacctcaaaatgaaaacatgtatttgagtatagaatgagaggggaaggtgctgtcatggcgtttcccgtgataccggcattgatgtttgacacatattgtggcagctctctgagtacacatgcaaagattgctactgccagggactgaagtcaccagggaagatcagacaccagtgtcaaggatgttctgcctccttccctggacaagctatgtgtgatggtcaaatgtgggcatggcaaaagcactgttccctccttcctggcctaggctgggggctcaagtcctggtccatatgtatatatatatatatctttccaaggtctctcctcttggtgagtgaggggttcttcttcctacagtcttaagtggccattcccactactgtgagacttctgatttgtttctagctctccttagctctcttgaagacagtcttagagctgtcttcaatcagaaacactttaattccctctccctatttctgcctcccccacttaataccccagtgaagaagtgccttgcactgagtgagctactcacgcgatgaatttcaggtagtccatcccagaaaacagcccaagccgaggcagacacatgtgctcagtgtgaatcccagccctccttgctggactctt

SEQ ID NO: 300 - DNA, 2902 bp, Mus musculus
ccttcaattttctcccggggaggggggatatccccaaaacctaggagtggtgatcagaatttcctgggcacgcccacctcacaccctgcgattcgttcccacattgctgtaattataaaaagccacttaatagactctcgctctccgtgtgaaaagcacaggctcttctatacacagagagatcttaggactcctatgtctactcttccaaacaacacaagttaagcccaaaagcaggctgatgtaactggcaagagttcaccatgtgcccagggagtagccatctgtggatccactgtcactcctgtgctctgagacaggccatcctgcctttgtcacaaacaaggctccatcttcacctcttacgatgtgcatccttgggggcgctctgtcactttccagagtcccattttctaccttgttcagaggtggaagtaaaacccgccctggagaagaatgttcttatggcggcccccagtgacccaacagactttcctctgatcactccattaccaacatctctaactcttctgggagtccctgagaagggcgcagagtggggatggggtgctgccacccgcatgccaccctccagcccaatttggggggactcttcagtaaagcctctgccaacctccctggtaccccacatttatcacggacattaaaacaaaagcgtcaggagaaggcaattaagattaatagcccgcgctgtcgattgagaatcacaagggagaagtaattagattttacaggagacatcgctctctaaaacaagcctcacagcatgggagtccccggtcctgagagccttcggtgatgtctttttgtaaaggctttcctgatgacattctcccagagctccgtcattaatgccagtcactgatggcgtctgaaagtggcgtgttcctcattgagattcatcagatctgccatttctctgctgtcccgcccctgcagacagacctcccatcaccacggagctaggccagtacctttttacccaaaccagcctcctggggccccacatacaggagttggggggttggaggcataatgagaaaggataagcgctgagccaaagccccctgcgaggaccctttctttcaggcaggggaattctctgcaggctgcctccttttctttgcaagagcggctctaggagaagcccccattctcctcccacctgaccggccgccagcagcgtccaccgttgctcctagctggccccctcctctccggtacgcagctgtcccccgcgcacagactcaagggcctgatcatcgacccaagaggggatcccgcggcctgccgtgcttctgcacgctggtcagtccacccttctcaaaagtcgcagccccagtgacattccacttgtggagtccacgcgcgaggcaggcagaggacgtgcagacagcgactggcagcacattggagaccgaaactagggctgaagcgccacctagtgcgtgcgacacgttctcacgaggtctccaccttgtagggcaaatatccatgaaaagggagcctaggtctggggccgggagaatgagggagggtaggatctgcgatagcgtgctaaaggagagattcaagactcaaacagggggctacggaggcagagctctgcgtgccttctagtctctgtgactgtcccacgcgcatccctctgaaagcccagggcctgaagacctcaataattaatagtaaaattaaaatagcctattcaataaccaccaagatactgtgcattgaacacttgctccccaggccagggtcgcaaagggggggctcctcctctgccagatctggccggcctgggcggggtcactgggttggggcttgaatgggtgtgtgcggggggcggagacttgatgcaattaggaggagaaatgctctgatgcccgggtcacctacccgcggggcccgcgggacgaaacgtatataaggccgcgtgcccggagccaccccactgtcggagcagtaactctgtgcgccccacgccacaagcgcccagttgctttgtgggttgtgcctgccctgcgcctgcaacttgagtccccgccgcatcgcagtctccgcgccacctttgtaacggccttcaggaccccgaggtgtcatggcgagaaagtggaacgggcgtgcggtggcccgagccctggtcctggccactctgtggctggctgtgtctgggcgtcccctggctcagcaatcccagtctgtgtcagatgaagatccactctttctctacggctggggcaagattacccgcctgcagtacctgtactccgctggtccctatgtctccaactgcttcctccgaatccggagcgacggctctgtggactgcgaggaggaccaaaacgaacgaagtgagtatcattcagcccgtcccctccggtcccttaggacccagaagcacgtgggtgtgtcgccgtggccttaacatcctcccacccctgacttccagactggagctggggaagggcgatgcagtgtggccccgctgtactcacgtgttgctggggcccggcaacatctttctcttgctcgcagatttgttggaattccgcgcggtcgctctgaagacgattgccatcaaggacgtcagcagcgtgcggtacctctgcatgagcgcggacggcaagatatacgggctggtgagtgttcctccacgcggcgggatgctcgcggccgcgttgggtccgtattgtttttgtttgtttgtttgttctttcgcctcctgctcaggtccaaaaggaacttcgagggcaaggtaccaatgatagtggggctaatattgctcttgcccgccctgcgtaaagtgatggccccaggctgtagcgggggagcagggagaccagagaagctgtctaatcttcccaaagactgggctaactgc

SEQ ID NO: 301 - DNA, 2553 bp, Mus musculus
gccagtcccgagactcaaacccagagccttgtgaatgctaagtacaatacacaaaatctccagcccgagagatggctcaacagttaagagtactgtctactcttcaaaggacctgggtcaaatcccagcactcactggtttgaaaatgtctgtaactccacttccaagggctatggataccctcttctgacctccttggcaccagaaatgcacatggtacacatgtatacaggaaggcaaaaacaatcatgcacataaaataaagtttaaaaaagaatctagcctggtgttggtagtctacacctttaatcccagcacttaggagggaagatggatctctgtgaattctaggacaacctggtctaagggaaagagagatcttgtctcaaacataatctttttaaaaattaagtgtttttaaaaatattcatacttctgggtgtgggggcttagcctgtgatttcagtacttggaaggcagagataggaagattatgaattgggaatatagtgagactctgtttcaaatagacaattcgcatttattatctttttgaggatttatttactttatgtatatgaatttttgcccgcatccatgtatgtgccatgttcatgcctgcaggatccccctaggtgggtgttgggaattaaaccctgatcttatgcaagaaaaacaaatgctcttaactgctgagctatgtccgcagtccctattacctacgtttatctctttcgtttgagggtttaaaggagttggttggtttcactggtactggggttcaagctttatccacagtaggcaaccacagtatcactgaactatgtcagtaacctgtagtgtttaatctttcaattatttcctaattttataacttcaaagatgataagatatactgaagttgctgctccaaacggagtttagacggagtttagaaatattaagtgtttcatcatctagccacctcctaattattattccatgtagttaggatactatttctattttctatcaccaaagaattgaatagcacaaccagtataagtgatgtgctggtgtgttatcatataaatgctcaaggtacgacttctaatggtgaaaaacgggaaaataaatggacgttgatgaagtgtgtcttcttttgtctgttcccgggaaagtttatttcgggcatttccactggcggaatgattagcgctaacagctttccccctccgttttattttacagggtctcttcatcttcctgatatatggggtatacaacctagaggtaagtctgcttggagtagctcaaggctgacagcgtgaatgagagaaatgacaggtttcttatcttgataactgtagaacaaagttggctttcatatgagtgtcccactgcccttcatgcttgggctggcttatgtgcagcccagctttaccattaaacatggacaccctgagtacagggacagcctcatttctcactggcactgactaatattttattactgtctgaagtttttgaattttcagtgttcaacgcttagctatacctggtagtttcaggaaataatttaactgtagttccatggggctaggaagatacaatgcctcatgaaactattcataaaatacagttttaaggtttctgggcaggctcagagaggcctgtgttggtaaacaatacaccgctatggctttaattgcaaaatttctcaaggaagttattacaagaagtcatctcgagaaacactatgagaatatggacgtgtgatttctttaagaaaacacactatgtaaataactgttctccaggtctttttattaaaaagtctgtggtgtataaatacacctaggaaagttgctggtttagatttttgcatgctcgctgtgaatgccttttatacattattaggcactaaattaatatctatttggttttgtcgatagaacttttaatttcaagattttatctaatttcccccaactgaataaggaacaacttttcaagtttctaggtattctatactggaggggttgggagagtggggtatgtatcctaacagagattttaaacaagaacgatggccagtatttgaggctagttagtattcaacgtaataagcaaattcagacaactgagaaagtacgtggcatttaaataccatctgatgatgaagtgtgtgtgggcgtgttttacaggacagctgcacctgggattacacgtggtttccctttgcgtagccttcaggtaggctggcactgagacaattttctgcagcggtccctcctctatggcagtctcaaaggctccttcaataaaggcaaagacaagcgttattgctgtctccattctgaaaaggagtaaaagctatctgtaatcaataccgttacgagtttaaagctttcaggcagaatcacaagtaccttaaggaatcctattctctgtttgattttgattcaatacttggattgcaaacactaaagtgaaccaaatgccaatgttcagttttcagtgtctccaccttccctaaccccttcctctgcagctcccacgccacgctgcaac

SEQ ID NO: 302 - DNA, 2239 bp, Mus musculus
aaactttctatggactcagatccatgatccagactccaggagaggtaagaggagtatagcacgggggtggggagcagaatgaggaaaagcaggggtggcatactttccccatcacagaacagtgcctggcatggccaatcagttccctccatacacaggcaaatctgatcagaaagaacataggtgcaggcaggaatcctagtgctttgtggggttttccgacacgtggccaggctggttactcccatttaggaaagctctgacccagaagactccagtttccacgacctccggggaaaccagtggtggaatggaggaagtctgagcgactgccttcctaggcagacacagccctttctgccaaacttcagagttggctagctaggccaagacggtgtctcacaggggccgtcagtcctgtgttaataactttctgggcattatctacagggatgagactcaggtacacagttctccaatcttggtgtggagccagagtacagaagaaaagaatacggtcacttcataccaagatgcatgtgggaaattcccaggttgcaggcttgtgggtccgcgcaaaaggcatgtctggcaagacaccactaatctccgagggacgtcattatggctcggggatagggtcaccgcgtgctttgtttgagactattggaccctagggacagccctcggatcagacacgcaacacagcctcggccgcaccccgccccagacaaagaactcaactccaggcaggtaagcaaggcaccacgcacccggcggcggacagagcaagggggcgcagacaaagacgcgcgcccccaccgtgctccgcctgcctacgccgcgcgcccgacggacccgggaccctttccagacaacaccctgccgcttgctaccacaagcgccccaggtgcagccgcgggaacacggggactctgagggtcctgctccagcgaaggatgtgtgagcggaattcccagagtcgtcctcttgcccgttcctctaaggggtcggtgtttccccacccgcgacgccctaagtcccgctttgctcttcgcgcactgacctctcgggcacccagatcctgcgcgcttctctgcgttcgtcgacggtctcagccctaggtgctgcacggacgcgggtggcagtgaaactcccgcgggcctgccatccagggagtctctttctgcatgcccagctcagccggaacccggaccgggggcgcgcgaggcgcacaggtccccgcgccttctctgagcgctgcgggcactctgggcgcagcggccaggagccgtcgagcgggcggggtggtggtggcgccggcaggcggggcgctgtgtgggcggggcacgggcaggcccaactaatccagccccgaggcgcagatctgcccgcgcagggtgggtggctgtctgtctgatctgacccggtggtaccccaggttggcgcgcaatggccacaagaaacgcccgtgggctctactccacgatcatcacaaaaacaagttacagacaactggtactccgtttacattaagggaaacagagccagaaagaagcgagaccactggcaagtccaggagctggggtatgaagggctgagaggatccccagaatcaacagccaacaaacacttttttgctttgaatccagttccgactctaagccatcccacgctgaaaagggctgtggcgccagggctactccgtgagccctagttactttacaggaggctggagacgcaaagcatctagttttgtttgtgaggccaggggagctgacctgagtccacaaggaagctgagtatgcctgcctgccacacaagccttagcacaatgagcccttcaagcccagtacgcacacaggtgaaacacagaactcagcaattccatgcaattctagcaattccatttgtgcccttgaaattcgaggacccacacaaagcttgaggtggaaagactcccacctaggcttcaaatgcctggtccaggacgggcatccactttgtgggaattcagccattcctaggcctgtgggagccagctccatggggtgcgttagaggtagaatgccagggtgggccaccattcatctttacaaatgaatctttacaaatttatccttacaactgcagcccttggataatccagtgataacctgtcagaagtaccagcctcaacagtatcttcagctctttccttatgtttggcttatttaccaaataaaggtcctctccttac

SEQ ID NO: 303 - DNA, 20307 bp, Mus musculus
agatctctggagcccttttcagctcattagcattcgtgcttgccctggggggggggggaagaatccaccattccagctcaggctattctgctgccagctcctcccctctgtgagcaatgttcctgacttcagaccttgcctgaacattctccatagcacttgccttctttgccctgaaatcaaggtgagtagcttgaatagcccattactctagctgcattgtaggtatcaatctgacccaggaatggaagggtggccaggctattaacattaaaaaggaattttagaaaacaagaggctttttaaaatatatgtagattgccaaaagaaactatagcctagattaaatgtggatctgaacatctcaaaagatcaagaataagaaagggtttctcacctcaaaaggtataattaagaaatatcccccacagtaagcagggttagaatcaggattaggagattagagggttatggtaaggattaggataagggtttatagattagggttatggtagttaggaaaataagggttgaggtttaagaaagggtaagagtttgtgggtaagtcccagggttaggctcagggttagggctaaggtggccaccattattcttgatggttctactgagtcaatagtatcctgttacacaaagaagaaatatcatggttaggactaggctcaaagttagggcattggatttgctgtgctatgtgaaatcagcttctatattttctctcatctgcctccctagtcctctttttcataatatcatcatctattttcctgcccccaggaaagtggaaaggaggttatccaagattctggaacttcctgatgggaaatttctttactttgccaaggggcgcaattcacatagaacagaaaaccactactgcattgattgttctaagtttcacttggggatcctcctaagatgaaagcaattatggaacttggtgctcttctttgatagtgatatcataaatatagcataggccatgtgtcaccacagatttagttaatataaccatgtggttcaagacaaaatggtggacaacatgattcttgatggtacaactgaatcagtagtatcccgattatacaaaaaagaaatatttttttccattttttattaggtatttagctcatttacatttccaatgctataccaaaagtcccccttacccacccacccccactcccctacccactcactccccctttttgtccctggtgttcccctgtactagggcatataaagtttgcgtgtccaatgggcctctctttccagtgatggccgactaggccatcttttgatacatatgcagctagagtcaagagctccggggttctggttagttcataatgttgttccacctatagggttgcagatccctttagctccttgggtactttctctagctcctccattgggagccctgtgatccatccattagctgactgtgagcatccacttctgtgtttgctaggccccggcatagtctcacaagagacagctacatctgggtcctttcgataaaatcttgctagtgtatgcaatggtgtcagcgtttggatgctgattatggggtggatccatggatatggcagtctctacatggtccatcctttcatctcagctccaaactttgtctctgtaactccttccatcggtgttttgttcccacttctaaggagggacatagtgtccacacttcaatcttcatttttcttgagttgtagtctatttacagttaaatgggtaaaatttaagataaacattagctcacttttggattatatcttagaaaaatacaatctcggagaatttgtgaaagtatatgtgaaagtatatataatattagtatacataccagaaaagccataatctggaaagaattatctttttggttttgtatgtaggagggagagaattttctagaaatatatgtatctcataagaggcaaaatcagtattactgttagtcattcagaagttatttgtctcttttactggacctaaataattccaatcattttgtttgtgtggtaaaataaaaggcagcacattgaactgctaaaaacaaaacaaaacaaaaacaaaacaaaacaaaacaaaaataataggcctactatatcttaatgttttgttttgttcttattctttttttttttattattattatatgtaagtacactgtagctgtcttcagacactccagaagagggcatcagatcttgttacagatggttgtgagccaccatgtggttgctgggatttgaactcgggaccttcggaagagcagtcgggtgctcttacccactgagccatctcaccagcccttgttcttattcttatagattctaccttgcatacttaatggcttctcaaatgaacctaaaagtttttccatccatgtaattccaaaactagcatcctaacttaggaagcaaagactttgatattcacaaaaccgaacagataatcaaagaataagttttaaaagccagtcagactgctgccagcaaagaccatttatgctaccctcttctgggcctcactgtcagttatttacagagctaattttcctatgaaataaaatgcccttcagtattcttttgctctagacacatctgatttactttctacccaaacgaaaagtatacttactaaagatctgtatgtgaagttttcacatgacaatcaaaattatgaaaaaggaatctcagacaagcagtaaatgcaactttatggtttattaatatttgctttttataaatatacacatatacacatggtttagaatatacacatggtgtgtcattcacatcatgtaattaataccaaagaaattttaagtaaagtaaactggttaaattggccaaagttaattttattcataataaactaaacttaaaaattaatatgcacatgcatgtatagatggataaatatattttctgtatttatttattcatttatgagaggcaaagtctctctacatggtgccaaaacatattagatagtccaggcaggcctttcaagtgagtcctgcctctgcctctacctccccagtgctgagatcaaagcacactttcctttttattttccctttctttcattctagggaggtaatgtgtgtgtgtgtgtgtgtgtgtgtgtgtgtgtgtgtgtgtttgatttctttttctgtcagtgtattggcagcagaatgttgaccccagaaatattttgtttttgattttatagttattatctatttaatttaatttcaaaatatatccatgtgtgtgtgttcgtgtgtgttgcatgtggtgggtgggtgtgtggtgactgtgtgcattggtgtgatagtaggaacctgtatgtgtgtatgttgtgtacgaatgttgtgtatgtatgatagtgcaggcatatgatggaggtcgggtgggtgggtggcatccaaactctgtatagcaccatgcatttagttccatttattgtatgtatgtatgtatgcatgcatgtttatttgtatgtgtgttattacttagtttttatttatttattcccacgcgccccgccccctgccatcactctacccacagccccgccctgcgcgggtgcggccccgccccaaggctcctacacccaccccaacccccccccctcccccgcactgggcccggcgccagattaacctgcgcatttttagactctggtggcaacagcgggagcgcggaagtgtgaccctctgagacaccttgtcaacttcgcagttctcttcccggttactcacaggggtgcgggagcgcccactgctgtcaggaagcaccctcgcctttctccccctcccctcgtggccccgtgacgtcacacacagcctccttagacctgctccctcaaccttcaccactcaagtgcggatccgggatcacagagccctcgtgtggtgtccccgcccctcccgtgatcccggagactccgccccgtccccctgcaactgccagaagtcccacagctgcttccagaaccgcgacaggaattggaagtcgcagccacccgccagcgctgcccgcttggggtcatccaggtcgtggtgcagggatggggcgcgcagggcggccacgggggtccggactgagggataagggcgtgggcttggtgctcagcggtatccatgcggtgaatcaggcagcgcggccatagcgaagagttcaggggttactaagatcacaatccctgtccgcagctcattactccctggggtccacccgagggtgccctcctgctcccaacatctctcattcccctgctgcccgcgtcacgtgactctggccaggcggggcaactgtagtggggggcgaggctaggggtggcaccaaagcgcagccagggatcacactgtgtctcccagatggctttgtgacccctgacaccaagggtgacatctgacctatcatgagaaccccaacctcacgcctgacccctacatcacatgtgaactccgaattcagaccccaacatgacctctatagtgttttctgattcagactctctgccatgaccctgatattgccctgtgaccccaatggtacaccatgaagtcttaacaatatgacctccaaaacataatgagaaaaggggtcactacagtgtgcattacagcatggaaggaagaaagctgacaaagtatagcctacacaaccatttataggaaactataaaccttggaatggaagaggttgtcaacttcagggacaaccagagtctaaagattggccatatagtaccaaataatgagccttcagagcataaatatatgcaatgttacacagtctctacaacttatatttcaaaatatatatgcatatgcaaatatatatacacattcagtaagaattaatgaaatataaagccatgtgcattttaggagtgcagggagtggtacaaaggttgttttggagacaggaaatataaatgaaaaaaaaaaattaaacgacaatgtcagacacttttgtcaagagaaagaaaaagatatgttgagtattatctaaccttttcatactaagttgcaataaagcaatttacctttgtagttctgtataaaatttgtatctggtctaattaaaataacataacactttgggacaaagataacattagcaaccctgcactagaagccaagatggaaaagacctccacaaccaccatgaccttccccctggtgctatggtacacagggaggaaggtgatccagatactgcagaacaccagcatgctgaaagttaggaacttggcttcattgaatctgtcaggaaggttcctagccaggaaagccacagtgaagctccccagagtcaagaaacccaagtatcctaggacaaagtggaaggcaatgacagagcctttgttgcaagtaatgacagtcttcccatgttcagattgtacatcttggtcaatgaagagaggagatgctaccaaccagattccacagagaacgagttggattagggtacaaatgggaagtccaacttaggtgcccctgtcatcagcatccctctcatccttcttcctggagtagtgagattgaaagccatgaccacagttattgttttggccaacactgtagaaatagcctctgtgaaaaatactccaaatgtggtctgctgcaggatgcaggtggcctggttgggatgtccaatgaagagcaatgagcatagaaagcagaagactagagagataagcaggatgtagttgagaatgcggttattggccttcacaatgggagtatccttgtacttcacaaaagtgactagtactagcattgtgatggctgaggaggacagggaagtgcaacctaaagccatccccaatggatcttcataagtaagaaatgacacagctctttggaggcagtgggctttctctaagttggcatatttatcatgtggacacatacactgttccatatctgctggtgaacaacaataaacctgtataagatatcatagttatgcagttaataattgtgaatttgtattattcagaggatatatcaataaataatttgatgttgagcatctattccattccttattgttgtaggaaccatgaacctaagattgctgtcgattgaactatgatttatagtggaagaaaaaaacatcatagagaatggacaaaaaatatttattaaacaaaaaagaaaatattatgaaaattaatatgcatactctcagattattatctcctcaaaccataaattcactattcacagaaaagggtagtttgcagacatcactgttggtgccagttgttgcaacgcattgtgtactttgttgctttgtggattgtgcctatgtttttatttacatgtaggagctagaacatttaatttctcatgcaaatacagtttgcataaaggaatattttcattcttgaaactgtatgcctcatagacatatgcatgtccctcccattgtggtacaatctctttcttcccaactatacattccaagctgtaggtcacgaaggctattgaaattcacattcatccctctttccttaggttggctctgattgatgataagcactgtcccatctcttgttacattctggaaatcttcactcttgttctaattctttcacaggaaattcttaatcctttaaaccatctaagcacttaaaatatatttcattaaacaacttttaccctgaacatctggtctttgtcaggtactaagctgggtactggagaaaaagattatggactgatcatgtagtcaagttgctttgtataaaggatcaatgaaaaataaacgtatgcatagattatgcctaaaatttttgtttagaaatttgttacatgtatatatccccctaaacattttctatgtaacataaaatcagtaaccatcatattgtgagagaaatacattgtttgaagaagatattgcaggctatttgctgggtccaaaagcagttgatattatttaactgattaagtagtgaaacatgaagattttaggtcttcaattttcatctagaccatatatttcttgtttggaaagagaacacattcaaatttagcaatttttcttctgcatgcaagcatgtacctgtttcattggaaacctcattttctgggcactgaacacaatcaaaacagcagtctgctgtttcttcctgatgaattttcctgaatccagcagtacatgccacactacacatggagaagggaacctgaggaaatgcataaattgtatatgtttgcgtgtgtgaatgtagttcatgtgtacatcatatacataatgacccttagattgatatatgggacattaacagatatggctataaatattcctctgataatcagtattacttaacaatttcaggcacattattatttgtattaccctgcagtgcactgaatgtcacaatatttaatacaccatgtaataatagatatgtaatatttagtttgaagcaatttaaaatttttccttcctaaactgattaatccaaaggaatgtttatgtggcatcagttctctaatgatttacaaataaaaaataacaatactgaggtgtgtagagaaataaggtaggatagatcaagaaagatttgtttgatgaatatgaacaaaatatgctatataagactctcataaaattaaggaagctttcctaagtttaaaagaaaaccttgaaccccctataccttcctctgtttcccctggtttttatgagggagctcccctatctactcacccactcctgcctcaccaccctagcattcccctattctgggacatcaagcctccacaggatcatggtcctcccctccctctgatgtcagataaggcaatcctctaaagaagaggggaaacatggaagcaagataacatttgaaatgtaaataaataaagtaaccaataaaaaatacacaaataaaaacaggaaaccttaaatctggagatctctgttaatgaatacatcctatacttaattaggctataaatatgtcacccagaatcagaaaattccatggtgtgtgtgtatacaaaatttatatatatataatatatgtaataaacatattcctatagtgtgggatgaataggcatgtgggtacaattgaacatggaatcaagagaccttttttccctatgaccatttttacatgaagttgtgagttatgaaatatttgtgcttgtaattgaggatagtcttttgtaagactagcaattggtctcaaccacacagctattacttcactgcctcatattttaaaatttaggtatcatgaaaaatataaaattgtggaatacccactgatgttcctcctgtggcccactccgggtcttcagatataagaagttgttgggtctgtgggaaacaaggaaaatagcttcctattttcacttttaatccaaggccttgtggaaaattccaaatgatacaaatgtcatactctacacactgatattccctatgattcatgttcaccagttcaccatcaggtttattaaatatctgggctttcagcaaggaaaccaattaaaagaaattcatgattacataagcatattaataaggggaagacaaaattgagaatttcctctaattttcttagtctttcagaaaagacagctctatgaagtaaccctgtataataaaatacaatatacctttttgataattgaaaatttatatacttcatattaatgtttgatggtaaaatgtactagaaaaaatgattaccagataacaagtaacatggtgtgtgaatgtgtgcacatgtttgtcaaaaatactttttaaaaaatgaagccatgtatgtgcaaatgaaggggaattctgaatgtgtgtgaagataaaggatggttgtgggtctttcatgaatagacagtatacatatatgagataaacataaacttaataaaatgtacagtcttaatcatttatggttttgtaagtaattgtaaagttcaatgagtaactatttgtactgcacatgtactgatccctgagaaacttttcttttttgtttttgggtttttttccaagacagggtttctccgtatagccctggctgtcctcgaactcactttgtagaccagactggcctcgatctcagagatcctcctgcctctgactcccaagtgctgtgattaaaggcatgtgccaacactgtttggatgagaaattatgcattaaaaacatattctagtctagtcatcatttaaggcttttatgataaaactcttggttcctattttaaattttgaacttatttatggaaatcttgagacacgttttcacaaaactcactgctatcataaaaaacgttttgtctcctattaaatgttattttgtgcatgatattcattcatgtaaatgattaattacagagtttttcagtgtagaaatctttccactgacagaataacctttaacaaatgtatacttgtttctctgggtccatttaaaagatcacactgttatatatataagcataatgaaaagtaagaaactttacctgctgacagtcagtgaataatcctttctgttctgctattttctgagactctacttgttgaagcatgagttcatggtaggtgtggaccacaacatgcacaacattatacagactgtaaccttcttcacttagggccatgtcacatttgtgcaatgctgtccattccgatgtgctgtttaatgtaaaatgatccattttattgctgttcttagagactgaacaattaaaataattccactccagtatagactcagaaatgtttactggtatttgttggttttcattgtttgcaaaaaaattcctaaatttagcaatctcaactttgtggtgtgcaaaagtgacagtcccatgaagaaatcaaggttgaaatctcttttaattgtgatgacatcccattgtgaggttgtgatccaaattctgcgtgcaaataaatattcccatcttctaaagctgatttctagagttgagttcatttcaccataaatgataacaacttttgctgatgatgtcataatttgcttatcatatgtcttagcccttgtcacgtgtatgtgcatgttttctgggatcacattcacaaaagctaaacagatcccatgtctttgcatttcttctgttgagtctgagagaaactgaataccctggccatcatctaggatgaccagtcctatccaagtccatctaaaatgaagcatcaaggagaccatgccatgggacaaacgtgtgtccttcgtggctacctgatggacataggggaacaggtcatggtcacttaggttaggattaaatgttccaaaaaaacctaaaggatatagaagagatgataaaacatctactgaggaatatgattgtcatgatgtttggacttatatacaagtaacattactcatctttcagaaatcaatcaaagatagtaaaattatactataaatattccgttttttaaaatatttttattatgtattttcctcaattacatttccaatgctatcccaaaagtctcccataccctcccctgccactcccctacccacccattcccactttttgtccctggcattcccctgtactgtggcatataaagtttgcaagtccaatgggtctctctttccagtgatggccgactaggccttcttttgatacatatgcagctagagtcaagagctctggggtactggttagttcataatgttataaatatcattcctattagattgttgactatctctgatacatcccactgttctcaaaaacagtttgcctgtttggcttgtacatctatgatctatttacttaattctttattttatataatataaataatatatatctattttaaaatgtgtgtgtgtgtgtatgtgagagtgtgtgtatgtgtatttctcagtgtgtagcaatatactcatcactcataaatgcacgctgttcaagttttcttgtaggcaaatataaatggaatttaaatgttgttaactcatccagtatcacacattcttaaatatggtgtcctagaataaattgacagttttacagctgttttccatgatggtcctgtaagatatatgtttcaatcatcctctaattcacagatataattaaaaaccaaatgatttttttcttctaaatatatcttacccagaatcccaatttatcctcacacaggccatccatgaaggagaatagcaaagacgtgttgggtaaatgataaggattcttgttgatctcatcagtagcaaaaaacattaccagagaaaacttgtatcttctcaatgatattctaaaacaaggcataatgatgattaagaacgatgtttgaaacaaaattccaattgcagtaaagtttgtaatatgagaaatgctaaatttctgtctaaatgtcttgaaataaacctcatatgttagcaatctttagaggtgaatacaatttaagattcatagacatagggcactatgatatgataaatattttattcatgaaagttaataaagattgttttatctctgaatgccatccttgaactagattacagtcctattgagaaagactgctataaaataaccttgaatttgtatttccacagatacataaaaaagcatgacgtaaaccatataaaatatataacagattctccttaaatttttttattattaaaatgcattttatgtatcaaacatcttaataatactgaatattttgagaaccaaataatacatcaaaattttgttcaactttcatattcctgtctttttatactttaaaaatatcattaatgcatatttaataatatccatacctgatgatcctatgtctactttttagtactgcctgcctctgcctcccgagtgctgggattaaaggtgtgagccaccacgtctggccttaatgtcactttttattttgagatgatgattatctaaatttttcattccatgttaaatttgagaaactttcagatattgtccaattgttatgctcattttttcataatttttgttgatgtaattgagatttaagctgtacattcagattattttatactggtatattccttgtcctttcagtgtatcatggctatcaattatttgtattcatttttttctagcagtttgctaaagttgctgtcacttgtaagtatatatttttggggaagattgattattttacaacatttaaatgctgtatataacatacaatatgtagtagagaaagtaacaaatacagctcctgggccctctgggccaaccaaagctgccctgagcagaccgctatgccatgtggacctccactctcccatcatctctcctcaaacctagtcagactcctgaaccataaggtgccgaaacatacagcctaatgatatccatcagaatcctgccacaccaggaaaattgaagttcaccctcttccaaatatctgctgcaacaagaacatctagggattaaaaccatccagtttactaaaggccctcaaaagaacaaaatcaacaaaagccttggcagtatgacacttccaaagcaaatctaccccactacagcaagctcggacaacctagcaaaactgaaatacaagaaaatcaccttaactactatcttacaataatcatagaggccttataataggaaattataaattccttaaagaaacactggaaatacaatcaaacaataaaggtctttaaagaagaaacaaataattacttaaagacatacaggaaaatagaattaaacaggtaaaggaaacaaataaaactgggcaagacctggaagtcaaaatagaagcaataaagaagacacaaactgaagaaattctggaggcagaaaactaagggaagacaacaagatcaacagatgcaacaagcatgtatagaataatggagatggaagagagacagtcaggcataaatatacaatacaagtaattaatacatcagtcaaaaatgttaaatataaaaaactcctagcataaaacatccaggaaatctgggattccaccaaaggccatcaaagagcaacagaaataaaagaatgttaagactctgtgatagtttgtataggctgggccaagggtgtggcactattagaaggtgtctcccagttggagtacgtgtgtccctgtgggtgtgggctttatgacccttattctgactgtctagaagccagtattctgctagcagccttcagaggaaaatgtaaatctctcagctccttctgcaccatgcctgcctagatgctgtcatgttcctgccttgaaaatactgaactgaacctctgaaactaagaattgccttggtcatggtgtctgatcacagcaattgaaccctaactgagacaagactccaagctccaaggaccagaacatattcccaaaataatcatagaagaaaagtacccaacctaaagaaagagattcctagaaatgtgtgagaagcctctagaataccaattagactgaaacagaaaagaaacccatcctaatacataattatcaaaatacaaaacctaaaaatcaaagaaagaatattaaaagtagcatgggtaaaagaccaagtaacatacatagacagatatatcagaattacatctgacttgtcaacgtagacagtcaaagttagaagggcctgaacagatatcctgcaacctctaaaaaacataggtgcctacatacactactatgcccagaaaaactcacaatcaacttacatggcagaaagaagacatttcaataaaaatccaaaatcaaacaatatctattcataaattctactctagagaaaatacgagaaggaaagctccaaacaaagaaacataactacatccaagaaaacacaggaaataagcaatcccataccagcaaaagcaaagaaagcactgacaaatacataaacacacacacacacacacacacatactaaaccaccaatgacaaaataatggaaaattacaatcactggtcattaatatctctcaacaacagtggactcaattcccaattaaaaagacataggctaagagaatggatggaaaaagaggatgcattatccttttgtatacaagaaacattcctcaggaagacaatagacatttcctcagagtaaagtgctagaaaaaaagttatctgagcaaatgaatgcaataagaaagctgggggtagtcattcttataccaaacaaacaaaaaacaaaaataaacactttcaagcaaaattaatcaaaagagacagggaaggacacttcatactcatcaaaggaaaaatctaccaagatgatatctgaattatgaacatctgtaccccgaagacaagggcactcaacaactataaaagaaagactgctagaatgtaaatagcacatcaaatcccacacattaattgtagggtatttcaagacctgactagcatcaaaagacagcacatccagacaaaaccataatcacagaaataatgaaactaacaggctctgtgaatcaaaaatacctaatagacatgtacagaaaattcaccaaaacccaagaggatatactttcttttcagcacctgagggatccttctccaaactgatcatataatcagtcacaaagcaaatcttgaaggtacaagaaaattgaaataatgccttgtatctaatcagaccaccatggatttaagttggacttcaacaacaggaacactgtaaagcctacacactcatggaaattgaacaagtctccattcagtgatctctggggcatggaaggggggggagagagagagagagagagagagagagagagagagagagagaaagggagggagggatgaaggaaggaaggaaggaaggaaggaaggaaggaaggaaggaaggaaggaaggaaggaaggaaaaacactttatggaatccaatgaaaatgaaggtacaatatatccagttttatgagacacaatgaaaacagtgcaaagaggaatgttcatagcactaaatgcccccataaagaaattttaaatgctgaaaccagcaattgaaaagtacacctgaaatctctagaaaaaaaaggtgcaagaatatcaacaaggagtagaaggaagaaaataatgaaaatcaaggctgaaacaaatcagttcataacaaagaaaacagtataacaaatcaagaaagctaagagctgattctttgagaaaaccaacaagatagacaaaccatagccaaaataagcaaaggacagcgaaacagaatctaaataaacaaagtcagtaatgatgagagagacaaaacaagtcacattgaggaagttcaaagaatcattaggtcttactccaaaagcctatactccaaaaaaattgtaaaatcctaatgaaatgggtgattttctaggcaaataccaattggaaagttaaatcagggacaggtaaactatttaaacatctctatagcccctaaagaaatagaagcatgtattgaatgtctcctaaccaataaatcccagtagagagattgttttaatggagaattctaccagactttcaaagaagagctaaagccaatactcttcaaactattccataaaatagaaacaaaaggagcactgccaaactcatgctatgaggccacagccactctgatacctaaaccacagaaagactcaacagaaagaaaactttagattgatttcccttattaacattgattcaaaatactcaataaaacacctgcaaaccgaatccaggaacacatcaaagatgccatcgctcaagatcaattaggcttcctgaaagagatgcttagaaatttaatatattgaaatctaccatataaacaaacttaaagaaaaaactcacatgatttttctcattagttgctgaaaaggcctgggattaaatccatcgcctcttcattttaaaggtactagagaattcatggatacagggtacatacataaacataatcacagtaacatacagtaagccaatagataaaaatcaaactaaatggagaatttcaaacatttcctctccatttagctataaggaacaagactaaccttcccactctatccctatctatcttttgaaaatatcacttaaaattctagccagaaaaataagacaagtaaagaagatcaaagaaccagttcctggtttgattgattctttgttcagttcttttagtttctacttgattgatttcagccctgagtttgattatttcctgctctctactcgttttgagtgaatttgcttcctttgttctagagctttcaggtgtgctgtcaagctgctggtgtatgctctctcccgtttctttttcgaggcactcagagcaatgagttttccttttaggactgcgtttattgtgtcccataaatttgggtgtacccattttcattaaactctaaaaagtcattaattcatttctttatttcagtcataatggtgtacaaagttcatgccagcgtttgaaaagcagaggcaggctcttacaggattgaggcctacaaagtgtcttcaagacagccagggctgtttacactaagtaaccatgtatgaaaagaataaaaataaatttaagaaagaaaaatactattatgaattaggttcacgaatgggaataaattcataaatttttatgttgtaagaaagcatttggtaggtattttacttagacagtcagtaccccttaaatatttaatactattttaagttgtttaccttctgtttcatagaactctgaacagtagaattgtgattgttgtttgccttacatgtccaatgccctgagtttgataccttgcacagcaaaagagagattgtgattattgaaattgtcagagaaaatggcaagggtttgatctagatcatgcagcctcaatctgaatccttgctctgccactttctgcaacaggaacatgcataggcattcgccgttcttgcctctttcctttctgcaagaggaatggcaagaatcagtgactttcagcttatgtctacttaaggacaacacggaaaaaggttcagagccttgcacctagtgagactagacaattgtctcacagttaattcatgaagtggctcaattgttcctgagtaaggtttttgtttttgttttgttacacccaagaatattctctaaaatcagaactttttacaagcttaaaatgttcttatattttagattcttagatttaggatctgtatttttatattttggaacatcaggaggagtgttagtaataatattattataaaataatattagcctaataatccttataaacactctctggttattctaagtcattaattatccttatgaaataatatttattttcatctccataaatgtaataaacatgctgcagaacttgttagtaacagctaaaggtgaaagaaaaattccctttgtatatagatttttggtttttttgtggactactttttgaaatatgtctaattattacagtagtatgacagtttaagagcttagaattcagccaggcgtggggtcgcacacctttaatcccagtattcaggatgcagagtcaggtggatttctgagttcgaggccagcctggtctacaaagtgagttcccagatagcccgggctatacagataaaccctgtctcaaaaaaacaaaaacaaaaacaaaacaaaacaaaaacaaaaaacaaaaagaccttggaaatcaaactgaccggagttaaattccaatttgggcattcaccagctgtgggacttaaattactaatctgtaaaaggtggggctgatagtaatttttccccacagtaccatgagaattaacctaaccctttgtaaaccgtttgtgttttattatttatcaggaacattgggtagtagtagctattgtaattatttcatttataaagtttgtagagttgtgcagaatggagtttatcaaacctaagtatgtgaaagtatacatcttgaaattgttaaaatcagatttatcttataaaattattgttttaaaagaatgcagctagaaattagaataggaaataattccatggtattgttcaagtgatttaaaattctatcggataactaaagaaactgaaattcatctattaaggtagcatacagtccataaaatattctatattatgctaagataccattctccttaaatgtgatttctaaagttaactaaatctgtttttaatgagaaaatttatctgggtttgaatattctttttttttccttttaggcaatatgtcagtattgagtgaatccagacatcatagctcagtaaggcatagtgatattgattgcttctttgtctcaggaagtataagaactggcagatctcaaaggtctgtattcatgtttaagaaaattgacacacatataaatgtgtgtgtgtatctgaattgataacaatgtattctttagaaaatattttgatatttctcagtcaaatctatccctttgttcaaattgcctggagtccattatcacaggtgttgggaaattagaaacttgctatttggtgtaagttgcaatatacagggaagactatcttaaattgagtaatctgttatctcatatagatgagggattctgaatattttccatatctttttgttgtttgttaaggggaaacttctggtatcctgtgtctttagactttctgttcttctgttcaagtaactctcctcccttcatctaggtaaacatactaactttttggttgtgataattttgtatcattgagttgaatcatctgggcagtcttttttttaatgaaatttcaggcttatgtatgtactacttactagtattagaagcatttgtttaggatttttctttagttttttcttgtcagattgaaagaacctagtggggaaaccccccactcaattcccgaatcagagtgcacccaaggaacacgagagaccgtcttgatgcaaacacacaaagtagtttaatgacggagctccgagccaacctgtatctcacacaggagacagaggttgttgaccacgaggctcgaaagctaaggggttttatagaaaagggtctggcgctgggggaggaattggcacagtttcacacgattggttcatttaaacaccagtagaatgattacacaccagaaaaagattatgtcaggtccatgagtcaggaattctgagggccaggtgcttatccaagtcagcagaacatctggttaacttttaaccaaggtagacagggtgggagatagggaggcgcctggccaatccccacattcttgtatatcttctctatctttgtggctagccagttcctaggatgactttacagcctttgttctttgctctaggcccaaaaagccttcctaactagcaagctgcttgagtcatggatcttgaattttaattttctttcatctagaagtagagataaggatttgtttaattccctaccaaaagctccttcctctttctacacaggtaacctagcaacgttttacatgacaaagccttgcctgcctagctgccctcagatcagcctggaaatcaacccctcaggagcctttatcagatttaaacacacaaataccactcctggtgtcctgacttttggaatgtcagccttgattcccttgggcaggcttcatgctcactgtgatttatgcctagccctgacctgggagaactttcacagatgggatgctgtgtttctctcatgagtttagaacacccagggcttgaaatcagacaatgccctggcttagatttaaaagccttttaaaaaatggagtctgactctcagttcctcctgttccactgaaatgccctgtcattcacacagacagctgtggtggactgcgcttctcagacccttggtgggtgaaaaacagtcaatgttgcctgctcctgtaagaccccaactcattgtgtttcttagacccctagaaatgaagcccagcatggagttcttagttttttcaccttcagcctgaaagaagcccagcatggagttctttgttcttttgccttcagcctgaaaggtgagatgggtgacccacctaggcatctgacccattgtgtaagggaccaagaacatttacacaacttccccagtctttgtgatccatccttcccctcactttcggggagagatgagctgtaattcaccatccccacttttatgatgcttatcctatccttccctcactttatggttcattctttaaaaacctccactgcaactgctggaggtctatctcctctgccccttgtgggttacgagctcagtctcagcatgctgatactatttgaataaacgtcatgcaatattgc

SEQ ID NO: 304 - DNA, 49363 bp, Mus musculus
acagccgctctcggcggctgcccgaggctcaccgcgccgccgccgggcgctgactcagccgcagtccggctgctccgccgagccggacctggggagcgcgcgcccggagcctgcctggagccacccgaggagcaccgcagcgcttgagccgcgggcttccggagctgggggctggcccgtttaggtccctgagcgcatcggactcgcttggccaggtaagactgcaggagcatcacccggagcatccttccggatgggcgggagcgcagcaccgtcccccctgcgggagatcgtcccaggtagcaggagcgggatctgcaaaagcagcgggcctggcctggataagccttggccgctaggagacttgagaggacttgacaccaggaccccttggcagcccagtgcctaataccttagctgataactgttaaccaggagagccagttccgagaggccagtaaatgcagcgcttgggatggaatggcacaaggcaaggctttgcagcaaacagctgtcttgggggattctgctctcaacaccagggagttgctaattttgggttcagattcattacttccctttgggagaccctcctccatcgacctttaagggatccaaaggagtgtgtgttgaaactgagtcaaagttaccaattccctcttgtcaagttcagggccgaaaattccatgtgcttgtgactgtcagcagcagagaacagagtctcatcagtgtagttgatgaaggtcatgattgatgggacttctggggaaagttctgttggtggaagtctttctaaagaaatgtcaagtctcagtaggatttttgtcctgatctctgtgaaaagcctaatgcaagttttcaatatttttccccatgtcagtggagaatgtttccggcgattctgtgaaaactgtgttatcgtgctaaatttgataatagtctttttgcccgagggatcctgttctggaatggcaagtctctgtccaaagctatgaatcttctcattgcctgtactctagggtcccagtgtcacaatgatctctcaagacatgactatgtacccagaaatgaagcctcacccatcgtccctgctgccttcctgggagaggctcccttgtaaccacttctgcaccagcttggaggttctacccccacatcctctgggatttccctgccctcccaaatcccagccaaagaagctaagcttttggcctgacactataatccatgcaatcttgctacatgcccccaaaagtatgttgtccagcatcacagccctcaggaagctatttcctgagcagggctgtaacaatctgattcgttgcaattcatggtcttctgcaaagtaggtttaggcaatcacaaagctgaacaccaagcctttgggtgtgacttgcaaattggactttggtaaaggttatatttttggaggtagctcacagtatgcaccagctttgagaacacatgagggtgtgcaagcaaacccctgctttaagaaagtactctgaagcaaatggccttacatttgcccaagcaaggaaccgtgaggaagctattcacttactctatgtacctttgcattaagatactctacttccaaggaactaattccctaatcacttttccaataatgccatttattatttctgaggaaaatgcaggtaatgaatgcatgagctatgtttctgaattcacctacatgtggaaaaatcatagcaacttttaggctgttaaaggacaaaacgtaagtctgatataaacaaggatagagtggaaaatggatatgtatacattggtgaaaagcacccgtgtatgtgcccggaaaaaaaaaaaactagaaattcaatggctgcttacatcgatttagcaaattgtgtatctttccagcctgtttccttaccgggttaatgaaagatgcaatcatcctgaatatattgcctcactagttaatctttctttgacaaatatttacactacaagggctcgatctcacagcacagtctcaaaatcagcatccctgcagtggtccacatatagtatggctcaaattcaacactatttccaagacttaaatggaaactgaaatgacatcaaggaaaatgtccttacattatcctgcctggccacagtagaagaagcactgtttataaagctgacagggttccaagtctctgaggttaatgcttctaataagttcaaatgtggaaaaaaaagcatgctggctctgaatttgggcatcgaaggttctggagctactccacgtttatgagtgttttaagtgactgaagtttgttcttggaagtgatatgttttagtattttctttggaaggaaatattcctactgtgccatccttgcctcctcccatcagagagttggcaaatgggaatctgtgtttcctgctgactcagggtgggtgctgtgaaaatcagttatcctggtctccttagggaaaggctcatgggtacgtgtgtgagggagtctggtcagagtttagtcctggctctataactaatcagatgacattaaacaagtgacctttctgattcccttatttattaagccccagaataaccaataccaagtcagttgctcttattaaatacctgccatacattaagtattttgtatgtgcattcttgtaactttcacagcaacattctatgtatgtatatggatagtggggtctttgtatgtatatgttcatgcatgtacaagtgtgcatatgcttagtgggggtgcatgtggagttcagaattctacattgtcttcctcaaccattctttatctcattcattaaaagaggatctcttgtgtgacacttctagaacagatggccaggggaaccctgagatgctcctgtctctgccttccttaccaggattacaggcatgagccactatgcccagcttttacatgggtttttatgtttttaagcagacacctgaccaaccaagctatctatatccccagccctcagagtcacatttttatctccattttctgatgaggaaactgataattagaggaactatctcaattaatcaagattgattgcggatgagagaacttgagttccaaagtagcatgaagacatttgaagatgctgcccttcttccctgagcttcttcttcattgcctgaagttgcttaaagaaaaaaaaaatctctgatagacaggcatcactcaaaaatcatggaggtgcactttgtggtgataacaacttccactttctgacgactccatggtatgatgtcttttttcatgtttggcatctgttgacggaaccctttgttattagccatgacttacctattatcctctgaaagttcctctctgcctctaggactcagtctctactgccttcctttctggggtgatgtaggaactggaactggaattggcattggtactttctgtagataagcccagcacatggaaggtgtttgacacacagtgtttagaaccaattcttcctgtctggtccctcctatactctgctcctgtgtttcacaatggacaatggtggtcaatagatttccatggcatgtccttgaacacagacttctgtggtagacattccctaaagaaccccttgatgtgttccctttattacattgccttgggccattccaggtaagtgtccttgtgaaagtcaatcctaaagtaatgtagggaggtattgtcacagactagaagaactagggttgggatatccactctcaagtgcccctagatccatggacttataagagatccccatagccacagacactctacacaaatgagcatccaccagagatcatgtaaccttggccttcatcctctttcatagtatctaacctggttgcttgcctaggattgcttttgaacctcaccctgggctgtagagcagaggaagccctgagtgagtgaatccctgagaatatgtgttattgacatgggcagggcatcagacccatgggaaaatgtcaacacttcccagccaccggggtgaggctcataaggaagtggcaaagccttcccatgtgtgaatgctgatattgagtgcagaaaatgtccagatagcttcccccactgccccaccctgcctagatatttatagcctgaagactgctttcctacagagattacttctaccaagactagttaaaccagcctcctttatccaattgtatacaaaccctgcctccatgttaaactctatataataagcatgctgcacttctgtagggctgtacttttcaagcagagagctgagaccacctcctctgtgatcccagttttctatctctgtgtctgcttgtatttcttttcttcattcccttgccaatacgctcaggttcatccctggacaatgctagacaaggcatcccaggtctagcattaagagcagtgcaagagcctccctgggccattcctcagagcctagccccaaccttggcattcaagagtttttagaatttttaaaggtctttgttttgcttttaattgactcataatggttacacatatttatagaaagactgaagtggctcacttggcaaggacaggcccagacagagggatgaagagaaaaggcacttagctacttagacttgaacctctcagatgtttctactgaaatctactagtgacaggagatatgaccctgggtagaaagtaaatgacccaacaacattatgctttcatgtatagtttttgttctgacctttggggagtttcatattttgtctctaaaagatctgactttagcacttggccccatcagaatcccaaggacgatttctttacccttgggacagaatgatgggaagtgaccctgaggtgccctcaaaggttggaacaggttagtaaggcaagaactgtgcggctgcttctgcagccctgtctggaagagacaaggtgagcgaagtccaatgtcctttccttggacatgaattttcatgctctgtgggcatgatgacatgagtttgtcatttggagatcgacaactgacaagtgacccgataatgcaaataatcatcatacctctttcttgttggcaatgcaggttctccttagctcaaatggaacttcttatattctagaagactgtaaacaaatgcctcgtgtttgtcatacctccatatgtctagagatggcataactaattgaccatggtactgaatgaggccttgaaatcctcaagagttgcctagagttggcttgagaaacgatccctagtggggtaccatgtttgatgggaagcaggcagaagttttcagccaggtgatcaaaatgaaggtgaaacttctgaaatggttggcccttccttcctgacatccttgcttctcccaagtcaaacgatcatcttacaaaatgtgcccctatatagtccaccatgtcccaagtgtcttcagacagacacacccactatagcttatttgatgaccttctgcttgcattgattggggtgtgtctgtgtctaccctggactgtctaccttatattatgtgttacctatatagctaagacaccagggagaatgagacttaaggcttggaatgtttgcactctgagaaggcagacggcatactggcatagcaaggaggctttgtgcacgagagcagggacctctgggactctgaagggctaggtggacctgccagccagaccctcattaacagcatggccttcatcttctaagatgaccccatgcctggaaaacagcattgccctctcttattaactgaagtctcataggggcccttgtcttcactgggccaattgatttgacaaatagatattctgggccaaactctcgggaagggagttccattccactggcatcaactctatagcagaattgttcactcaccagcaaagtctgtgtccccttccctgtgtcccagttacaatattaacatattcattctcagctctgcagaagaatggagggaagctgccacttttagcaagcagagcaatgaaagtcgtgctctccccggcagccacatcttcaagtgaacaaggacatcattgttaatcaatatacatgcccactgaaatccaggactctgagaattcattttcttcttcagcgatttccatgataactgagattttatctgagatagatacagaatttctaactattgttgaagaggaaggatttgagtcctgctgctctgccactctccctaggtccctttacttcacaactggaagtgggcattccaacctgtggggacaaggaagggatttttgcctcctttagaaatcagcatccaaaagccttaaccctttgactcaacaagagtcatgtttcagaaattccaactgggtgagggggtctaagagagcttccttacatggacataagatgttgtaaagatggtgagaagagagatctagttgtcaagacccatttggcatattgactcatttcagaaccgtgtaagtaattatcctggtgatgcacaggagcctccattgtcaaacttctctgacatggcttcagatcctaactccatgttttggtgaatgaacacacatattcctctgctgctaggagctcccttttctccaggatgaaatagaggcagggatatggcctccaaaaccttaagagaagcttagggagaactatgtgtggctaatccagcactatgctcaccacacagtaggttcagggaaatgtgtttggcaaagtagcctaattatgagcgtgcaccttatcatgcagcaggcaggagagtgatgcccaaagaatcttccagaaggctcattgtaaactacagtcaggacccaatcctgatctccctagaccagaacttcctggtgtagtatcaacaatgaacattttgaacaaacatttcaagccttaggtatgagaatcactgaacaggcttgggcacatgcatcaatttttcacacttgcttgacctaaactccgtatcatccaatatctatagttcaacatctgacagaaaagcaagtgtcctctttccccttttgaatgcacacatccactttaactcccacaacagacattgaaagggcaattgctaattttttgctttccacaagtcatgacataccattggttgtcaactgtgcccatatccagagcttctcagtccagctgatgcagcctcaattttcattgctcctgcctagaaaaatcataggacaaagacaagacctggatctggagagaaaccacagggctgctagctttgatgccattgtctcttttaacagtagccactgtgtagtaaaagctcaggattgctccaatttcaatgtacaagtagggagagagcttgtctttattttaggactgtgtgtgtgtgtgtgtgtttccatctttgtataaaatgaattttggagttatagacaacgtgttcctttaggggaacaagaatttgcatagttgcatcctatggattcacaggaagcatttactgtgttttgtggttgtcatggtttgtttatggtgctagggattgagcacagtgtcttatgaggctaaaagtatactctgccactaaatgcaaaaatcagttccccaatagaatctttttggaaattatttttgattatactaggtgttctatgtgatgttttcagaataaaaggaggaaatgactacctgtaatcccagacccatgaccagtatcttagtatttcctccagtttttgctacttctctgtatctttgtgatgattttatatttagaaaataatgggttatatgaggaagtagaggaaactgttcataagcactgtgacccacgtatcctgtaacacagcctggagtggctctggagactcctagagaaagttctatacaggaggtaggatatgggccagagagtcgggcatagtgtttctggtggagagagcaggggtggaagggactaagatcagcatcgcatttttgcagttatcaaaaggtagatgagtctatccccctccctcagacactgagagggccttggaggatacctcagtgggcaaaaggaatcaaaagtgatgctatgtgaccttcagggctgcagaagcaaaggccataccacttttttctggtctgtcttgagacacttgctttatgacatttgatctgtcttatcaactgccctggagccaccatgtgggatcacataacattagccctgaaggacccatgctgagagtttcctaaggccagggactggagctgtgagtaaaggtccttctccaagaagccaacctcaatggccatatgccaaaacacacggtagagccaccagcagggtccagtcagctcctaagttcaagagcaacgtaatggttcttgttgttatttaaaaataaccaggacaaattcattgtacttattttagacttgaggtaaacagattgtcaagggcaagatgcttagtgaggctgtctggggatagagtatagaggtcttggtgctgtggcatggagaactgtcagctcctgtggaaggaatttgatgacagctggtaggcatagtcatctctggagggttctttccacattgtcaccatgcctgcatcttcagtctgactttaggaagtgagcactctggtcatcagacataagcatcctagaatctgaggccaaactgtgaaagaggtcattcaagccctggtacagatcaattatggggccatttcttaaaccccaaggcttggttctatgtctactgcctactctgatacttattccaagttaggtggaggcttctgagacactggtggaacaccacgttagagtcttgataaagtatgaagtgcctggctggcttgggaggtgcttcctttcctttggaaaagatccagctgacaggctttgggacccatggcaacagaattgccaggaaacttctcagagagcaatttctaatcatttgtccttccttggctccaacctcagagagtggcatctgggttgccctcatgcctgctgccagagctatcaaaaccctggtcccacacattagatttggtgtgagcccatcttcactgactaggagggaaagctactacccgattgtcagtagggcagtgctttaccaatcctgaaactaagacctctccaacttttgtgcagatgggcagtgtcccagattgcctgagcagtgacttacctgagaagcaggtaactactgacccagcctctttcatctaacctgggcttggtttgtcaagagtggtacaagaatcactgtagcgcctgctgattctggcacatcctgctgctgccttgagcctggatattacctacatccaatatgaaattggcctcagaagcttgcttgctgaactcagaaggaagaaggtgttggtagaggctgaacacaatggctttctgttcagtcaaaactagacagacattttcaaggactcctagcaggacggtgtaatgaacagatgctggattgattttctgatttcccacaccttggtgaccaggaggtggagatagagatgaatgaagagcaagtagctgggtgcagacatgggaacttcagcagagtcacactaattcacactttggatggtcctaagtgtcaggctcctctaatagctactactctgccctaaacaatgacaggcaactctttcgacttagataaaacacacattttgttacctactccaaccaggctgtcaatcccagagatggagtgtccaatattcatgagaagggatgagaggactcaccaactggcggtgggatgggtacagtcccaagcctccagtccccagccccagcccccagcccaatccaggacagtatcaacagcacaggaggaggggatctgtatctaaatttcatagaaaagcagggaagaaagatgagaatagcaaagaaccctactggactaccccctggagggtaactctggccaattgtgtaaggcatgtatacatcctaggtgtatcagcctgtacaggactcaaccccactcctcatcactcaccccaagtggtcatccatatcctctttctatcttagagattgtactgaggggacagttggcaaatagaatctgcagatgcccagtacacattgaaatagccatcatgtgatgtacacattgaaccccagattcagggcccatagcttgggtttgtcaaactggagtggtttataacagcccccattctataggccatataggagcccctggagccccttcctccaagccagtatcgactggcatctatctgttctgagtgtcaggttagggaaaacagcaggtatacttggcatcaccttcctgagggaagaggactctgagagctggcaggtagaagctgtctaacgaatctcttatgaatccaaggttcccagactctcaggaaagtaaaggctttcatgccaagcttgctccttgaaatctacatgttcatgggatggcaaaatcagatgtctatggaagtcaggcaagtgccatgatggctggagcagatgagtctgagggacagagaatggggacactggagaacagacctacaggctggagactcagttttgacattgtgttactgctcccatctgcagccccaacatagccaggctattttccaaaagaaaaacatcaagtatcatgtgaaattgtccaatagtcagcacatcaaatgagaacatcatataactttgttcagatcaacatgaagaaacaccatgttgtgatctttggtttaggtactcaatggaaattgattagtgagctgaagttgctgcagacttttaaacttggggatgctccagcacagaaagatacaaactatctcttctggtggatgaggactcaaatggagctttaggttggcttctggttcttgtctcacactgtccaaatcctgaatatttccattaacccctactctcagatagatatggaatacttcagagataaaaacagaaccatagtaaaaggccaggctgggttacttagcaagttcaaagccagtctaatccgcatggcaagagcctgcctgacttcaaaagcgaaggcctgaggatatagctcagtggtggaatgattgcatagcatgcataaggtcttggttcaatccacagcaccaggagaggaaaaaataaaagaaataaaaatcttcttgccctggttcactagatctacttccccactgtggagcatgggatgctatgtacttcaaagattctaagttgtcaccacatcctgaaagcacagtgaaggacatctagggtgcaggagttccttttagacagcctctcagagttactatcatgcaggtacagatgtgtctgtgtctctttagatgccccaggtgttcctagcctacacggcatgacacatgaatagatgaagtgagcacctgctgtgaacctctgtttcttcatctcattcctgtcctacctacctcatcaggaaaacactggaatgaaaaagtgggatatagacataatattgtttccaacaggggggtgtgataggagaaagggcatgctatcattctgtgcatctgccttccttgatcgtgagaagggaagacattgactttggcacttctgctcctccttctccaatctgctttagccagatggcctggaggaggcctggcctggtggttatcagaatgcactgaccctcaggactcacagctttggctaacagcaatttaccattgtggtgttgtggatgtgaagggaaagccaaaagcaggttctcctccagacaagtacactcagcaccagcaccaatgggcacctgtgactctacagctatggggaagtgtggggaggcagaatggctagtcctcatcctgcatagttattgagagcccacttataccaaagcagagaggatgaagtgcagggttccctgcctccacagctgctaaagcctttacttctttgaacatcataattaacccaaaaaggagtcttccatttaaattggaaagatttcctgaggtcttgaggcagaagggtcctttgagaaagacctcaaagtgggaaaacccatattgtgtttaagaatttaggggattagaaaagtaactcgcgagaagggtaaggcaggggagaaagtggagagacagaggagaagcagcagatctttgcacggagaggcacactgctctttggaaatttggatatggaaaattgggatgtgtcttctactaccccctcctatctaaactgaactcattctcacagagtgggctaactccttagtggaaagcttccttcagagatgcccttctggggttcctaactgccctgactcaagatcatcagttaccccacaggcattttccaccctagccccatctcctggtcctagtcctagctgatactggcctctgtctcttttttatatgaatgaacacacattcctcctcttaagtcttctttcgaaaggtctggagagggtaatgtgtgggagataaagagcagagctcacagccaggtttaggactggtggacaggagaccatatcttcagagtgttggtatcttttggggtaccacatacgtctctgtagaatgaagatccctagtgcactacttcagggcctgatagaacaaaatgagaaaataaaggaagccaggctatcctgggggacgctctaagtcctcagagacccaagagcctggaaggagagtcatatcactgccctgttatctccaagtggcagtaagtactgtgtatgcctttattcattggatttattttcattttaagtggcatttgctcctgattcttatatcttgaacagagtgtctccaataagcagatgcatcttcaagagctcttatcaatgaatcagtgagacaaattagcttctaatatcctgttctccttaacagtatgtctggagtgttctcaggacttccagatggtagaaactcaactttacaggatgaattggagctgacttagtagctaagagctaagatttgggcagggggtgatgccaccagcagttatgagataggtgtgcaagtgattaagtggtgaaaaccttcatagcagtttaatagcagacacaagtcacattcccaaaggggatgctgataaagacaggtaaattagagactgaaagagggggaaaggggagggaggaagaaggggagggaaagaggggggagtagagggagagaaggagagagaagagagagagaaagagaagaaaagagagaggagaaaagaaggaaaggggagagggaaagagggggagagggagagaaagaaagaggagagagggaaaaggaagaaaaaagagaaggaagggagggaggaagagaaggaatgaatgaaagaggatagagaggagggaggaagggaaggagagaagtagggaagggaagagaaggagagaggaagggagggagaaggaaggagggagagaaagagagacaggagagaggaggaggaggaggaaaggatagaaaaagagaaacatgatattctttagacaccaagaatggaagcagatgtagggtttatgaatcctgaaggttatgaagtttggaagtcctttgtaataacgaaagaaaagtaaacacaaaagcaaatatttggaagcagaaaagtcacagaaaattacaaataataacatgatttgattttggttttgtttgtaaaaggaaaagaatatcaatgacctcacaaaatctataaaaaaaatgaacatttttttcttatggttcagtatctatgctgatgtgtttgcatgtgcatgtgtttacatccatgaccaatggaagccaggaaaaggttttggatatcttggaactggagttacagatggttgagagctacctgatgtgggttctgggaactgaacttgggacctctataaaagcactgtgtaccattaaccactgagccctttctccagtccctaagaatctttttaaaacgggtaactgttgaaactacttctgtgatattttcagaatctcatgctctatcaactaagctagccagatacttcacttccatgacattttagtacatattttggctgatctttgatctactattgatatcttaattacatttatatagtcatttctatagaaaatacaaatgttgccagtcttcttacataactgatcacaacttattgactaggctcacagaaaaattaagttcataactcacattgtcatgagatgtctgtgaagaaatcctgtcaattctctctcttgaccagactggcagcctttggggcatttccaatttcccaggcacgatgaatcttaatgattctatgaattgatgacattcatttgctggctggctgcagtgtccacgccactgtgagacttagtgaactgcctcttgtcttcctggaagttagtatttcatgttgaaataacacaaagttaataagagcttcacagattattaagcctcttcagctcaaggaagaaaagcaggaaggggcgacaagcccaagtggggcatcccagcaagcatgagggatagatgggggaaggaaatgcatgagaacaggtgaagggtgaaaaataacattagacattggcaggtctcaaagcacaaactagcctgcatttaattaaggtatcggggactgtcgataagtttctgggcatacaacagcaaagagagtgtgttcctaaaatagtcaactagcagaaaatctagagctcaaatcctcctcgccatcaaataccctttgaaaccttgttaccttattacacaaaagccatcttggactaaataaatatatgccattaaatccacatgaagtatatgccattaaatccacatgaagtgcagccccagttcagcttctctacacccagattccccaagtgcagattctcaaggatctgcagatatgagcccagagtctgagtgctgccacattggctgtggttctccaactgcagccactgtatttaacttccagaaatcttgctacaataggggaccatgtaaacacactctttcagtgtatgccttctaagagtttaggagaggctcatgcaagtagcgggttggatcttaagccacattaccttagtatgtacctcttcagtgagagccataaaggaaggtttctggagaaaatggaaacaaagccaggtctgcagactctggctggcagtgaggatagatggcccaggcataagactgataagaaaagtcagcatactgaggaatagtggggcagggcagcgacctgcagtgcgcttcccacaggacaggagtcggaaggctcagccagagagcccggacttggctctgtgaagcactaagccagagagtctggacttagctctgtgaagcaagctgctggtagagatactttgtctggtagtgtatgtaggagacagaagtgggtggtaaaagaccacagaagaaatctacgtacagaagactctaggatgggagaaacctagaacacaagaacttagagcagatttagaaagcagaacacagggctggagacagatatcgaggataagtgagagagaaaggaggaccctaggcaacttgtctggcatctctgcctgctcaaagtgccagcttttgacttggaagacaaaatgatatgctcactcattcaggaaatgcttatagtaaaacagctaaattgcatctcttaggacctctaagaggacttggcataatgttctataatggaccagaatgaaaatacttcaaattttgtctcccctttggtctttcacagctgctcatcagttgacagaacaaccatggatgcctgtaggtcaaaaatgcatggctatatccaactacctatgaacatagaaaacaaaattttgtaatactcatacatttcatggcttttgtttttcactggtttctaaccattttaagatgcaggtgctgttcctacctcctgtactgtaaagcagatttgatcatggactgtcatctgctccctgtcatattaccacgctgtgggaatccctagtgcaaagggcgtgatctcaatgccctattctgtgggaagcaatacccagggaactagctctccatgctacactatcgagcatacatgctattatgggacatgttatgtaacaatctaaacctgtggacttctggactgctccagacaaaagtgggccactgcctgagtgcctgaacgtgcagtgttgggtttgctctgagtcagggacacagctactggcctgacacgcatcagcctagcttggtcctcaccaccaccttgtgagcatattattgtgtgtcccattgatcagaagagcaagttgaggtttgaagggataaggatgtgctccagactgcccaggtgtcaaggagcagagctataatgagccagttgagaagaggaaataagacattgagaaggaagggggaaagtttcctgtcttgaccacacagtgaggactttgcagagccacgacgacaatatccaggaacaccccagtgtggttgagcctcctcaggagagaagccaggctgaaaatggaaattgggacttgatttcccctgaagctttcagcagtcttgttaggccactcccagcattccttctgccccagtcagtaaaacccacaactaggctatgcaaatgagtgtgatttacggtgagtttcttgtgtgattctcaactaagcaggccagtgtgctgacaagcgactccaccagggctcaggtatatgatgtctcttggctcagggtacacctctcctgtacccttccctgactttgactgaggtggtactttgcatactgagaggaagaaatttgtttctgagtgttgtcggtcttggaatacttctgggtccttactagaacccaatggggtaaggaacagaggagacccacatactggctctctatctgcttagcttatgagaggtaccttgtatatacctggcctagccagttctagagtttttcacctcttcctccagttgaaatccatgagtagctgagaacagaaaaagaagagccctagctggatagcacagagaaatcataaaatctatctgaagtcacacaaccaccaaagagcacagctcaaacactgaggacaggctccccgccctcctgtctaaggctctcagcatctcactgtagctccctcttgggccatggctaaaaagtaaggaaaggacatgagcagatgtgtgttcaaaaatggctagagcaattatggagtactgaggagcagtcttggctgcctgcgttgcagtgtcattttgacattagtgattttccaaagcatcagaggatggaatggtggtgtttattttccataatttgcataaaccacggccccatctccctctgtccctgactctattcctgccctaattttccaactaacactcttgactctaactgtcccactgacttagcatttcttagattaagacaacacacaagtaatgatttgttttcaacatttcatcttaaatgccctcatctcagaggagcagcctacaaaatgtcagttttccataatccatatatttccccaaaccctccccacatgaggtatgcagtgcattttaatgagggggatatttcctttgtttcttggtttctgccttgaatacaaggaccctgttcaccattacactacacctgatctacccatgtctcagacttagcttgtccccagcaagaccacccctgttctgaagatccattttctctgttcatatggacagaggaggcagcaaagagctgtgattgtcacttcattcctggccacttcgaagccatggacaagccctgtgggttctggagggttatgggtgtgcagtgtgggggtggaatgtctgtcctcacgaacatctccacagatgcaatgaattttgctttatggatgcacacagcctctgtggcggctgcctttaagggaccattaatttcagggtgattaatcactcccagagacagccaagctggtggcttgcagctacatacagtctgtgtgagtcactgtacaggatgtggatttgagaagttttctctagaatcttcaccaccatcgtctgagttggcacagtctggtccttaccagcaccaggaagctccagctccaagctcactttgggcagggtcttggtccttatgggttgcccccttgtcagaggagagcaggggccatgctgacaggaaagctgcaacatagcttagagggtgggggcatcatgtatacttgcaacctatttggaagactagacatctacagaaggaaacagtaaacacaaaaacacgagctgtggatttatattgttttttatttctcagaggcccagtgagccagtaggatattactatttcatagtaaaggtaaggaaactgagacttggctttgcatggctggtctacagccccaccgttggcagtcaggcagccatctggagctgagactttgcatcccagggaatatctccaagggtctggtttctagcttcccttgcagagacctttggggttcgaactgtggtggtgaaacgaggctgcagaggcataactgcattgttgaggataaggaatgttacttgggtgctctgtgcctggagtgttttgaggatttaagggttttatgaaagggaatcttgatcaatatgatatgtcatgctgccgagggggccgtcgctgcccagctatggcacctaactcagtttttttttttttgtttgaagaagaatgctgctgcttaacataaaaaaaaaaagtgtcatcccagcactcagaaggatgaggcaggagaattatacatttgagtcaagactgggctgcaaagtgagacagtctcaagatgaagaaaaatcaattgagaggttctttgccagggtgtagcaatgcaaatggtaagcaatcacacaaagggcaacagattaaatggcaatcagattagaaatgaaaatccaatttcttcaagatgcttttggccactgacttaacatatttggagattgccaagattgtgaacaattcctctgagactcaaagtgaaggcagtcacagaagccagggctattcctgtgttcacgacggttcccatctctgcaataccttgcagctctgtctggttctcagcccagtgtctttcctgcctgaccacccttagggctctccacagcccgggttccctattctggcagtcatgctccccgatacccaatatctttctttccagtcacaactggagctgttactgatcaccatggctctggcccatcctgaccccagaagctccatgccacccagagaacatgagatgtccacagtcttttgatgtcttgcggatgaataatcacaagatcccactgtttcttcatgcttgaaagtaccacaaatggaaatcctcttataaaatataaatcatgggcaaatagaagtggctgctgttctcagtgtgcatagactttttctatgttctaagatgacattaagcaagttaatgtgctctttcccatttcatgatgttgagtgcaagtcatgcagggagatgatgagaatgtggcagaaggcattcaggaaaaaaaaaaaaaaaagcacaggggtagtcagagaccaacaaccaaacacagtgatgcagcagaaaaacagtcaggctttctcccggagaatcaaccttcccaactccctcatttccttccttatttagcctattacaaaacaatgtgtaggacctggctcataagtctctcccatggtgtttaccatcttcacgtttttaatgaggtggcttgcattcaggaaagggatgctgacaggacaagttaaatgtaagagggtgaggcaaaatgtagaggaaatgggatgagagaggaagtcagaggactgcctccagatctttcttattagtcagatttgtagacaagatgcaggggagaagttgagagcagtgaggcctttggcctacaacttcaagaatgttaccttgaagatggtatgtcatgctgccgagagggccgttgttgcccagctatgacacctaactcaggtttttgtttgaagaagaatgatgctgcttaacattaaaaaaaaaaaaaaagtgttatcccagcactcagaaggatgaggcaggagaattatacgtttgaaactccccacccatatgatttaggagcaaggtggagcacagagggaggacaggcagaacaggggtaaggagatagctagaaaagttgtttgggaatcaagcaacatctttagcacctcacccactgaagaagaaaacaatggagatcctaaaacatttagagcttgcaggttattgcttagaggaatctttacaattccaaatgtggactttagaaaacaaggaaaggtcaaaaaccaataatgaaagctcccaactcagcaaggtagaaaaagaaaagtaaattaaacctagagaaaatcaaaggtaggagattacaggacaacaagagctaaagaaacagaaagcagaaaatcaagagctgctgggccagggattggcaaagttataaactaatgagagagaaaggaagaatgtgaactgccatacctgggaggcaagaggaatcactgcagatttggccaacatcttaaaatagcaagaagattctatgaatgactccgtagcacgaagtttaatggtttggggaagaaataagacacgtttttaaaaaacacaagaaagtgtaagcaatggtcagaatgactgcagcccttctctagggctctttataactcttagattggcagtaaggagaaagcccagtatagggcctgagtcagccactgagtatatatgtaggagacaactgttcaggttctgcagcccacaagagctcctgggaatctacttcagccaagcaaccagacaacaaagcctgagagctgttatagccaatggcttaagcaatggaagcctaaaaaattcagacaaaccagaactatatctataacccactggttacaagcacccaaatggcaccttccccatatgtcacagaacattgaattctcacactcttatcctcaccaccaagtaggcagaccacctgcaaggcttcacattttttaggagagcatggaggttatcttcagctaccaagtagcataaaatcacctgctaagaagaaagagaaactgttagacctttggaaagagtctgcttgtcattacattgtctctgtaaatgatggaagagtcttgattttgacacggtcttgtttccaaggacatgatagaagtatcaaagcttattttttgaaaatgttaaaattacagctcctgtacaagtatagaatgagcaagtgacagtgattaatttagttaattagtgagagaactaacaagactgtaaagctggtgctgtggtctgaaggtgtcctgtgaacttggagactgacacttaatctcatatgcaatagtattctgaatggccaatgggactgatcagatcatgacatagagccaatagaaacaggattagtgctctttttaaaagactaccactctatcatcacagctacaaattaaagacctgcttgggctcaagagtaagatcaatgccagcccaggctattaagcaagactccgtttaagtagtagtagtagtagtagtagtagtagtagtagtagtagtagtagtagaagtagtagtagtagtaggtgatgctggtgctgctgctggtgctgctgctaatgatgatgatggctgaagagtagctcagtggttgagagccttggctgttcttccagaggatcagggttcaatcctgtctcccacaagagactcgcagccctctttcagccccagatgccctcttttggctcctacagacactgcatgcatgtggtagataaacatgcaaattatatatatatatatatatatatatatatatatatatatatatatatatataatatatatatatatacctaaattaaatttaaaagcaataagtaaataataagaaagagctgggaataaagtatagtggattagaccatgggccctaagttcactgcccaagaaaaagagacagacagacagacaggtggaaagaaagagagaaaatcagagtcttataaagttttgcttctctttcttttatacaaggccacatcaaaaagtgatgcctatgcacaacaggtccccatcagacgaccaacctgttctttctttgagttttgattccctaggctctagaagaggaagaaatatgtggtcattgtttacattccacccatgatgtttttgttgtagcaacccagactgaccaagacagttgtcaaaaaaaaaaaaaaaaaaaaaaaaaaggtgtagaaagtgagtctgtataaatgctgaaaggaaggccagtaagatgagtaatttatattgagactgctttactatcccaaagataataataaccagacaaaagtctttgtgttgtatcaggcgataatcatctgacgtctattcagcattctccaagttgcctcttcctcttggagttatgtaatattctaatcaataatgaatagcaagttaaataaaggacaggacagaaatccaaatgacctcaaagcctttagtcacagccgcccctagctggacacaggaagacctgtgaatcttcagcttcatgaaaattttgaacatttttctcaacagaagtatgtaagcatgtgctcatgtctgtgacatttaggaggttatgaatatttaagaaataggaactgaaagtcctccgtcttgctaatggtggtgacacccacatcactagaggcttttagagacaatcatcaggcctgccagcccagcaggatgcaatctgcaattactttgctgcagatttggaaacagaattgattgtaccttatgtaatcctactgacctgagaactctagaaggccattttggaatgagtcaacagatttggggtctacagaggaaataacttctaagcctagaagttcaagcccttagaatagttctgaataccactgtatatttctgttctagtatgctttgtctggaccaagaaggttggcctcacaaaaatgcacaatatatgacatagagtttctaaaatatccatttgaacgcgtgtcaaataaaaagatattttcctactacatagaagtttgtagtcaagacaaaatgttgcttttaaaatccaaataaagggaacagtgggcatttttatatgcctaagttggcagtagactatctagatcacagtttcttcattctgtgggagagtgaatgtcactatactttcacccatggtagtatatctcaagcttgccagtgaatgaattcttacagttttcactaatttcttaccaattatgaatttgtatatggtttaattgtgtgatcaggactttataagcactatgtgcagcccacacaatactatgacatgttgaaacagagtgtccctgccatctagatgtcactatgatagtggactgctttaaaggtttctaacacttactgcttctatgtttacaggtcaaggaaagcatcagttgttagacagtagatctagaaagtctaaaaacctgtccactctaacctgggagacttagaaatagaagaggaacacaaaaccagaagatatgggacaatataatctctttccccagcttcactctagtctactctagggtttgtgtgaagagttggaaagcataagaccagagctcactcactgagtgagcacagaggaagctgcaggtctgtggacacgctgaaactgtagttagcaagtacaagaagaatggaatggagggaatgagttaaacacacctgagctcctgttttttgttccatgtctgtgcatagacggtaaggcacccagacatcactcatccagctatcctagaatatgctatgggaggccagaaagacttcaatgttaggatgaggggatagccctggtgaggacttagaaacaagtacagataatgcattttgcccaaaaggtcagatggaccagatacatccagcagtcaccctatcaaggatcagaagccagtacagatccagaacactctgtatggatcacaaaatgcccatcaccacatcacaagggcataatgaccctccatacagccacacatctgccggaagttaagtaaggaggggagatgggacccagaaagcctaaagaatggaagactgaactcatccctgattttttttttaaaaaagtaaaataaaacagtttttaaaagtctgatgaccatttaatctaaaaagaggtttttaattgtaggagtctttaacattgataaattttctccaataactcagaaaggtgcctgtaaacttgaaaaggatatgaaatttgctataagacgtgcaggtgcattttcctagtgcattaaaggaacatgaacatactctttgtccaccagtttcttgcttttttttttccttcataacattaaggaagaagctagaactcagtagtcaagggaaacatggagaaatgatggatttccctaaacagaagtaaacattttaaaagtgtctgctgtgtgcatgcaataaaattcaataagccaccatctccatgaataagatatgaagaacagactagttaatagacagaagagccaaaagatggaggtatcctgctaatatctaaaggggaattgattacttgttcctctctctttacatcctggtgaaatttgcaaattaagaaaataatagatacaaaaactagagaaatgctagcaaacaagttaggatgctctctgaggagctgcagagtcaggggagcagacagggttacagtggtcaccagcaggtgaacactagacagtatcaaggggagacccatcaggagagtagcagattgctgtccccagtaaaatagtcacagacccttgggttctgaccctttggggagtaaagagggcctggagaattctgccctgaggctgtccagccttagcgttggttcctctcacacacaaaaggcttattgtccactgtaggctcatgtatcatactgcttcctgtctgaattaattagcatggtctgataggcccctaacagagtcaggagagtaggagaacatgaaagatactacagaagaaaacatgtgtttttttaaaaatattttttattacatattttcctcaattacatttccaatgctctcccaaaagttcccccataccctccccccccccacttccctacccacccattcccatttttttggccctggcattcccctgtactagggcatataaagtttgcgtgtccaatggccctctctttccagtgatggccaactaggccatcttttgatacatatgcagctagagtcaagagctccggggtactggttagttcataatgttgtttcacctatagggttgcagatccctttagctccttgggtactttctctagctcctccattgggagccctgtgatccatccactagctgactgtgagcatccacttctgtagaaaacatgtttttagaaaaaaaaaaatgtcctgatgtgtttgctagccttcgctggatttattttcttattttctgctaaaacaatgtcctacttaatattaaaatttattattaaaattgtatattttatatattctctatattttaaatataaatatatatttatattattaaatttttatattaaaacttactatgaaatattaaacttaatattaaaaaggacctcaacatctggatgtgaagtaatatcaggcatagaagtaatgcagatcggggagcagctgtaaaagtcaataaagctctctctacgctaaccaggctgctggcaggccagatgccacttgcatctatgttcaaaagtgatttttattgcacatgggctcatgtgcacatgcatatatgggccaaaagtacacccatacaaaggtgcatgtctggaggccagaggcaagctggagagggttgttttctcctcctaccatggggattccaaggattgagcttgcgttgtcaagcttgatgacaaatgcctttccacactgagccaacttgccagcccattttgtgtgtgtgtgtgtgtgtgtgtgtgtgtatttggcatataccaaaacagtctatcaaatgtaaaaagaaaaaacaatgttactgattacatcaatgccaaaactacaaaatatttgataataaacaggaaaatgttttcttatgaataagatcataaagtatgattaattgacaggagagtctagataccttctcatgaatacaaaaattatatcatgtacataatcattcacttgaattacaatttcaatgcaaatccagtcaacatttctatagaggttttcaattgacttaacaagatcctcctagcccgtatgcagtgaggagctaagaaacatttgaatggaaattacaagagggagtagaagcagcatactgcaagatgcatgataatgccattttaatgcaactcaagactgtggaattggctcagatatagacagtaagcaaatacaaagtgataaagcatccagaaatggacgcctgtggagatatgagccagaaatagcattgtaaatcatgaaagaaagggcagagtagtcaataggcagggagagacaattgctgatgtatataggaagacagatagctaaatcctacgtgaaaatcaatttcagatacactataagcctgaatgtggaagatcatgcttcagaattctagaatatgcacacaggtcacacctaaatatcaaggcagaaaagaagttaagaagtcacaaaaagcataaacaataaaggaaaagattaatgaggcttgctacataacaggctgtgaaactgccttaactttaccaaaatcatttacagaaacagacacacaacatcatggttgaaacaacctaggattctccctagattttctctgaacttgattcttgaaagacttgtctcaattctgtagacttttcctttattgtcaaagcttgatttgttgctgttctacccacagtgatggagaggctcagcttgtgactggtgtacaagggaagtgagagagagagagagagagagagagagagagagagagagagagagagagagagagagagagagagaggaatcaagctggggggaggagagagagggaagagagagggggacaagttttgtcctgtgttctggtggtagaaactaccttctgtgcctctggaaccaagtcaaggaaaccaaaccactgagttgtcaatgtcttggaaagttgctgcattagcaactagagcgccagggttctggttccctgaggggacataaggagattcttgatcaggtctcttgctctgcctgagtctggttctcttaaactctaaaacagcctcgatgcattgaattttgattgtttctagttctatatgaaaagacagatgatttgtaaacaaggcccacattacttttgcaatgacagtgaaggatgggtgaactggttggccctgctgccatttaacagttgtaaagtttaaggaggaatggtcaagatctcaatgtatggaaacaaatgaaagatggtcttgaagcaagaagtacctcttctctaacttgcaaacctttagcttttgccaattacaggaatgcggaatctcagtagagctctgcagaaaggatccgattaatttagggaaagtactattaaaaaacagcgtgcttttgccctgtgtctagtatgagcaaagccagaaaaaatatgttctatagagtatggtagggccttggagaatggaaacactgccttcaaagttctttaatgaaagctgagataaacacagaattaaaaaacatatcatcttggttctaagtggatgaataaacagaaagattgaatttaccatttctttctgagacataaactttaatgacaatattttggaagatgccagaaagatccaggaacatatacaaaagggcccctagaaatgaagacttaagtgatggtcctcttctttctctgaaggactgaagatatagaagtttgcttcagtagcccatagttccctaaacaaaaatccagaggaaagagctatgaaaccccagtaatggaaccatcaaagggagaagagccatctactgccttaggtaaagagaagttgctcttggagcagagcaggaactgtggctaactcctagtcctgctgtgacttgatgtgtcagggtgggttggtatccaggaggacctcccccttctcagaggagaaggagagagaggatgggaggagaaggggcctgcaatcaagatgcaatgtgaataaataaattcattaatggaaaaagtagaaaaaaagagaggttgctttaaactcctaatgctgtgagttctgggacaggtctgaattcagccatcctgaaagcccagctactgtcccagcaatgtagcccaaatgggtaagcagatggatggagcgatgacattaggagtcgtgggagagggctgaagaagattaggatccccaaccttacactgaaggaattatgtggatgtgtctggagctaacttcctagttgttttgtgagtttttccaggccagcctttgtcttcaagggacactccatctggaagtgattagccctttggtcataaatacgtaccctgtggtgctttagtcataagccaaatattcaaaataggtaccctagcagagcagcttaatagaagtactagcaggaaatatgttgttgttgctttaggacccatgaggagaaacatgtctagtagatgtacaaccccagtgtttccagaaaaagaatgcgtgaccctgatccagagttgtttcaagggtagcccatgatccttgcaggatgatagtcagctttatgaatttggacttgacctacctactgggacttaatccaactcattgccaggaaacactcaggacaaacattacatatggttgtttagtttgagattttcactcaattttgaccatttaattttttcccctggaaaagcattattgttgatgttttcctgtgtcttggttgagttttacacagaatcagctcattagggtttttatctatctatctatctatctatctatctatctatctatctatctatctatctatctatctatctatggagagagagagagatagctcatttccttcctaggggtgtgtatttggttcttctcttctagagtaaacttatctcaagtttgtctagattcagactttaacaaagaacctgctgatgggcttgtttttaatttggttggtttgctttatcagttattagctaccactcttaactctgctaatcttatcttccagatgcccttggtgctgtttgtgtaccttctttggttgagtatttggttcactgcattcgtttcctcttgttctctggtgaacatcacgattttgtctctgagtatagtaaacagctgtcactcatcttgcccaatgggttttactatatcctagtctcatagagtgattttctaaatattctgtaattacactctatcattaacccaataattattttaatgacatttgaatcataaagctatcagtttgttcatttgtttaattctttctggttagaatggctgcccatacaatttaaattttttagaatttatatatatgtttgtgaatattctttgtaaatgtatattaaatcattgttctgtgggcatctgaacagaatgaataatctctacaagcaatgataatgtcctttagcaggaagaaaagatggcgtggcagacacctagcatgtttctccatctctagaagattaaaacaaaaggcacaggtatgggcagaggagggtggtatagaaagatgctgaagagcaactggtagacaaagaccaggtaaaacccagaatggacttacaatttttctaagaaacaataaactttaacataggccatttagcaacactatagggaagagttgagatcctctcagtagagctttaagcaaaatatctctgaaggtatactttgcaaaaatacagcactccaaaccaaaaaagcaaaaaacaaaaaaaccaacccagtttaatacaaggacctgatatgtatgcaccagtcagatgcaaatgggatgattggcattattttttggtttgttcagtggtactggggcaaagagccatcctaaagagccttatcatcgaaccacaaaggcttctgcatttttatatattcaagtctgcttaaatgagaaatgatccctaataggctcagacatttaaattcctggtcctgtgtggtgtcacagtttgggtaggttatgggaattttagtcagtggaatcgtgctagaggactaggtcactgaggatgcatcgactgtggtttgtagccttgcggacttccagttcattcttcctgcttcgtgtttgctgttgaagatgtgctctctcagcttcctgctccagctgcctgcatccatgtctcttccaccttatggactctctccctggaaccagaagccaaaacaaattcttcctacttaaattgtcttggtcacaggattttatcacaaccacaaaatgaaattagtacaatataataaagatgacatataagaaactgactagtgttgtactaaatgaggagaaaactgaaaacagttctaaaattggaaatgatataaggatggtcacgatcgccactcttattcagttatacttgaaatcttggccagagcagtaaggaaagaaaaacaataaaatggagggatgctaagcccacacattcctgcttgctgattctgtgattctagacattatgagctccaccataaaactctaatatttgaataaaacttttcagccaagtatcagaacaaaaataaatatactagaagcagtagctcctttttgttgctacttcaaaactgtaattttgttactgctatgaatcataatgtaaatatgtttggagacagaggtttgtcaagagctttgtaacccacaagttgagaaccactgccctggaagatcaaaatacctcctttattcaacaaaattaatatcattaaaaatgccacatcacttaacaagatacatggtttcattacaaccccttaaaattcaaatgacatgtaggcttggagagattgctcagaggttaagatcataaactgctcttgggaagaacttgagttgagttcccaacacccactttgagcggcttattactacctggaactccagtttcaggggatctgacactctcttttggtctccacaaggacctgaacatacatgttgcccataaactcatgcaggtactcacacattaataaaaataaataaatcttcttaaagtcccaattatttttttcaaggaaatggggggggaaccttaaaattcatgtgcaaacacaaaagactcaaaatattcaaagaactcctcaacacaaagagcagtgttgtaggtagcctttaacaatgctacagagccacagtgggtaaagcagtatagcaggaatataaagcagacatgttgattgtgggacccagaatagatcggaggaccctgaaacaagcccacacagttacagttaccttgtcaaaggtgctgaaagcatacatcagaaaagagatgacttcttttaacacacagtgctggtaaaactggatatccacatgcaaaagaatggaagtagagcctcatctctccgcaccatcccccattacaaaagcaactcaaactgaccttaaagtaacacctgaaactttgcagctacttcaaaaaattgcaaagcaaatacttcaagatctaagcataggcaaggactttctgaaaagaactccaggagctcaggaaatcattgcaagagctggcaaatagggttatattgatttaaacagcttctacccagcaaaggaaataacagagggaaagactgctaacataatggaagaaagtctttactagctattcatctgataggcaattaatatccataatgtataaagaactcaaaaaagctaagcaccaaaagagccagtagtcatcaataaaaaagggggaagggacaagtgaaatgatgagaattcttcaaatgaaggagaaatgattgattgatacgtgaagaaaacatttatatgtcaaccatcggggaaatgtgaagcaaggctacactgaaacctgtgcatggtggagtaggtacacttgtaatttcagcatttaaaggctgaagccaggagaactggacaagcttgaggccaaactaggccaattagtaagttccaggccatttggggctacagagtcacattcagtttcttttgttttgttttgttttgttttgttttttgtttttgtttttaaaagcaaccaaacaggattaattaattaataattaattaatacattggtattctatctcattgcagttataatatccatcataaagaaaactacaacaaatatttgcaagcatacatggaaaaagggaatcctcgtccagtatttggtgggaaaataagttatccagtggtcatgcaaatcaatataggggattctcaaaataaattaacaccaaactgctgcttgagccgcctctaatactcctgtttatatacacgaaaggatccaagtctgcatgcggtagataacacttgaaatataaacttactgctgcactgtttacaatggacaaaacctgggtcagcctggacattcattttctctgttgtagggataaaaggataaaaaaatgtagtgtttattaataactggagtttcagttaaccataaacaatgaaattactttagatgtaagaaaatagatggaggcatgagaatcatcatcctaaacaaaataagccaaactcagaaaaataaatatcaaaagttttcttttatacattaaaacttgagagctgaaatgtcatgacagtcaaaggggatcattagggatgcgagaagggatgaagcaggagagagtaatggaggatgaacaagatcaaagtacattgcatgtatatataaaaatatctttgtaaaactcattgctttagtagatacaaagtagatacagttagtagatacaaatagatacaagatactaatacaacaatgtccattagtttattgatcatattatttgcatcattgctatcatttttaccagttatcgctacatgtctaaacatattttgtaatctatacttttctaatcatatgttaaaagtaatattcactggcaatatccaaacaatataaaaataatcctaatgtcctgcaccactccctcacaaatgtttgtcataataatatgaaattgaagatgcaaattattatgaagcattccaaaaattattcttagcacttgtagtttcaaattgttataattggttgaatggattattgaaatttttcattctctcatgtctttactacacttgaactcctcacttctatttgttcctggtggcagaagtactgtgtcatagaatggttgctgttgctatgagggctgtgtctgtctagcatgcatgaatagttaagatccttcatcctgtctgaagaaatgagttctgttgctctcaatggtgcacaactccattcagttccgaatcctcttcttctgcgccctgtggatgatcacctcaaatgtaaactgtagaaagtctacatgaccctaggaatgagatttcctcctctatagataacccattttctcctttctctttatatctttttatatatgacagggttatctttcgaaatgagctatcaccaagaagactggagtctctctccctctgaagtgtcttgaatttgcttgatctttctaaaagatggaaggctttctttcttcagcacagggaactgttcattaacttttaaaacattccttctattttttctctcctcttataagtataattgggttcttggatagatgatgacctttgttgtcagaagatatatttccatcaggttttctcaacttcaggagtagaaaagctctccttggtgttaaaggttgaaggcctaataggcataagagccagtcatgaacagaactcagacttctcgtgtgtcatcataggcgaggcgcagataacgaagctcaacaagaaagcaggctcagaggagtccagcatgggtgtcaaacccaaattcaacagaattttctactggacattctattcctaggctacatgagaacatgtaggctaggctagggaagggcagctcttaccttttgtaaacaccacctaagatggacctgccttattttgtagacagaaagatttaccctttttcaaagtcctctatcaatgcacacaagatttgcacccatgaacaagtatctccatggtgtgtatttttcttacatgacactgtgtcaaaattgtgttgaatttttcattatgtttgtttaggagcagggtaatgtccatttgtaggactgttccgtgccccaacaactaaaagtaagaatgtaatgtgtgagagtaattctgtaaggaacaagagttccccaaggctgcttcaagaggagggtcctttagtgcaaggccaagcaagatcatcacctagtcttttctcacagcctttcctggtattcttactctggtttaccagtgttgccatcaaaataggtagagctccacagcctgatggaccagcatgtcaaaaggagggccaggtaaatctgcactagcaagaatccataccttcacttggatgctacagccttgatgatcccttgatgaaggctttccttagctttgcacaatttctttctctccttttctccagctgtatgattggcattgtttgtcacagcccatgcccaaagctggtgcacaatttcttccctcgttttggtccttggttcaattttaaggtgcagtttttctgacaatatgccagtgagtcaatcttcatcaggtaggcaaactctcttttctcaatctctttctctctctcatgtgtgcctttggctgacttgttcccatttctctaagcttaggggaatagtgtagcttagggatagcttgtgacttttacagactagacagaaggatcaaaaggactagccagacttagctacgtggtgaaaccctgttccaaaccaaagcagacagtgaatgcttattgtaaccacacagaaacagtgacaaatgggcagagccttccctaaaatggctcacaaatgactgccactgtgatagggaaagacatctcaaagacaaattagtgaggattataaataaaagtacactattctgaaatgttttcaaaattcccttcatagtttcctattgcccatatgatagctactatgagttgaaataattcaaaagtatgtatttatggttatggggatgagatgtccaaaatacaccttaaatggactaaaaccaaggtattagattatttctggaggtttctggaaaaaatccattccctgtctcttccacttgtagaatctgccagaatttactggctcctggccacaacagccctggcttgtggtcaccttgccttctcctctactatggccagaacaccctctgcctcctatataggatgctcgtgattactcagagcagctcagaataatatatccttgacataatcacatcttcgaagtcccttcaaaatccttccaaggattatattgtgaatttgtgggaagcaacgttcagcctaccacagtgcactctctggccccaaagactcaagctatccctacatatatccatttcattctaacgtcccccaaactttcagctcactgcagcctcaaatggagatcccaaatctcatcatctctgtaagacgagggtgaggactcagtatgagccatctcagggaaaattcttctctctctatggacctggaaaacaaattatctgctccaacagcacagtggtgtgactggtgccaaacagctgttaaatgctttctcatttcaaaggaggaaaaacaagtggaaggggactgggagtcatcagtcccaagaagtttcaaaatgcaatcagaaaaacgtcaagcagtctccaaaccctgagactctgcgtctgcctagttaggtgctttcttcctacccacactctgcgctctgtgttaagactgatctcccagacacttcttctttgtctaaagagtagcatgtctttcatcagcatgcaaagttctatttcattctgtccattttagtctaaactggctgtgattctattgctatgttatctcaagaacattgtttctctccagtgactgtcctggactaaagggtcctccaagcctcctgtctggacactctcctctctaaccttgactgctgctgtgatggctgtggggacccacgtgtggtgtgtctaattttctcactgttattaaaaggttgtccaatcccatccttggccttttctagagaacgtggcttcctgctgtcaacgtcataattctttccctttctgcccctcaatggaataggctgaaatgtttgaaggcaaggattaggtctaactcatttgagcatcacaaacacattaagtttgtactctagctttcagtgggattttgacatctcagtataggacaactaaaaaaagtcaatgtctgtctgttttgggtcagctgtctgtcaaagcagtctctgagacaactgatgcgtgggatttaatcttagtgtactccatgagaaactgccatgggattgtgacaagtcgaacaagaagcccagtaagcatgcagcttcgggagaaagacattctcacctccttggctccaaggcaccaagatgtttaagttatataacgaagtttgtctccatccaagcctagaatctgcattccccaaatttatagcatccatctttagctatgggccactccagggtgatgactcaggtcctctcagttctgtacacggagcgagcgtgttgagagcataatccttagaagcttaatagtaaggatctaggaagttgtggtagtgagctgttaggagagaactgctcagggcctggaggctgtgtgtatggaatgacaaggggaatcttggaaagcaacagcacaagtgccatgttacagagctacactatagaacaggtgtggtagctaaaagtgtggtacaatgaccacacatgctcttagcagaaatactcttttttcctacctgaaacagtgctgtgacaagctgcattcttgctctggaggattctgaaaggctagagatgttcagatattggaagctaaatcctaagcccagtattgagtcccaccaattcctcaagccatgcttttccaagccctgactgtcatcatggcttcgatcattacctaccaagcactagcaccatcctgacagcccaactaagtgttccaatagaggagtgtggcgaccaagtatactcccactagacactgtgattggctccctgtgacctgagtaaatgccatccacttaagcaatttgtcagctggggaggtgattcagacaggtcaccttctataatggttctgcttctatttatagaccaagctgattaatgctcgtggtcaacgctgattcgggttgccctgcatgaattcacaatgtcgctgcagcctgctgctgatccctttggtgacaagtggcaagctctttcaaaaccttcattttctgcccatggtgcctggaaggaagaggccaaacatgagctgtcatctggaggccagaaggggtggcccagccctggcttctggtggcagtgccctctaccaactcagtgccctgtgttgaactctaaccccagatccacatgctcacagtgttttgaaggtagggattttaggaagtgaataagattgagacagatgagaagaaaagatcataagtggtcagatacacacatagctcatgaaaaaaaaaacagttgctgaaggaggagctgcagtaaggaatcagggatagcaggggtggagagggagaggagaacccactaaaatacacttgggttgcaaatgtcatagtaataaataaagtgttatatcctaattttaaaaaatatatacaaaaagagcatgtcatggtagtgaggtctcaatctaatggcaatagtggccttgtgcaaaggtacatacaccagctgtgcatagtggtttatgcctataattcaagcacttatagtgtagaggcagtaggacaacctgaggtactgagaccctgccctccaaaatcagttaagacccacaaaactgcctctggctcattgtgtctgaacggagtagatggaaggtggagtgagtttcatcatgctacttcccgatactaatatgtgctgccatgtcgagctagtttaaatcaatacttagtaataatccttagtggattgtctggactaagtctgactttgtcctgtgaccgcttggcccccagagaagaagagcagcagttaaaaagcagcaaacacatgtgaagacacccctcagatgtgggccatagcagaactggacttaggttgacaggattagagatgaaattctaaatctgtgttgccaattctgatgatgtttcaacgtatctgcacaagcagatccctggccacctgcatccgaggggggggggtgcgtggaagagagggagaggggagagggagagggagagggagagggagagggagagggagagggagagggagagggagagggagagggagagggagagggagagggagagggagagggagagggagagggagagggagagggagagggagagggagagggagagggagagggagagagaacttatgtgggcaggtatgaatgcacatgtgtgctcatacactcagaggccagaggacagcatcaggtgtcattcctcccagcttgtctgccttttatttcttctcttctctgtcactgttctaaactcacgaagtaggttctaggctggtatgccaacaagcttcatgctggctctctctaagatggcgttctagagatggaacgcaggcccttccctgtgcttcaggtttcctttcctgcctgagccttctctccagcccctctgtcaagcagactttgactctacgactttttgttgactttaaattcatactcacatgattaaaagcaaacaaaccaataaggtctcgctttgtagggtatcagttgttgtgattagcatgttagcaaattttaccaatgctgggtatgagtccaactaaggttccccaaaggaaaaggcataaagttgagagcaggggcagaaaccatccttgagcatctccaatttgtcctagtatagtgtgcaattttcacacaagccctgggtctaggcaccctcaccgttgtgaccaccttatttctttttttttttttttttttgttttttttttttgttgttgttgttgttgttgtttgggaagttacctttttttttccattttttattaggtatttagctcatttaaatttccaatgctataccaaaagtcccccatatccacccacccccactcccctgcccacccactccccctttttggccctggtgttcccctttactggggcatataaagtttgcaagtccaatgggcctctctttccagtgatgggcaactaggccatcttttgatatatatgcagctagagtcaagagctccggggtactggttagttcataatgttgttccacctatagggttgcagatccctttagctccttggctactttctctagctcctccattgggagccctatgatccatccattagctgactgtgagcatccacttctgtgtttgctaggccccggcatagtctcacaagagacagctacatctgggtcctttcaataaaatcttgctagtgtatgcaatggtgtcagcgtttggatgctgattatggggtggatccctggatatggcagtctctacatggtccatcctttcatctcagctccaaactttgtctctgtaactccttccatgggtgttttgttcccaaatctaaggaggggcatagtgtccacacttcagtcttcattcttcttgagtttcatgtgtttagcaaattatatcttatatcttgggtatcctaggtttggggctaatatccacttatcagtgagtacatattgtgtgagtttctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctaggttctttccagcttctggctattataaataaggctgctatgaacatagtggagcatgtgtccttcttaccagttggggcatcttctggatatatgcccaggagaggtattgctggatcctccggtagtactatgtccagttttctgaggaaccgccagactgatttccagagtggttgtacaagcctgcactcccaccaacaatggaggagtgttcctctttctccacatccacgccagcatctgctgtcacctgaatttttgatcttagccattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacacgataacaaccagttgtgccagcaccaattgttgaaaatgctgtctttcttccactggatggttttagctcccttgtcgaagatcaagtgaccataggtgtgtgggttcatttctgggtcttcaattgtattccattggtctacttgtctgtctctataccagtaccatgcagtttttatcacaattgctctgtagtaaagctttagatctggcatggtgattccgccagaagttcttttatccttgagaagactttttgctatcctaggttttttgttattccagacaaatttgcaaattgctccttccaattcgttgaagaattgagttggaattttgatggggattgcattgaatctgtagattgcttttggcaagatagccacttttacaatgttgatcctgccaatccatgagcatgggagatctttccatcttctgagatcttccttaatttctttcttcagagatttgaagtttttatcatacagatctttcacttccttagttagagtcacgccaagatattttatattatttgtgactattgagaagggtgttgtttccctaatttctttctcaggctgtttattctttgtatagagaaaggccattgacttgtttgagtttattttatatccagctacttcaccgaagctgtttatcaggtttagaagttctctggtagaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccaaaacttttatcatgaatggatgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattgaggatttttgcatcaatattcataagagaaattggtctgaagttctctatctttgttgggtctttctgtggtttaggtatcagagtaatagtggcttcataaaatgagttgggtagagtaccttctacttctattttgtgaaatagtttgtgcagaactggaattagatcttctttgaaggtctgatagaactctgcactaaacccatctggtcctgggctttttttggttgggagactattaataactgcttctatttctttaggtgatatgggactgtttagatgatcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttccttttttttctagagcttttagttgtgttgtcaagcttctagtatgtgctgtctcccgtttcttcttggaggcactcagagctatgagtttccctcttagaaatgctttcattgtgtcccataggtttgggtacgttgtggcttcattttcattaaactctaaaaagtctttaatttctttctttattccttccttgaccaaggtatcattgagaagagtgttattcagtttccacgtgaatgttggctttccattatttatgttgttattgaagatcagtcttaggccatggtggtctgataggatacatgggacaattacaatatttttgtatctattgaggcctgttttgtgaccaattatatggtcaattttggagaaggtcccgtgaggtgctgagaagaaggtatatccttttgttttaggataaaatgttctgtagatatctgtcaggtccatttgtttcataacttctgttagtttcactgtgtccctgtttagtttctgtttccacgatctgtcctttgaagaaagtggtgtgttgaagtctcccactattattgtgtgaggtgcaatgtatgctttgagctttactaaagtgtctctaatgaatgtggctgcccttgcatttggtgcgtagatattcagaattgagagttcctcttggaggattttacctttgatgagtatgaagtgtccctccttgtcttttttgataactttgggttggaagtcgattttatccgatattaaaatggctactccagcttgtttcttcagtccatttgcttggaaaattgttttccagcctttcactctgagttagtgtctgtctttttccctgagatgggtttcctgtaagcagcagaatgttgggtcctgtttgtgtagccagtctgttagtctatgtctttttattggggaattgagtccattgatattaagagatattaaggaaaagtaattgttgcttccttttatttttgttgttagagttggcattctgttcttgtggctgtcttctttttggtttgttgaatgattactttcttggttgttctagggcgtgatttccgtccttgtattgcttcttttctgttattatcctttgaagggctggattcgtggaaagatattgtgtgaatttggttttgtcgtggaatactttggtttctccatctatggtaattgagagtttggccgggtatagtagcctgggctggcatttgtgttctcttagtgtctgtataacatctgtccaggctcttctggctttcatagtctctggtgaaaagtctggtgtaattctgataggccttcctttatatgttacttgacctttctcccttactgcttttaatattctatctttatttagtgcatttgttgttctgattattatgtgtcgggaggaatttcttttctggtccagtctatttggagttctgtaggcttcttgtatgatcatgggcatctctttttttatgtttgggaagttttcttctattattttgttgaagatattagctggccctttaagttgaaaatcttcattttcatcaattcctattatccgtaggtttggtcttctcattgtgtcctgcattacctggatgttttgagttaggatccttttgcgttttgtattttctttgactgttgtgtcgatgttctctatggagtcttctgcacctgagattctctcttccatttcttgtattctattgctgatgctcgcatctatggttccagatctctttcctagggtttctatctccagcgttgcctcgctttgggttttctttattgtgtctacttccccttttagttctaatatggttttgttcatttccatcacctgtttggatgtgttttcctgtttttctttaatgatttctacctgtttggctgtgttttcctgcttttctttaaggacctgtaactctttagcagtgctctcctgtaattctttaagtgacttatgaaagtccttcttgatgtcctctatcatcatcatgagaaatgtttttaaatctgggtctagattttcggttgtgttggggtgcccaggactaggtggggtgggagtgctgcgttctgatgatggtgagtggtcttgatttctgttagtaggattcttacgtttgcctttcgccatctggtaatctctgaagctagctgttttagttgtcactgttaagagcttgttcttcaggtgactctgttagcctctataagcagacctggagggtagcactctccttagtttcagtgggcagagtattctctgcaggcaagctctcttcttgcagggcaggtacccagatatctggtgttcaaaccagactcctggcagaagttgtgttccactcactagaggtcttaggatcccgtggggagtcccgtgtgggcccttgcgggtgttgggcaagactctgctggcaaggtagcccggggctcaagtcgagcggacgaccaccttatttctaagtttttctacaactctgaggcttttctcccagttcctgagtttgagttttttattttgcatcctgacttcccatggcatctggcaggactcttttctgcttggttcttctatactctagccatgatactacaagcttcgaccagttgcagggtcaacccagaaactactccccccactcccaaatgtcacttgtttaccatctccagagccaccttctaccttcagccaaagtatggataaacactggattaggccagccacatcagtgccaaaaggggatgcaattatgttggagctgactgagcaggagactgtgaagacgaacgacttagttcctcagacacagcagctgagttccatgttaagttccctcctggatgtcatgtcctcactttgacacaaagctagctggaacctatgccctcctagtaattaaagctaatgagtgttcccccatctggagggtagcatgggggaatctgctctttgaggccacattcttttgttggcactcgccctcgggccaagagacattgaatatattcccatggggtgaacctacaagactgagggcaagacaaggcatgagagggccacaaaatgagtctgctgaggtctggcccctacaatgtacagagctcctgacacttacttgaggccacttgttcagaacttcagtcagatcttatcaaaccagaggactgagctgtgtctaaacccaggagcaaaaattgaccatgtggacaccatgctggctgcagggccagaaacctggggagggatggtagaatcctgggctttcccaggtgcctctgtagcatagctctgagaccccaaacaagcctggatttttccacattccaggctttcatctatgaaattctcaaataattaataaaaataatatactttttaaaaaacagactatgaagatgtccagtgagatggatcgcaagaggctgaagagggggcaataggaaggggaggaaagagatcataaagtcgggctgggaaggggaaggaaacaaaggtaatagaatcaatgtccttgaaatcacaatgaggtgtccccacagggacctgagagagcagcagaggaggggggaaagaccgatgaaacaaagtctgtatgaaaatgccataacgaaacccacttctttgtatgtaattttaaaaaactaatttggaaaaaaaaaccaaaaaacaaaaacagaaaaggaaagaaaatccagcatgtgccagaaattgtatggaggtgctgtatggcacgcttccttcctgcccagccatggtctcacttggagtagaaatctccagaaacagccagtcctctgttcttctgttccagccacctacagctctgctctctgagaagccgcgctgactcgctggctccagctgtgatgctcagctgtccgtccatcttgtctcctggaacagctcaacccagggtcttcctgaagtggtgatcactccagctggcaggtcagtggcccagggatggctgaggacagaggtgtaagggcaaatgaggatgtttcaggttggggtgtccgggtattggctttcatttaccagctttgtggcttaagcatttatatttacaaaatgagtgtgtgtagggaactggacaggcttctcagccccatgctctctgcccagcaactgacctcgctaggaactaagctaatcatccttgcctgccccacccccaggcttgtgtcagcccacctatctgataactagctggtcccaggcccagaggttatgctggacttttatacacaggatcaattttacctaatgcacaggtccccataaaacagatgttgccttctgcactcagagcattgggcctggaagtctgtaaggcattcccaggtgcttgagcgatgctgcacagaccagttagctgcagcagaaactggactggggtctgcctgactgctccaaccttaccccttctgtgcctgccatatttgtcaaagcaagctgagccctggcacaagccatgggggagttcctagaagaatgagttccccctgcttcccactgatgtacaacagcagcttcttttctgcatgttcctacgggctgttcagccctcagtttctttagaaatcgggttctacaaaattcttaagaaatattcacccaccatttttaaagtgttttgatcatgctctgccactgcctttgctgagtagagaatgttgcccttgtgacaaaggctttaggagtggaggcagctacagggcactggccccaagctgatcccttagcccactccacctatgtcctgttgagagtcactgtcacgccaccaccgttaccctagggtgcatcttgctagaaacaaagattgcctacatgttatagggttgcaaccatatgaatgccctaagatggggtggcctcagctgtatgctgctgcccttggtggtagcttacatagacaagtggccctgacttcctcactgactctctctacagggatagaaaatggtaccagtcaggccagagctctgggatcccacagtcactgctgcaggatggaggaacctactcccgagcccgtctatgtggatgtggacaaggggttgaccttggcttgcttcgttttcctttgcctcttcctcgtagtcatgatcatccgctgtgccaaagtcatcatggacccctacagtgccatccccacgtccacctgggaggagcagcacctggatgactgaggcacatgacaggtctcagtgtcctggacacacctctgtacaccctggccaacatcctgcaagctcttgggagactgggtgtggctataaccactcagagatggagaaggctcaccttcgccttactgactctcacataaccaccagagggaaatgccagcatgcctgagccaaggcagtctggggaagccaggggagaggaatgctaagccatgactcaggattgtggaggccatcctgggactccactgggagacagacagcagagtgatggtccccagcccaggctccagggcacctttgagatctggaccaaaaccagatattctggtctgtaaacagtgatcaggaggagactgaccttcaactgcacagcactgaggggttgctgagagcccagtaccctctacagactagcactgatgaggcaggaaagatggagacttcagggggcttctcctgcaaattctcacaaggcacacggctacttccaaactttttttttttttaaaaaactaagatacagagggaatatatttttcctgttaaaaatgagatgtgcattttagacacttgggaaaatatagataaatagaaggaaaggggggtaaatagcacttaaaatccaacctcccagaagccatcattttgatatatttcttcaagtcttttttacaggaatttttttagtaattcacaccatatgcatgatgctgcattgattcgtctgatagcttaaatatcttctgcctcacgagataccatggctgtttttagtgactgagagtatactggctaggccatggctgaatatagtcgttttctttaatctagttaactttctactatgtactcacaagaatcacttcacccagtaaccttcagaagctctgtatcacaggagctccaggcaagagctgggttctagacctgcttcagctattcaaaggctgtaaaagtcacctcacttcttggtgcctccatttcctcattgaaatatgggaaggagaagtctgtctttctgtctgtctgtctgctgtctgtgaaagcagccatgtcacaagtgggagctgagactagcttgtctcttctgttgtctttccttcatcttcttctcccacacactgtcccgtgtgtctgtgaccttgctgcaaggctcctaggtcacagcccacaaccttccacaacctgcttcaactcctgtgtccttattatatgacccctaaataaatcagcacctgtgagctcc

SEQ ID NO: 305 - DNA, 3417 bp, Mus musculus
agagttgtggggaggacggactgaggtgcgctgaggccgaggtggacctgggaggcttggctggtgcgaggctggggctgtgtgtgggaacttggcgggagaggagcgagccgggggcgggcgggcctgaggcggcggctgcgggtgggcgcgaggcggtgcgtgggtgaggcggtgcgtcgatgaggcgcgggaaagcaggagggcggcaggctggaggctgctgcggttctgcgtggcccgggcggccaagcccctgtgcgcgttattccgagtgtggctgctgggtggtcgccatggcttctagcttttgctctgctcacgtagggaagtccgacctttcctctcttcgtcccttttctttgctggtcgcagactccagggcctggtgcagccgggaagcccaccccttgtgcagctgccctcttgcatggccctaggaggttttaaaagccaccttgccacgggaaagcaaagagccgcgaggaaaaggaggactaaacaacccgggtggaattagttcattgcggctcacctgtctccagccgccggtgcctcggttagactcggtgtagtgacagagccaattaaggaacaagtagctcccagaagtatcttccttggtcgataagcactcttcggtttcctgaaaccttgttttagctagctccctggtgcgtgttggagttctccagggtctccccgctcttagttgttacccagagcttgggtctgtgtgagaagatgaggatccccgggaaatctccagatcgccttgtggaggaggaggggagagaacagagtttgcaggcttttgattatgagacagaaatggtgtgagcctcggttagagttgttttcgcttcttgttcatcctgcacagggccaaagcatgtcctccctccctgggtgcatgagtttggctgcagcgccagctgcagctgactctgcagagattgctgagctgcagcaggcggtggttgaagagctgggtatctctatggaggaacttcgtcagtacattgatgaggaactggaaaagatggactgtatacagcagcgcaagaagcagctcgcagagctggagacgtgggtactacagaaagagtctgaagtggcttatgttgatcggctgtttgatgatgcatccaggtagggattccaggaagcagaagtaaatgtccatctgtgtcctccttggagtgactgttgttgtcattgtcctaagcactttatactttggcgacttcagtcaggtggggccttactcttcctctgagtttgtaatgcagagttgcaacacaacactttttccctgtgggtagctgctatgtgatcagcagtagttaggttaaaggcttgaattcccttgtcttcctcctggactgaccttccttcctaagatccccagaaagtgaagattgtagagttgctgtcttttctgtttttctgagacagaatcccaatacctaaatcttgctggcctgcaacttgcagagatctgccgacttttgcctcctaagagctgcaatgaaatgatcctagcttatgcttgttgagttgattggggtttcatgagtaacagagtgtggccttgaatttgctccatgatcttgactcatggataatcctgtctttttatattttgagtgctgggactatagttgtgggccaccatgcccagtttattttgtgtttgggttatcaattagggctaagcaatcatttgccagttcagctacatcctcagcctctgttatctttaattgtgaaacattaaaattcataattcctccataatatatgtttcagatcaccagtgcaatttaagattttggattgttgaaagactagttgaaaattgatgcagctattcattatattgacgatatttggctggactcacagagaccaaactacctctgtctctttactggtgagattaaagggatatttcacaacacccagcaaaatgaagttgctatttaaagctgtctacttagttcccaaagccacatagataataagtattggatattcttatttttgtaatagcgggtgaaaactgaactctggcaagttgtttcatagaataattgcatggaaacaaactttatgtggaaaaagcattctaaatactttggaacatgtagagcaaacagtctatatttaaatatacataatttcctgttactgtgttgtgttttgtgtgtgtatgtcggggggggttgttttttggtttttcttgtttctgtttttgttttgttttatttttgagaccgtttctttctaactctggctgtcctggaactacctctgtataccaaattggcctggaactcagagatctgcttgcctctgcctcctgagtgctgggttctgtttttgttctgtctaaaggtttcttactctgtaggccatgctggccatgaaccactcactgtattgaccaaagtgacctcaaacctagctagccttggttcctcaggctaaggactaggattacatgtgtgagctcagaggctaggtattgtataaatgtatatacattgtaatgctcttgtaccgcactgtctccactggctttgatcttttctgcatgtgttccaatatcagggaagtgactaactgtgagtctttggtgaaggatttctactctaagctgggactacagtatcatgacagtagctctgaggatgaagcttcccggcccacagagatcattgagattcctgatgaagatgatgatgtcctcagtattgattcaggtaaatgatgaagctttggtcagaaaagtcttagaatggaagctgaaatactggaagacaagtatgttgcacgtaaagaatcacattgtcattacttactatgccaaatacctgactgacttattatgacaacaagtaagtattcttagcatcgtaagtgttttctgtattctgattgcttcctttccccatttcagataaggtatacttattttctgtcttttcccccatgtgtttgtgtgtagtttgcctatgtctgagtttctttttcagttatggtgatcaaataatctgacaaaatcatttgaaggttaagggggctgatcctggttccaagttccagatcatatccatgatggtcggggaaatcacagtggcaaaagcctaaagcatctggtcacattgttctgcaatctggaaacagagggagtgtctcatcctgctgctcctccaatcactctctttatttgtgtatttatgaagtctatggaatggtaccactcacagtgggctggtccatgaacaccatgaaacatttagtaaatacttcccttggtaacttttttttttgtttgttttgcattgtggttctgatgtgtgctatgtatgtagtacatgaagcagtaaactctaagcatcaagttacaac

SEQ ID NO: 306 - DNA, 34913 bp, Mus musculus
aaacaatttcaattctttattaatggctggcttagacattttgatatacaaatattgaatagaggccctgattattgagtgttgttaggagtaataataagctttacattatgctgtggcccagcaggacaacattctattgaaagcatgtagtaaatgactcactatgtatttgtggatggtctataacaggttggaacattttggtagacccatattttctcttttgaccacattttgcccagacattatattctgattataatttttcctctctgaattcttcccaaattttacacctagaaacccaccaaaacccttaaaatttttctctattatttgaatacatataggtatttataaagtaaaattaaacacattgagaataggacaaaacaaaccggaaaaaaaatacccaaagaaatagcataagaaacacacatgtgcatagacatagttactcacacaaaatcccattaaaaagaacaagattagaaatattttcacaaaagacttgtcaggtgaaacatacatattcagaacaagtgttatgagacaaacaaacaaacaaaagaaaaaaacaaaacaaacaaacaaaacaatcaaaagattaaaaaaaacaaaacaaaactaaaaaaaggcaggtgagtttgttttatttggggtatcagcttctgggcttgggcccccctaaatgtgatttatatatccagtgagacttccttggagaaaactgactttactttttaagttgttatcaactgcagatagatagaatctgccatggggacagggacttggttttactttcactctcagggctggggcaacatttggtttgggcctgtgcatgccctgtgcatagtgccacagtctctgtgtgtttttgtgcaatggttctgttgtctcaaagatgttgttttcccaatatattgcatacccactggctcttacaatatttctgcttaatcttcatcacagttctctgagccctgaagagggtatttggtaaaaacatccaatgtagggctgagggttctctcacattgtctggtgtgagggtgattctttgtatttgttctcatctgtttcaggatgaagtttctttgatgatggctgagaaagacactgttccatgagtgtatcagaatattgttaggaagtatttcattgctgtactcgtttaacagaacggtcatatttatttttccatatgtccatggcatatgtagtctcaggttcttgactacctgagcagtatcagaataagttccgggtcatgaagtgagccttaaatccaatcagataatgcttggttacttccataacttttgtcccactatttcaccagcatatgctgaagatgtcaccactggagattgaaagatttgaagctgacttgatgtttatttttctcctctggtagcctgaaaaattattgccagaaccacgaacattagtctgtagaggtgaagaccctaggtagacaccaggttcttttctctgtgttcaatgtcttctagatgttgtcataagtaataaggccttaccataattttgcagagagcaacctatatccttggtaacagcctgatttgcctaggtgagtctatgggcccctttggccaacaactcaattagattaacccattctaggcactaaaggtttgatttggtggcaaaatatacctagttgggggtttcactcccctgttatctggtgatttaattaagatttttataaagaaacttctactgtagtaggtttctatcaaaacacttaaatggtaattggttttagctctctcttcctgtattttctctcttattttctctttggaaaaatctttatctccccctaatcatttctgatacacctaaatctgtgactatgtggattgcagtctgattatcagagacataacagctaacattcacatataaaagatacacttcatatttgtcttttggggttaggtaggctcactcaagatttaaggaggtcccatcctcattggcctattaaccttttccttacactacttctggtggatcatgggttaaaagagcagttaaagcatttaagtaaagttattacagtaggtttttaaatatataagcatatgtagctgaggatggcctagtcggtcaatgggaggagaggcccttggtcctgtgatgattatatgtctcagtataggggaaatgccagtgacaggaagcaggagtggatgggttgatgagcaggggaagagggaagggatagggggttttgggaagagaaactaggaaaggggaaaacatttgaaatgtaaatgggacctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtgagaatggctaagatcaaaaattcaggtgacagcagatgctggcgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtatggagctgagatgaaaggatggaccatgtagagactgccatatccagggatccaccccataatcagcttccaaatgctgacaccattgcatacactagcaagattttactgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagtaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaatggaaaaaaaaaaaaagataggaaaccaaaaaaaaaaaaaaaaaaagaaaaaaatataagcctatagtagtaaatgtcaaaagttgtcaggagcccttttttttctctttttttaaattaggtcttttcttcatttacatttccaatgctaacccaaatgtcccccataccccccgccactcccctaaccacccactcccacgtcttaaccctggcattcccacttactgaggcatataaagtttgaaagaccaaaggcctctcttcccaatgatggccaactaggccatcttctgatacatatgcagctagagacacgagctctggggagtactggttagttcatattgttgttccacctatagggttgcaaatccctttagctccttgggtattttctctagttcctccattgggggccctgtgatccattcaatagctgactgtgagcatccacttctgtgtttgctaggcactggcatattctcacaagagacagctatatcagggtccattcagcaaaatcttgccagtatatgcaatggtgtcagcatttggaggctgattatgggatggatccccggggcaaggtagtctctagttggtccatccttttgtctcagctccaaactttgtctctgtaactccttccatgaatgttttgttcccaattctaaaaaggggcaaagtgtccaaactttagtcttcgttcttcttgagtttcctgtgtttcccaaattgtatcttatatcttgggtattctaagtttctgggctaataaccacttatcagtgagtatatatcatgtgagttcttttgtgactgggttacctcactcaggatgatgccctccaggtccatccatttgcctaggaatgtcataaattcattctttttaatagctgattagtactccattgtgtaaatgtaccacattttctgtatacattcctctgctgaggggctcctgggttctttccagcttctggctattacaaataaggctgctatgaacatagtggagcatctgtcctttttactggttggaacattttctgaatatatgcccaggagaggtattgcgggatcctctggtagaattatgaccaattttctgaggaaccgccagactgatttccagagtggttgtacaagcttgcaatcccaccaacaatggagaaatgttcttctttttccacatcctcgccagcatctgctgtaacttgaatttttcatcttagccattctgactggtgtgaggtggaatctcagtgttgttttgatttgcatttccctgatgattaaggatgctgaattttttttcagctgcttctcagccatttgctactcctcaggtgagaattctttttttagctctgagccccattttttaatggggttatttgcttttccggagtccatcttcttgagttctttatatatattggatattagtcccctatctgattcaggacaggtaacgatcctttcccaatctgttggtggcctttttgtcttattgacggtgtcttttgccttacagaagcttcgcaattttataaggtcccatttgttgattctcgatcttacagcacaagccattgctgttctattcaggaatttttcccctgtgcccatatcttcgaggcttttccctactttcttctctataagtttcactgtctctggttttatgtggagtgtcttgatccacttagatttgaccttagtacaaggagataggaatggataagttcgcattcgtctacaggtagcagattaattagctagtaaaactgatgcacatcataaatgctggggtgtcctttgggaagagtcatggttcacactggctggcataatttagtcatggttagaatactcctttggatattgactagcaaccaggaaagaatagttcaatattatctcataatgaaagtcaagctaatgcacaattgtttgttcttacataactttgaccatgaacaatgataactaaaactctggctttttctccttctcttatttaacacagcccatgataaattctgactcttcccaacatcatttcttattgtaatgccttcttactgtcccctgagctgctctccacaccatgctattcaggtttcacagcagattcatccattcttgtaggacatcaggcagtctttgttatttctctgtagagaactcttcattaaaaatattattttaacaaaataaaaattgaagcacaagttatgacagagttccatagtgccctgtacaattggtcgcagacctatccaagtggtgaccactagaagttttaccccttccctgcttctaacatgtgccttacagtgttttgtatacctattatctatgttttaaaatcacttgacttggcctgtataagtaagactctaggagcctatccctgtataaaatcacaattccttattgtcttgtcctcactattcctcatttttaaaatttttctacaggtaatatctgctagcacaggatgtataacattgcatttatttattagtgcattacatgcctctcccccctaggttgcaaatacatggaaaaagaattaacacctatattgttcactgatattatatccacagagcctataggtgtgattagaacttagtaaaatttaacaaatatttttgaagttaatgggcaaattttgttatgaataactagagatattaaaatgggttttgctgaatgtagaaggtggtaagcactgatacagttcttcaatattggtagatttattatcagctctttagataagaaagtagagttctttcttttgcaattcaagagcttttattataagtgtttggagttattgcaaaaccactggggtccatctcccacatgtttctcatacttatctttgtctttccagtattgtggcaattgccctagattctagcctcgttaactctcagcttcattatcacagtaacttcataactgactttcctatctgcctcatccctctagtctatcatgcacagtcctacttaagtaatcttcataaagggtatgctaattttgtcagccccttgctgatgtgcaacttcataacatcttaaacctctttatgatctattatttctgccttaactactaggagtgatttctcattaaatccctttcctttgttgcaaatggattctttatcttaattcctaaatacatcggatttttttcattatctatgctttctttcagtcttctgccttaatattttattttaatttgttctctcatccaagtattcctaatttttaactgaatataacaaattgaaataggtaatagtgtccttttatgaggccaccacatccagagatgtgtcatatcactcttagaacatgtagatgaatggtctgaaaatatttgtggtctcagctaagctatttgctgtagattgccatctattttccaatccctgaagaatttttaaataccatgatgcctcttgcatgaaaagatacagacggaaggataggcatatcatcaactttactattatttatattggtatttagttggtactgatctgaaacaattcaagatttcttccaagaagaatcattgaagaatttatcttcatcacatgaaaaacatagtaaaactttatgtacagtgccctcctttggatgtcattgagagcaactagtatgtctctagtaaggggaggggaggtttaaagaacgttaccataaaattcaaacccctactaatccgtaattttacagcatgtattccacacaggatggtgtgatctgctctgttgaagagactgtaagaaagcctggaggtgctggtgcatgcccttaatcccagcactcaggaagcagaaacaaatagatctctgtgagtccaaggccagcctggtcctcagatcaagttcctaccagggctacacataaagaaaccttatctcaaaaaagcaaaacaatttttttcttcttaaaattattttaaatgtttatttatttattattttatgtgtatgtgtattttgcctatatgcacgcctgtgtaccacatacaagcaatgcccttggaggccagaagagactatcagagccccctgggtgctataaccaaatcatagtcccttgtctcttgcaagagtaatacctgcttttaactactatgtcaactcctctggcttttccctctttccttctttctttgtgcccctctctttccctgtctgtgtgctagtatacatgtagaggttacaatgtgaaatgactagagatatagttaaagtggattttgttatttttcttgggaagcttgggtagttaaggaaaagtgttgggtttggcaaatatcttatgatttatgtttctaatgaagtttttggttttttttcccacataaaatgagagttagtgttttaagtctgctgcctagctcagaggcctattgtcatcatggaatgataatatttgtcaaagcattttgaaaaactcatacattttagacagattaaggtattagggacaacatttaaaaactcattgcagttgctttatcaaggtattagaagataaagttcttaatctcaaaattaaatgccatgggtgctatagagtttatagactataagagaggtttatgagattccgaaggcttggttggaatctatgagtttaaaatatgggcatgaggctgagcagatgactcagcatgtacacaatgtgttagcaagcatgagaatcagacacagtcaccagaattcatatgaaagaatgagagaaacagctccacaaatgtgtttcctgacatccacaggcatgttccggcatgtatgtgctcacacatacatcatacatgcaaacaacgataattacatgccttaattttagaatgaaaaaatgtgggctgttcttaatctccatgtaagactcttaaattgagcaattctgccaatggcataagtcagtgtcctgatgcatttaaccatgcctgtaaggcttggtaaatcagccccaggagtcattataaatgagtcacatgatgctctcttcttagcctactgtcttagtcagggtttctattcctgcacaaacatcatgaccaagaagcaagttggggaggaaagggtttattcggcttacacttccatgctgctgttcatcaccaaaggaagtcaggactggaactcaaacaggtcagggagcaggagctgatgcagaggccatggagggatgttctttactggcttgcctctcctggcttgctcagcctgctctcttatagaacccaagacagccagtccagagatggtcccacccacaaggggcctttcccccttgatcactaattgagaaaatgccttagagttggatctcatggaggcatttcctcaactgaagctcctttctctgtgataaccccagctgtgtcaagttgacacaaagctagccagtacacctaccttgaacaatcacagatggtataaggatttgttatgtattttggataatagcaattttttggatctagggttgatgaagatgtttccccagtctgtagtctggcatcctgtcctgttgacagtgttctttgtattacagaggctttaaggtttcagaaagtcctatttattcactgttgctcttagagcctgagacattagtgtgctgttcagggaattttctcctgtgccaatgagttcaaggctatttcccactttatgttttattagattcagtttatgttgatatccttgattcatttgaatttgaactttttaaagggtaataattatggatctatttgcactcttctacatgcatacagttagacctgtaccatttgttgaaaatgttttccttattacattatatggttttgactggtatgtcaaaactcaagtgtccataggtgtgtaggtttatttctgggtctttgattgcattccattaatcaacttgtctgtttgtgtaccaacaccatatggatttttttcactattgctttgtagtacagcctaaggactgggatggtgatttctttaggattcttttggctatcttgggatttttggttttttcatatgaatttgagaattgctccttcaagatctgttaaaaagaatgctgcaacattaaaattgcaacattttggtggaaattgcatggaatctgtagattgcatttgatatgatgacaatttttactatgttactcctacctatccataaacatgggagttctttttattttctgatttcttcaatttctttcttcagggacttgaatttccggtcatacagatctgtcacttgattggatagaattacaccataatattttatatttttcctggatattgtagaaaagggtgttgtttctctattttttttctcagcttctttttcatttgtataaagaagggctactaatgtctttgagttaattgtgtttacagccaatttgctgaagttattctcttaattagctgtagttcttctctggtagaattttgggaatcacttatatacactatcatatcatgtgtgaagagtgatactttgactccttcttttccagtttgtattcccttgaccaccttttattgtctactgctctagctagaacttgaagaaccatattgaatagataggaagacattggaaagtcttgctttgtccctgatgttagccaaatcacttcaagttactctgcatctaatttgatattggctattggcttgctatatcttgcttttattatgtttaggtatgtgccttgaatccatgacctctccaagacttttaatatgaaggcatattggatttgttgaaggcattttcagcatctaatgagatgagcaggtgattttcttctctgagtttgtttatattacactgatgaattttcatatattaaaccattcctgcatcgctgaaatgcagcatactagattgcagtgaatggtgcatttgatgagttcttggatttggtttgtgcgaataattttattgagtattttggtgttgatgttcataagtgaaatcgttctgaagttctctttcgttgttgggtctctgtgtggtttaagtatcagggtgactgtgacctcatggaataaattaggcagtgttccttctgtttctgttttgtggagtagtttgatgtgggtctgtgtactggaggctttccgtggagatttctggcccagccaggtgcaagggttcaggcaaaggggagagaatatgatcagggagggaaagtcccctcccctgtctcaactgctgcagctgctttgacctctgccattgcctcctgaattggtccaagatgctgcactggttgccctgcaccaggtgccctgcactgagctcataaaagtcctactagccagtgaggagtgatggggagcttccggctgtgtttcaggagagaagatctcttcccaagcagcagtggtacagctcttatgacagaagctctcagacgacagagtaattctcacaccttcgttccttccagataggattcttatatgcagttttggggtgggtcaggggctgagagcagatactccttatctgaggtcttggggataccttatctgcatgtgggagggcttggtgctgctcctaagtgactgatggccacagacctttctacagggtgctatgggaggctatagctatgtgacaagtgccacaggcccaggagagtggcaaaaacaccctctgtcccttcagggtcattgtgttttcaaccaggaaccaggctggctctcacagcccactgccccacagtttgaggagtattgtcactagctcttctttcaaagtctggtagaattctgcactaacatcatttggccctgcactttttgagggctgggaagtttttaatcatcgcttttatttctttatatggtttatgggactgcttagatggtttacctagtcttggtttaacttttgtatgtggtatctttggtttatatttttcagttttgttgagtgcaaacatttgaagtaagagctaataattttttgaatttcctaaatttctgttatgtttcccttttcatttctgattttgttaatttggatactgtctctgtatcttttagttagtttgcctaagagtttgtttattttgtcgattttctagaggaactggttcttgcttttgttgattctttgtattgttctctttgtttctaattgattgattttgggccctcagtttgattatctcctgctgtcaactgctcttgggtatatttgcttcttcttgttctgaagctttcaggagtgctgctaagttgctagtataagacttttctaatttctttatgaagggatttagttttatgaattttcctcttagcagtgctatcattatgtcctataaattttggtatgtcatacctttgttttcattgaatgcaagaaagtgtttaattcttttctttattcctttactaagtgattattgagtaaagagttgttcagtttctctgagtatgtgggctttttcattgcttctgaatttgttcaagttcagccttaatctgttgttgtctgatagaatgcaaaggattattacaatcttcttgtatctgttgaggcttgctttgtgtctgtttatatggtcaattttggagaaggttaattatggtgctgagaagaatatgtattctcttgtattagggtagaaggtcctataatctattaagtacacttggttcacaatatctgttagttttattgtgtctctgtttattttctgtttcaatgacctgcccattgatgagaatggggtgtttaagtctcctaatattattgtgtgggcttcaatgtgtgttttgaggtttagttaatttcttctgtgaatgtatgtgcccttgcatttgtggtgtagatgttcagaattgagacttcatcttggtggatttttcctttgataagtatgaagtgtcattacatatctcttttgattgcttttggatgaaagcctattttattagatattagaatgggttctccagcttgttttttgagtctgtttgcttgtaaaacttttttctagccctttactttgaggtagtatgtacatttgttgctgagatagttttcttgtatgcagcagaatggtggatcctgcttacatatccagtgtgtttgtctgtgtcatttcattgatgaattgatcccatcaatcctgagagatattaatgaccaatggttgttagtttctgttagtttgttgttagatgtgatactgttgatttctatgattctcttctttggggtttgctgtgagatgattactttcttgtattttcttgggtatggttatactccttgtgttggagtttcccttctagtgacttctgtagggctggattagtagaaagatattgtttaaatttgctttgtcatttaataacttcctttcttcattttaattgagaattttgtttggtataataatctgtattggcatcagtggtctcttagtgtctgcaagatatctaatcaggatcttctagctctgtttctgttgagaagtgaggtgcaattctcataggtctgcctttatatgttacttgtttttgttttttgttttttccccttacgatttaatgttctttctttccgctgtacatttacagtttattatgtgacagaaggatttcctcttctggtctaatctgtttggtgttctgtaggcctcttgtatgcttataggcatctctttctttatgttaatgaagttttcttctatgattttgttgaagatagtttttggccctctgaagtaggaaactaggaatcttcactctcttaggttttgtttttttattgttcccaaattttctggatgttaatcactttgactcttttttttttttttttgactaatgtatcaatttttcctggtatcttctatacctaagattctctcttccagtttcttgttttctgttagtagttcctgttctcttttatagaaaattctcttttataggttctctgtaggctcctgtgctactccacaggtcacagccacttggggaggcagagtgcagggagtttgactatgtttatcccacactgtcactggggcatgtgatgtgctaatcagaagcaccaaagcactgggtgggggtgggggtaggaaagtgtagtctgagatgtgggaaagctgaacctggctcaggagtccccaggcctgtggaacagccaggctgtgggattcactaactcttggacatacagacaactctgacagtcactgaagagcagagaatggagttggaggcctgtgggatatgggtggagtggggaaggggagctcgagcttgttctagcagggtgattgtccttagcctggtggaggcaggattggtggcagttgtggctggtattgcagagaggtcttctccatggttacctccatttatgttttctttattgcttctacttccacttttacatcttacaaatttttgttcatttccttcaactgtttgactgtttttcgtaaagagatttatttgtttcctctttaagggcttctagctatttgactgtattttcctgtatatctttaaaggaattatttgtgtcctttctaaaggcctctattgtgggcttagattatttaaaatctacttttaataaggattctcaaatgatttgagtccccttctagccaaccatccaaatgtagaggagaaaagaatggtaaataggacaagggatttgaaccagtttaggagaagttccttggtgtgattctaatttcagtttgtcaggataccacagtccagttcagtagtgtcagaatgccaaatatgaatcagcatcaatggcatgatctagcagaatctaccagtgctctgcccaatcagcaggagccaaagggagctatcaggaccagccagcacaccaggagaagctctctgccttgcctctcttaaggaagttaagatcagcaaagatgaagatgagagaccaaaccaatgactatgcaagcatgtcatcattgtctgttgagttctatttatactttctccaaatatcatgtatcctcccatggtccttgcctcagcaaaacactgcaagagtcagcctcacaatgtgaggctgtatcagcaaggcaccatgttagcctgtatcacctgacatgtctagaaactttcatttcacattatcatcttcataagataggaattaagttaacaatcttgctctttgggtgtgttcagacatccagggcttgctgtagcaggaaagctgggtcctgaaggtgctgtgttgcattggcttctgttgattatgttctagtgtttgcctttcactattgttgtctctggtattggctagcctgggaattctgggttggagtaggcatccaagaaggcaaatagagctgtgtgtcccaggttagaccagtgtcctgggggcagataaagctgtgtccctggttacaacagacctcctagaaggcagacaaggctggggttgggggttggtgagctccatgagtggagaaggaggtgtgaactgaaggggagcctatattttatttttaagttctaactgtagaaatgtgccatacatacctatctattttacaaaaacaatcacaagagatattcctatttttaataagattttataaaaagtacattcaccagaggtctgtgctgcagcctgaagccatgccaatgtccatagcctggagcttccaccatactgatttaaatggcctttgatgaaaccatggtgatgtctgggctttgcttctgccatgtctgaatctggggtctgtgttggtgttcctggcccatgttgttgccaaaagccgtgctgaggtacatgatctttgctgccatctgaagccatgttgatatccacggtctagacagcctctgagggcctatctgtgtcaggagtcctattgtggtagggaaccatgctggtctgtactgttaccagagactgtatagagagacctatgattcatgttccttgtgactttgcaaaatcaaagaggctacttttgctgagattgatggctacatacctatggttgagagggagagacagggaaggcttctgagacaatttctagtgcaacagtcaaaagaggaagccactgaaaagaactcttacaaagtgtgactaagatgcaaagagtagctttccacagttgatggcttcaaggggaatttgtgggaggggaagaactcacttctatttaacaggcaggctactgagaatttgaccatgctccagtgagtatatagacaacacaaatatacttggattggagggggggtagttcataaggaggcagacataaaagggattgccatcaggctaaatgatatgaaattcccagataatcaataaaaatggcatgtgggaaaagttacattcttttcttattgacactcacaatgactgtgtctcccaatgactgagactagtattttgccagaattttgagaccctctactaagaagaaagtgtaaacctttgccagaatttatagagctagcaaacttggggttatactgcttctaaacacactggcatcaaatccatcaaactgcagtcagttattagaaattgatttcatgcctgacattttatgctgtggtttattagtaaatattcatgaaggactaatctacttgtcttcttttaatacaacaaagtactcttaagttcacctggtataggtggcatttgtgtaaatggctgtattagttctttataattctatttgaagttattaggctttatgaatcacttaatagttctcctaaatgtatttaatcttactggacagagtaagaaaaacttcattaatcactgtacactcattttgctactagtgctttaaagttcaggtcataaaaacacaattaaaaaggaaaggagagaatgaaaagaggaatatttcaagtattttttgtgaacatttgcactgtgagataactggtaacaaacccacagaaccaattagcagatctttatttttctgtatctggccaagttagtttgagagaatatgggatgccacaccaattaacagagctgagtcagcctctcttttgacaaacacttaataagcaatcaaatacaaacttgagatttcagaagctcactgatgggaaggagagaaactccattgcttatctggaataaagaaggggctgaattaaaccaacaatgtgggagcaagatgaaaaataaataaataaagaagtaaagcaagaaagcagcattttactttagcactcagataacagaaggaaggtattttgtacttcttttcttaccagcctatattaaagcacagctacagaatctagtgccttcttttttgtagagtttcttttgaaacaattgatgcctgtgatattcttgatatttatatttaaaatcctgattctcaagttttttttatgacttcaaattcagcaagtctcttataatcatttttcatcatttgatgtagttgatgatgactgtacctcttgcaacccccttgctagatctataggtttatgagtctaatgctattctaaccggctcaccaaatctgaaattaatttgccttcctcaaacatggcataatgaagccacatttctcatttttctctggtgaagaggtttcttatttaaaaagttattaataagaaaattaaataaaaacaaaccactgcaatgcaaacacaatgatttaaattgtagagaataatcaactgtagtatgctcaatgaaaatgagacaattacattacaatagttatcaagctacaaggagaataatgggaaacaaaacagaataattttagaaccaaatgttcaatagagtgtctttaaacagtacaggaccattgcactataaactcacagcagctatggatgcctgtataagattagcacaagatctttaggttagagaaattttcttttataattttgttgaagatattttactggccctttaagttaagaataatttagtacagaaagacattctttttttttaaatattttttattattacgtagtttcctcaattacatttagaatgctatcccaaaagtcccccataccctcccccccacttccctacacacccattcccattttttggccctggcattcccctgtactggggcatacaaagtttgcgtgtccaatgggcctctctttccagtgatggccgactaggccatcttttgatacatatgcagctaaagtcaagagctccagggtactggttagttcataatgttgttgcacctacagggttgcagatctctttagctccttggatactttctctagctcctccattgggggccctgtgctccatccaatagctgactgtgagcatctacttatgtgtttgctaggccccggcctagtctcacaagagacagctatatcagggtcctttcagcaaaatcttgctagtgtatgcaatggtgtcatcatttggaggctaattatgggatgtatctctggatatggcagtctctagatggtccatccttttgtctcagctccaaactttgtctctgtaactccttccataggtgattgttttcaattctaagaaggggcaaagtgttcatactttggtcttcgttcttcttcagtttcatgtgttttgcaaattgtatctaatatctcgggtatactaagtttctgggctaatatccacttatcagtgagtacatatcatttgagttcttttgtgattgtgttacctcactcaagatgatgccctccaggtccaaccatttgcctaggaatttcataaattcattctttttaatagctaagaagacctaataccaatactcttcaaactattccagaaattagaaacataaggaacactaccctgttcattctatgaagctgcaattaaattcatatctaaaccacacaaaggcccaactaagaaagaggacttcagaccaattgaccttatgaaaattgatgcaaaaatactcaataaaagtctcacaaacagcatccaggaacatatcaaaacattcatccatcaggatcaagtaagtttcatgccagggatgcagggatagttcagtatatggaaatccatcaatgtaatccactatataaacaaaaaacacataatcatctcattagatactgagaaaacatttgacaaaatttaacacccaatcatagtaaaagtcttgtaaatatctacaattcaaggtccatatctaaacttagtaaaagcaatatagaacaaaccagtagtcaacatcaaattaaatggagagaaacttgaagcaattctactaaaataagggactgacatggctgcccattctctctctacttattcaatatggtacttgaagtcctagccaaagcaattagacaacaaaaggagaatgatacaaatcagaaaggaagaagtcaaatatcaccatttgcagatgatataataatatatttaagtgacaccaaaaatttctccagagaactcttatagctaataaacaacttcaacaaagtgactagatataaaataaactcaaccaaatcagtagccttcctctacttaatggattaacaggctgagaaagaagttacagaaatgatacccttcacaatagtcataaataatataaaataccttgctgtaactgtaacaaagcaagtgaaagacataggtgtttcctgagaagctctgccagagcttggcaaatacaagggcagataacaattggactgagcacagggtccccaatgaaggattcagagaaagggatgaaggagctcagggggtttgaaacccataggaagaacaacaatatcaatcaaccagacctctccccgagagcttccaggaagtaaactaccaaccaatgagtacacatggaggtactcatggctccagctgtatatgtagcagaggatgatcttgttggatatcaattagaggagaggccattggtcccagtaagtctctatgccacagtgtaggggaataacaaagaggggaatcaggagtaggtggatggatgggagagcatcctcatagaagcagggtgaaggaggatgggatatagggtcccggaggatgatctacaaaggggatatatatatatatatatatatatatatatatatatatatatatatattcacagtggactcgaaagggttcatgatctcccacactgaactgataatgtattggaagttaaagtcctctgtgaagagagagtcaattttatttaagtatgtagcttctggtcagtggatccacacccatggatatatagacagcacaattgtagttcatagttcattgaattgaggaaaagagaaaggggaaaattacaaataattaatatatgtgcttattagaagcctgtaaccaaattagtaatgttagaagtaagggaaaggcatcatcaatccattatctgtttctgagttcaattatctatagaaaacttcttataatcctaagaagagcataattctttattcagaatattcagtctgtgcattttcatttgttgaaaataatattttatgcatttataaaatatgtgggttatagatgtataagaaaggtaactaaattgttaattattaaaaatgtgtcactcactgctgtgaaagacaattttttaacctcttttgatcacataattttacttgtaatatatatatatatatatatatatatatatatacatatatacatacatatatatgtgtgtgtatactaatgtatagctataattcttcattatgagagacatgtaaatctttaaaaacttgaagattaaatggattagaatttattttatttgttgaggaagcagagttctgactacctcatcagtatgtatataataatcttacctcaatatccatcataatttttctatgctattatgtgatagattttattatgtatcattattataattttattgaatcagtaacttgtttagctgctatttgtagcataatatccccccagaagagtatttatgaaataaatcaagtagaataataatagcatattttaaaataaaatttaaaattaaacttactttgacaatgggatacttcatgactttatatagattacagaacaaattactggagttttatatatatatatatatatatgtgtgtgtgtgtgtgtgtgtgtgtgtgtgtgtgtgtgtgtgtgtatgtatatatatatataactataattatttttcattcattcatataccaaatgaatcatgaccaaatatacataaatcacattctagtttacttttttttcctataaacttcctttccatatctgtggtgacttgaatatgcttgggtcaggcagttgcaataattgaaagtgtgtccttgttagcataggtgtggccattttggaggaagtctgccactgtaggtgtgtgctttgagaccctcctcatagctgtcttgaattccgtactctcctgtttgtcttctgaacaagatgtagaatgctcagctcctctagcaccttgcctgcctggatgataccatgcttttctgccttgatgataataaactgaacctctgaacttataagcaagagccagttaaatgtctattttaggatttgtcttggtcatggtgtctgttctcagcagtaaaaccccagctaagacaatatcacaactggttttgaagatttgaaactataataaaatgttttcttatgttctgactagtttcatatgatctagttaaaaagataaatgtactgtcaacatgatataaattacccagatactaagacttagctactgtttagcaaacatgtaagtctattaatttgtatgtatgtgtgtatatacagaatgacaaataatcaaaagtaaccacattgaattgatttttttctcaaatattgttttatcttttctttttagtaagtttttcttgtctgatctttaaaaggccacttacaatttctcacctttgtgtattttttatccagattgtctagtgttaataaaaagagaataacattataataagcaaaactattaccaaggacaacaaaagatgctgaatgcttcatttatgaaatacaaaaattagctgttgacattttcatcttttgacagtatctttagataactttataggattcagagtggtttttttttttttggccttttagtgaaaagaatttttcctgcttattgattttccaggtgcaagaatgatctcaagttcattaacattaatatgagacagagtggcttgctaaaaatcaaagcattattactttctgaaggcaggaaatttctttcagagtgaattgggagtgttaccacagcaaagggtttccaattaaacattattgtttaccaaatgctatcttttcatctactgtgataagctttggtaattgctaaaactgtaagaaattagctatgcagtgtacagagtctttgctttgccatctaagaactgagaaatgtgaactcgtatttaaatattgaaagaaaaagcttcacagtttggtacagaactgattttggaactcaaagctctgttttcttacattgatttcctctttaaattctgttaatactgatctgtactgtttagatatgtatgttcactaatagttcagtaaaataaggtttatggacataagagccataaataatatcaagaaggaaaagaggaaacaaaaatgaaatttgtagtttaacagtttcttttcctttctgctttgttggaatggggagtaagacagcttcccgaaaatgaaaacatggccaagaatcacgcggaaaattgaaagagttacacagagcctgtcagtgaggatgctaactgcagtggtcagaatccataaatgaaaggggaagcaggaaaatatcacccaattataaggaaattcatgcttttcaaagatttaacagacagcaaatcttggtatgtggcagtctcattcctttaatcccagcactcaggaggcagtggcaggtggatttctgagttcaaggtcagcctggtctaaaaagtgagttccaggacagccagggctacacagagaaaccctttctcaaaaaacaaaacaacaacaacaaaaccaaaacaaaacataacaaacaaacaaaaaagatgtcagggtccagatgtatgcctagaagtctgtgtggttaagcaaaacttaccagccacactagcaactacacaaggttactggtacattctgttggaaagaaacaaaatagtttgaaaattatcatagaatattatttgtgttctgttgtttacacatttattagtaaatccattattgaaggtagcaaaaaaatcacacgcagtgtcggacataattaatttttcatctggagaggagataatacataaaagttcatcataaaaattttcatttttaataagtgcctctaaaatgctgttccagagatccatcccatgatcagcttccaaacgctgacaccattgcatacactagcaagattttgctgaaaggacccagatatagctgtctcttgtgagactatgccagggcctagcaaacacagaagtggattctcacagtcagctattgaatggaccacagggcccccaatggaggaactagagaaagcacccaaggaactaaagagaactgcaaccctataggtggaacaacaatatgaactaagcagtaccccggacctcttgtctctgcatatgtatcaaaagatggcctagtcggccatcactgcaaagagaggcccattggacttgcaaactttatatgccccggtacaggggaacgccagggccaaaaagggggagtgggcgggtaggggagtgggggtgggtgggtatgggggacttttggtatagcattggaaatgtaaaggagctaaatacctaataaaaaatggaaaacaaaatgatgttctgtcattgattacatacaattttgtactagaatattacatactacttcataaaaaaacaagtgcccaagcagtgactctagatcttttgaataataaatgagaaagaaaatttgaagtacaggattgtagtggcagatacttcctcttcattggacagttcatttgaaatggatgcccatacatcccttaaaattaatgatgccacaatgctaattgcagcataaactaaatataaatttaagatttttcttcaattgtgtgaataaagaattgtttattttaaacattttaattcagcttttgttttgtggattatatttgactttgagttattagtaaggtaacctcagcaattgatagagcatttactgacaaagacatgtagttcttgaaatgacattttaaaaaattaaataatattgaagctatttgcagtagagacagatagcaggacaaaaattaaaagtttatatgttaagaatattatgctgagtttacaaaagctcagaattaaataggaaaatattttcagttaatcctagcagtcagaaggctgagggaggcagatctttgtgagtttgaggtcagcctcatctacacacagagttccagaacagccaagaaaaacactgactgtctctccctctgtctgtcattctgtcattctgtctttctgtctttctgtctttctttctttctttctttctttctttctttctttctttctttctttctttctttctctgtctctctgtctctgtatatatataaaacacacacacacacatatagtctgtaagagtttgagttgaacttaaggatcaccactgagtcttattcaaaggtattagggaattttattaaaaatatgaagtggtttattttcatataatatacacgcaacagcagtgcagaggctataatcaacataatcataaaacaaaatgcacattttattttattacacatgcttgaattttttcctcctcctcttcctcctcctcctcttcctcctcctcctcttcctcctcctcctcctcctcctcctcctcctcctcctcctcctcctcctcctcctcctcctcctcctcctcttcttcttcttcttcttcttcttcttcttcttcttcttcttcttcttcttcttcttcttcttcttcttcttcttcttcttctttggtttttgaaacagggtttctctgtgtagccctgtctgtcctggaactcactctgtagaccaggttggcctcaaactcagaaatccatctgctgcttctgcttaaaattttttaatgtgtaatcatcagttaatccctttatttcacctactttttggaatgttgtctagttggcaaaaaaaaaatcgcctaaaactctgttttacataggtgtattaatgataacttatagagtgtttttacaggccaattagatggcttagcagtttaatgagcctgtggtcaagcatggagacctgagttcatctgcaggggcttgtatgttagaagatgagaaacaacagctgaacagctcccccctcccttgcacacatacatactaactcctatgcaaacatacacagtcacacatgcacataaatgtgcataatatgtaataacatatttaaagttaaaatgtaacttataaatataagatataaaaatctgaaagctacccaaatatacagaatctggggttatttgccattttataagcattttcagtttatatttggctaagtttgtttatttcacttaaaagaaaattataaaataagttaggcttaaaaagttccagtgtagaggaggggaaatggttacaaattctcacctttaaccaagaagctagttgaaagtgataacttctggcagaggaaaaatccattttcttcaatgaagtgacactgggtatttaaaccacaatccagcacaggtgccatccgtgctcagaactagtcaaccaacacaaactggactatgttttctatttaagaaaaagaaagggcataagggtttgagctgtagagatgtaggaaagaatctagcagttcaggaaggaaaaagattatgacataaaagtattttatgaatttctcagagataaaaattaacttctttatgtctgtatcaaactgttaagcagatagttttttaaaaattaattaattttttttaccctatataccactcattgtcctcctactggtcactgattcctgcaaactttcccctattccccattcccttgtcctttgagcagtcagcatctgttaactcagacagatgcagatacccacagccacatagtgaatggagcttgggaactatggaagaataggaggaaggatttcagccttgaaggggatatgaactctacaggaagaccaagagtctactaacctggacctttgggggctctcagattctgaaccactaaacaaaaaacacacaggctggacccaggccttccagcacatgtgaagcagacagttttaagtgtctttgatacacccattctctctctctctctctctctctctctctctctctctctctctccctctcttttttttgatgtgttttagtacagcaacaggaagcaaactaggacatatatcaaacaaatgtatcatatatataataatatatattataatatacagcataatatataaacatgtataatatacttttgcttctttatataaactaaattaaaatgcaaatgtttgtttttcttaggacaaaagataaaagaacaacttttatacagaatatataattttggtaataagcttttgcgagctgacaaatattgttattattttttcattaaaaacctccaaaacctagtggggaaacattctgctgacaagtctccaatgaacaagagaaaaatttggggttttaactttggtaagaaaaaattattctaaactaaaatgttactttctcagataaaatgacaacaatcatagtatattataaatgatgattttatgtgctgggaaatatccaaaactgaagaaaatgtactattttagaactgatataacagaacaacatgtactgactgattcaaacaaatcagaaacaaatgtgtgtgtgtgtgtgtgtaaatataaacacgtagattctaggctaaatacccaacataaggttacctgtagggatatttcctcatgtatattaatgggaaaagagaatcttttttgatcccatttgtagcttctgacaggctagagaagaacattgccattctttttttttaaatatatttttttattacgtattttcctcatttacatttccaatgctatcccaaaagtcccccataccctcccccacacttccctacccacccattcccattttttggccctggctttcccctgtactggggcatataaagtttgtatatccaatgggcctctctttccagtgatgactgactaggccatcttttgatacatatgcagctagagtcaagagctccggggtactgtttagttcataatgttgttgcacctacagggttacagatctctagttccttggatactttctatagctcctccattgggggccctgtgatccatccaatagatgactgtgagcatccacttatgtgtttgctaggccgagagacaaagtttggagctgagacaaaaggatggaccatctagagactgccatatccagggatccatcccataattagcctccaaatgatgacaccattgcatacactagcaagcgtttgctgaaaggaccctgatatagctgtctcttgtgagaacattgccattcttttgctagcagaaacatcactcttagctctacatcatctttacctacctctccctgtgtatacatctacctctgaatttcctcttttaaacaaagactcaaattatataacttatcttctagtaaaatcattatcacttgactcttataaagatcttatctatcactaagatctcattctttgatcctatgcattaagatttcaaaatatgaattctcatatgacagttcaacctgtaacattagatcaccaattaaaggcgaatcagcattccaaaaataaccaatctcaaaacagcagtaaagagattgcctggatatattttattaagagaaatgattatttagaagtagacttctgaaactgttatcatttttatttctgagaatgatgattaattgatttatgtgacacatgttctatgcatggatatcactgtctgtgtcactcggctttgtaagtggcagctgcaaagatgttttcgaactgccatcaatatagtacagaagacaattttctaaacttgaaactttgaagttttaattgaaatttaactatatacagcagttttaatgactttggggtttaatgcaggagatcaaagacccccactacctacagctatctcaaatggctttacttagcatacatgctgctaaagagaaaattattggcaggatgtcaagtgacaaagaactaattcgctaaattatattttctatttgttcttttttctttagttttatatttgaacagtatgtgctcctgactagataactgaaattagggaaaccgctatcatgttcttaattgtatttaaagttgtattctgataatattttgttgaaagttacggaacagactccgtagcgtttgctcttcaacctgaagaataagccttgaatgtgattataattcccacgtgaaatccttctaatattttcattcctgccgctatggagtctttggagatgtatttcacctctcaggcagtgatggagctcttaatatttccttccatagctaaagccgagcgagatgaggtgcagtaagccaggctgcctggggaaatagcatcataaaacatgggagcccaactcctgttctagtctgtggtattttgaaagactctattattacagtacaagagagttgtacttaacacaatattgaaattcactgacacaaaggcaatactgcaggaaacggctgactgggggataggtggcttttcactttgtatttctgtctttcccattcttaagtatcatgtgtttttctttattaatcttcccacaaatgctttgaatgacagaacaattagaaagaaaccagactgcagtatctatatctgtcactttaactgcgtccttgcagacacaaattccctgctgattttgctgcaatgtttgatatgagaagcaaactaaacttaacctagcttatttttcttcagggtagcaatgcattgtaaggaatgctctctccatcgtgtgaaagctgcatttccccttcctagaatatgacagattgttgatggataaaacctacttagtttgctatagaaagttttcactggaaaaataaatcttacagaactacagacacaggtaaatattgcctagacagtgggctgagtgtatgggctaaggggtctcctcataacttcagaggaactgaagaacagctttaaagggccagtactctccctggtacaaggatcactttaatctgtaaaggcactggatttattgactcttagtgacaaggtttatcggcttctgtaaccttctagtagcccaccatatccaagtgaagtatattttaaataaatataaataattctcaatctataagaaaacatggttttcttgtcaatataaacccagaaatatatggtctcaggaaataccataaggtaaaattgtaattaaccagcaagagctatcacacatacttaggaaatttattgccttcacttaagtgcaagcatgtcctttccttttttcactataagtttgttggtgcaaagaggaaggtgagccctttatgacataatatagaattgtgggtataaaacatcatgcatcaaagtgaccaatgaatgtttttgacccaacccattggatgccctcagataaagagatttctccagttatgtaattaagaaagtaacagcagtccacagttatgcataactgatatgccatcaaccactttatcctttagttgaaagtatttgttgctttcatttctctcaggttctttgaattgaatgggttcatatgttatagccttgatcaatatttcctatctcattttacaaaatggcaaatagaatttccaagcactttgctgtgctgcagagagcccagccatcagctgcagcaaggacatttgcattcagttaattggtacagatggtcgcagcactgatttccttgtttcattcagcagagatctggagactggggctggaacacagatgtcagaacagaacttttttggtgtttgctggtagcgctttcaaatatcatattctctcctcccccgcctctctcttctcctgtcatattctaataaatccttctgaattaaaaatataaggcttagaacactgtatattaagcgatatttcaaacatgcagtggtttctgtattgctgtacttcaatttaaaatattggaattaagatacagtaaataaagcaattatgaattaataacacttttagtgttagttaaagatccatatttaaaagaagatgactacaaattattgcaacaacatacaataatttggagattagacatatacatttataatgttgaaatcacccaaaaagtactcagcatgtaagtgttttgaggaataaatctggaaagaagatggagtagaacgaagagaggaaggagagaggagatggagagagtggggccagaagaaagaaagaagagtaagagcgagagagtgagaaagatagcaagggagtgagagagcacagaatgaaagagcactaattagagagagagacacacacaaaaaacacagacacacccagacatgcacagacacacacatacacacacacatacacacacacacacacacacatacacatacatagagagagagagagagagagagagagagagagagagagagagagagagagagagagagagataatgccctgaagtttcatggcttcagaatggatattctaactatatagaaagaagttcatgaagatatttaggactgggcaagtgtcttaatttacattaaatcgcatatatggcatttctgtttgtgagtttatttcaataaaatggtctttatattaaaaaataggaacagacatgtcactttattattttggcctagagtaaaatacagactcctgagaaacatatgtgtttgcctaaggaatggggaagagagagtgggatgctggtgacaggagaaactagaaatcccaatgtggtttttgggtatgaagagaagcagaatgatcatcagagaagcaaggaattcgtcccacaggaatcccagtgcaaaggtagattagcacgagattcaaggctagaaagctccactccagagactcgaatgcgtttctgatgccattagtgagtcatcaagtttatgcaaggaactgaaatagatacaaaggaaatgggagaatggggaggaagagaaggggaaagactgcataaaactatgttgcatagtttcatttctcctgtatttggatcaaacatctgaaagagtgtttatcaaaattttcacctaaagccctagaaggctttaggttttgctgacaacagtcttcattatagcttcttacctcaatattgagacaggaagtcagctgaagccacaagaaagagaataaacaggaatggcgatattcagtaataaaattatagtaaacattaaacatttaatatctgggaatgttcacttaatcataaatgattttccttctttttttaactacttaaacatttcagaatcctttactgcatgtgctgtgtgccagcagactgttctagctaatgccatgcttttgtttgtgttgaagatgctttggctctgagtcattttctaccagtatcgtgtgaaagagtaaagcccttgctaaaaatgctctgctagacaaatcagagaattcaacactgctccatgtccataaccagggacctccatctccagcgactggagaggagaggactgcaataaagaaatggataggagagctgcacctgtcagagtcatggacacaaacatactcaggcaagtattaagtgtaaccgctggaaatacagctaggtgagaagagagcaaccaccaccccaaggcgaatacaagctagagtcatccagcattcccactgagaacttcagacatggaaatattgtgcggagacatgataacccatcatcccatggagaacaatgtggtatggtggggaaagaggcaaagtactagaagtggcaacccaaataaggactgtaaatctgctacagaaagttgccattttttgtagggaattaagttattttgaactacatgtcttcttgtagagtgatctgtagaatataatgtgtgaagagaaatattttcattgcggcaaaccagaagtactcttccattgatggtatcaattttctattctatttatcttgtacttgaatttttctttgtttctaggtttgtatttcaatgctttgttttgttttagctttgccttgctgaaataggctttactagattcttttttctgcacctacttcaagctgtaccctctgctacttccaatgcctctgtggtcattaaataatcaattaattgattaatagcctctgcaactgcaagcaattgtatgtaccacaggtatgcaggagcaggctggggtcagaagacagtgtcagacttcctggagctggagttatgattcctgtgagacaccctatttgtgctgagaactgacattgggtcctctgctagagcatgaagtattcctagctacagagtcatctctcccacctcattagcttaaagaacagctttaaaggcatctagtctaactaacacagttcctctaattccaaaccaaccttgagtttaagtgaaatacaaacatgcattttactgcattttgatagcaggattgtcacatcagttttctcttattgttccccgatccctgtctctaaatattagtggtaatcataagcccaagtaacagttacaaacaaagaagagccacataaggtaaggcaagcagtaacaaaagtgggaaatgaaagccagaaagcacaactaacccaacagatacataaaaataccagagaaacaaacagaacatattagaaaataagctcttatgagacctcttcaataaccaaagacaaaactaatcaaatagctgaagtgccacagaaaacttctaaaatcccacatagaggactcaacagcaattgaatgtaggaagggaagcgaataagaacaagacacttaaaaaaaaatctgaagatgtcagaaggaaattcactgaatatgctaactaaagacattggcaaaataatttaaaaaatgcatctttactattctataataaacttataatacttaaagtctttgatttaaataatttggagaaatttcaataattatttttaagtttatttttatgatgaatgtagtctatatacaaacaattgattaaaaatgatcactagaagttattagaagcaatctgtagtaatggataccataaaatgcttacttaaacacacttgccttttattttatcataaattataataacttttgaagtcaagtataataaaaaattaaaatcttctgtgattaataatgtgattatagttaattaggtcatcatctcctaacatgtttagttgaggacagaccttccttcaatgaatgtaggtagcactgtcccatagaatggggttcaaatgggaatgcaaagaggaaaaaatccagaaaatcccaaagaacaaacaagtaaaacactaatatatttcctccctctccctcctaccccctctcactctgttcatccctttactctttctttgttagagtgagatcagtagctaggaacatatacctacttcatatctcatccagaaacaactgagtaaagatagaggactgaaaatttttaagaaagcatttgtcactaagaaagaaagtctgactgatataatatcctttataaaagtacatataatatatggaatgatatgtaaaataaaatggtctggaaagaggtggtataatggcagacttaaccctaatttttagttacagatcaatgaccagaaaggacacgtcaaactatcatgtaaaccacaatcccataatatcgttgcatttaaaaatagaaaataaaactgggccgggagagatgtctcagtagttaagggttcttattgttcttgcaaatgagcttagttctgttcacagcaccaatgtcaagcagctcaaaacaacctgtaatttcaggtaggtgggattttacatatttggcttctgagaataccgtcacttaagttcacatgctgacatccagacacacaaatgcatacacataattaaaactgaaaagtaaatcttaaaccaaaagcagagaaaaacactcagggcagggtgaggggagggtatatggaactttcagaatagcatttgaaatgtaaataaagaaaatacctaacaaaataaaaaaataaagacattttcatacaagtaaaaaaaaaaaaaaaaacaaaaaacaaaaaactgtaacacaagaaatgctaagcaatgcttcaactccaggttcaatagtggtactctacccagagtatgtcattggtttcctttgcagtctagctttcatagaattatgaataactcataagagcagagatgggtcacacattttactgttatttaataagttcagcattcgtgtctagatgcaaagctaaaactgtgttaagatcacttattgattggaaagtataacaaggatgaaaatgaacttgtaagggtaacactgtgacaaaattactaaaaaaaccagagaattattagatgctcgtatatcccccaaacaatacataactctttgaagatcacattatgtaattcccatatggtgaaaatgtagtagtcagtcatgccatccctatcagaaagacagagaagatttttattttaaataccttgatcgataccagccgtggagagtccttaagcctggatagaaacagttttcgcaatgacattttcaagtatct

SEQ ID NO: 307 - DNA, 14353 bp, Mus musculus
gtaatgtagttattgtttggagatgatcttatacagatttgtgtcagtcaatataaaagaatgctatgatgtatgtacgtacataaatgaattatgtcattagcgtgtctactctcttggaagcacttttctagactcttctagaaaaaaaaaaaaaaagaggaaaagctcctctagacgccgtgagagagcaaatctccagaacatctgcttaaaggtgggaacctgatgcgaggaggaacggtttagctgcaccagcacaccggacattcacctctcctaaatgtggaaatgagaaggtcccgagactttgctattgtgcaaaacaagctcacccaggtaacgttgactttcttcccaacctgtttatgtacggtatatttagtctcagggatcccccccaccaccaccaccttcagccttgtatagcgcatgctcatgtgacattaatgctacaaataaaaccgtacagttagagatcctgacctttctccatgaactttaccatgtctctaaagctaggtggagcaagtgtcaggttttaagcaagatttccttttgaaggcagtttcccctggggtgttgggggttggaaaattagccatcaaactgagatctctcccttgtggtcagggtggaatgaggggctttttgttgtcacctctaaagaatggaactgagtggggtggccctcggacttactatgtaacctacgctgacttggaacgtgtcatctgtgatcttcctgcctccatctgcagggtgccacaatggttgtgctagaacaagaactggtataatcttgggataacagatccacgcagaagtcaatcaagcagggttggtatcagtctctgtctgacgaattcctttctagaatgttgctcatatacttcagacataggcccaaacatctgccaaactgctttttctctctaaatgacaaaaatagaaaagaaaatgacaattgtcatcagcccactttttaacccttatctatgtagtccctagcaaccacagtttgcactctggaatgtgttgcaatgattgtgatatctttgaagaaactaaatcgctaatcttatccagaaagatgggcaattctttgatgttagaaagcattcaaactgctaggcctggtggtacatgcttgtagcccaggcacttggggagctgacaaaaaagaattgctttgtgtttgaaacaaggcaactttctgaacttgtttcaaaaaataaaatgaaataaatattaaatggccagtgaggtagctcagcaagtaagggtgcttgctgctgggtctgaagaccggagtctgatcctagtgagccacacggtagaagaaaactaactctcaaaagttgtctctgacctctacacatgtacatgttacatagtatgtacacacacacacagaaaacacaaaacacacacactaaaaaaattgaaaattaaaccaaatgtatcatgttccactaaaagcacctagtgccagatgcttggagtatatgcatttcagagtggcagtacctactgaatgctagttaataatgacgactgctgactactgtgtagagtgtgtttaaacttctagatacattacattattttgtttaatccttgcaaatgtgaagtggtaatctgaaggcattatgctttatttcatagataaatatgctatgggtttcctataatggacacttaggataaataaaaatgagctatggtgcttagtagagtatgtcatataggaaatgctcaataaattcattaattcattaagtattaatgtgtcaatgcctcaatggtgtcttccaaatgagctttcttcttccatcatatttagttgcttatgaaacaaagagcacattttgagaaataccgactaaaagtcttccttcccagttcttaatttgacagacatgttgttctgaaagtaagccatgagaagcaggtgcagtagagtgggaagacagagctttgaatcctacacagacctcctactcgtgtgccctaaccagcagctggcagctggatgcaggagagtggggaagagctcctcttaaagagctagacagggtgctagagccatacagttattagtaatagatttatctttatttatttattacttcaattagggctgagggcagggttctagcacccacatagagcctgaggatgtggagcttgaaacacgtgattccagacagcaaggtgtccggagttcatgaaatgtgccagacctgacccaaggcacaccaaggctactagggtattctctgatctagacttggttcaatgtccactgaacctggaggtctaaactaggagaaaacaagagagagagagagagagagagagagagagagagagagagagagagagagaggaagaagaagaagaaggagggaggaagggagggagggagggagggagggagggagggagggagggagggagggaaggaaggaaggaaggaaggaaggaaggaaggaaggaaggaaggaaggaagagagaaagttcttaagttgatgccagcatatactccggatcttgcttaagttgtattgtagattgaatagcataaccccaaattcatggtcactcagaacttacttgaaaatagggtctttagtgatataattaagatgttcttattagataaggacaagccctaatcctacacgcctggtatccttacaagaaaagaagaaaccacagctatacacatacagaaatctatgtgattgaaatgaaagggtgtgggtaccgaggaccactggagccaccagtagccaggaggccatggaggattcttcctgagagcctcagccgctgtctgactccagccaatgccgagatctgaggagatacatttctgttgcttaagccaccctcgacatcgttacttgtgtagagcaatctttagaccatagtgcaagtggagaaatttgaattcattagcttgccatcagaggacccccaggatcatggactaggttattttacttctcccagctcccagtcctgtcttctacgccaaagcaacctgaaggggttcacaaagcgctcatcccttttctggggcctcaacttgcttccattgcctgcccattcactcactcacaatccctgccctcatgaactgaaagcaggaagcgcacccacctaccacactcacccatcacacagagcccaccccaatctctcaaatcagacaagatcttatgttccctactaaccccacagtttttttttttccttcatattccctgattgccactttctgctttgaattagttgtctgtatctgtggcttcatctcccagtcagacaaggaacccttgggaatgtgaacaagcctcagacatttttgtactggccgcagtacctgggcacagtgccttcaatgaagcagttacccaataaatgcctgaggtagttatcaccgtctactctgtggtcttgactgttctattgagaatgaataaaaatagtcatagcaggatgcttcttcgtatatgtgtgcaagtttaatcatgaacaatgacaaacttgaagaaagtagaacattcatctgcatgatgatatgttcctgtaatgtgtgtatgtgcttaaactgatagaaaaaatagatagccccaaataagcctgcacttcactaaaaggtaataataaagccacagttaataacagttttctgaaattcttaaagaagtggaaggattgggggtggaaaaaaaaagtctaaagacagcaattttaggctcaggggcctgtttccctccctcagtggaaatggaaatttgtctctactatctcctcttgagagtcatttgtttcctgattctaatggttccctgcagagacctaggaatgggatgacctagggggttggtggctgcccttcttccaggtcctacattcaccccatggcagacatcttccttctgccaacactcccttgacagttcatgcaatgttacctcgctactttcagtgaagagaaacaccaaagccaaggcagcttgtgagaggtggagaggagctacctgtgctggcctggctaatcatgagcgtgaacagctgtctcacctcattcaagaagagtaccgtgcttggctgtgcaggactgatttttgttctgtcatgaaaacatttggttcttgcccgatgttctgtcaagattcccaaaggcttttgcccttgggaaggacactggatgtccttgaaagccattacccacagcatcattaacagaggctctgaaaggggaggctcaacactgctgttggagaaagcccaggctgtggcaactttaacaggcagagttctgtgagtttgaggctagcctggtctacagagtgagttccagaacagccatgagaaaaacagagacaccctgtcgaagaagaacagacaaccaaataaaatcaaaaagtccctatgggtgctcatgctatacaaagccacattcgacatcaagttgggaggacctgagacagcagaccctggcaaccgtggaggaccgtgaaagaagagtgagatgccagtcatttcttcagagtagggaaacttggtctgtctaataaggccaggagtcaaagctgaaatggaaacacatttgaatgagataacccaaagtataggtctaattaagttaagtaaatcaaatcccatgcactttcactctgaagctctaagcccattaaatctaattacattccccggggggatgcggctgtaaatggatgttagcaatgatcactttgaattcctgctccttgcccccctctgaaagcttccacggcagtgggcgactgcagcctccctttctgcgagacaaggtcaaggggaagacactccgaggagcccatccatttaagtaagtgccttctgaaatccagagttccttttgttcttgttgccttcttgtccttctctctaacaaaacgatgcacatatgtttatgggtcagactttccaaggggtcaccaacctattttcattaactctttacctcctagacagcaggactcaacaactggatgcagagctcattacagagttggatggggcagtcactaggccagaggccatcctactgcccttcccagatggctgtggggcaggtggtctgtgtacttccactctggatgaatcagatggactcattaactgagatagagactgtcctcaaacgccaaggcagtcttgtcatcactgcccatccttgctcccctgaacattattaaccttgcttattaaaggagataaacaaccctgggcagatggagcatcacagcttcggctgcatctggagcacaggtttgctccagactgaagcccctgagaccaatgagatggaaccgaacagcagaagcaaccttgctgattttgttacatattggattttaagacttagattccataaagctttgaagttagaaattttgtgacaagtggagaaaatatattctacttgtgtttgcttttgaatctattaaactgtgagtcagggcttattactgctatttcaccaatgtgtgatggaaaaattttctttcttttggggacacattgaatcctagaattccagttgtgatattaaattgcataagtgtagtcaaattcccagaatttctcaattccaaagtaatgtctaaggttggggatgtagttcagtgatacagtgtcgacataacacatctattgtatcaacaccactaccaataacagtaattaataataatgatgataaatatcatagtaatcctttcatagactattcaactttagccaaatagttttggcacttggtggctatggtacttgctataatgtagctgaatgttgtaaacttgctatagtgacactcacctgtgggatcccagcacggccctgcgctccagaccagccatgtgctgcacaaggaagagcctatctcaaaagcagtaacaacaatcaaacagttaccagcagcaaggtatcttggcttaactttggcgctaacttaaagtaatctaggaactttaaaactatgatactaagcccatcccctaggccagagttactggcagttggtgtctgctgagagaaggggaattgctttctttggggatgtggttggttgcctatggaccagaggctggcctcacccccatgctcagcactaaaaagtggtgctagtacctacaacaagagcagtgagaggacattaggttcagaggagaatggctggtggctcccacacacgcaccatacccaaggtgcaagagctctccctccagaccacaccagaagcacctgttgagatctgatcctctttttaaaggaggtacttctgaggtgtgctgtggttttcagacctttctttaggaaacacaaatagggatttgtaatacttgaagcataaggacaatgactatcatctcagctgcctttgaaaagtgaacagggatcttttagttatggctttattattaaccatttgtaaccaaatgcaatgatttctccttctcttcttcttcttcctctccctctccctcttcttcctcaccctctttctcctcctcctcctacctcccctcctttttttgttgttttcttgaaacagggtttctctgtgtagccctggctgtcctggaactcactctgtagaccaggctggcctcgaactcagaaatctgcctgcctctgcctcctgagtgctgggattaaaggtatgtgccaccactgcccagcaagggctcttaatcttatgaatgcaaagccgaaactaagagataaaagagtagaggaagacttacaaactgcattaggcaaagggaatattgagataatttgcaagcaatgcttttcccatcaagaggaaaccttaggattttgtgtaggaatcctgaatatagttatacaagaaagtacaaagcaaagtacaaagcaagctcaactcaaggtcacccagagatcatgtattcagaacagaaagatgtcagcaaattttgaggcttaaaattgaacatcacatggctataaaagaaagatggtggaaaatgtgcttctgggcatgctcagttcaaggtcatagagaacaaggggggaaaaaaggtagatgttaacacttctgggcatgctctgttcagcatgctaatgagcaagtttactttagtttgcctaaaaggatgagtaaaaactagactagtttctaataaagtgtctcaaagcattttagctgaagccaaagaaaagccagctttgaagatgtctaagcaattttttaaaggggtggcctttttcttttgctttttatttttgcctttctagcattattctctcctaaaagtgcttcccttgcttaggagccaacaaaccagaaatgcctacaaaactcccacccccagccttacaacctcctgtttgtgaaactcaacttcccccagacccctagtaaagcactctgtctcaattctcagcttatctgagaagttatcacaacatgcaattttcttagagtttttgatctctttgaacaacatatggattataagcacattatttagacagtttgtactttgtgcttaaaaacccattactacatataaaccagactaacttaatgaggttgattaaaaacacacaagacacacaaacagacacacacataatcatggttgacttcaaatgttggttttatataatacaaaccagtgcagttttggatagcattaaaaaacatgtagattgataatcaagacatttcaacaggtctctgagaagcatctctagactgaaagttcctgaccagattatagaataggccagagtgtggccgagcctccagtggtaaagatgttctcataggaagctgttgtttgtgaggtagccaagagataaatgaatgctaagagcatctcagagataaagaaggccattctcctacacctgaagaggcagcccagactcagtgcaagtcctaagggtcactctcaggacaggtagaggactgtcctttattacatccttcaagagatggttccagaaaggaagatctgtgacgatggagttagagacagagatgcagatgtaacaaagaagaaagaagggagatcaatgaagccaggcagagagaaaggagaggggtggagagagaaaaacaggtattgagctcttcctactcaaactgttccaagtcaggaacctgagagaaggaagagaaggtcaaagaagctgcccaccgtcctgctgagctgaaatcctaagaaggtagacaagtggaccccacagtttcttctagagctgaactagcctctgctttggaacggagaaaaagacagcccggagtagtagtgcatattttctctgtattctactgtacccggctactgaatctgtaattatacctagggcacaaataaatggggagaatttaaaaatagtgacaggttagattattaaatctgcagattggtaggatctggcagctattaatttaacaaaacaaaagaaaaggaaacaaaaagtctccttaccacttcctgataatttagcacgaaggagcagatgtcaaaacaggagggggatgcttaggtcaccccaatcctcaccaagacaattaattgacactggctctgacttctcttgtgctgagtgttttagacaagaattgaaagccaacagaccttgctcatttggcctaagccagctcttcatgccactgattcaaggcagttgcttttgctttggtttgatgtagcaggtctttgtagatatcaaacataaccaagtcgggagacttttcctgtgggcctggagtccactctgcactctgaaacgaccaatgccaactacaccacgctagcctactcctcacggacccccaccttctcctctgagtcatcacacagttcccagcctgccgtttgttatcagttgagtcatttgggatggatgttgacaattcgcaatgccttaagcggagataagtgatgagcagcgaccaagtgcagactccaaaggagcagaacaaagaaacctttgtgtggtgtgcacattttctctagtaaactgcgtacttgtgattaacactgctctgtagtcaaactttgaggagacgtcaagattataacgtttgcaccacacgctgaaaatttgttttcttttttattactgtatattggttaaatgaaacaatgaatgttcagtatggtattttcttcatctctatttttcttaattgtttgagaatttcacacagtgtattttaaccatgttctcatccagctcctccccttagccccacccacatccacccctatatccttaccctatacactcaacttcatgtgtcctttaaaaaacttttcagtaacccatcaactccagtttgtgtgctctttgtgttcttctggatatgggactgcttactagagcatggtgaagccccaagagtcacagccttcactagctgcactaatgaagcttcaggacactggcctggtgagctaccgtgtcaagacattttcacacatgcacactacatcctatggctgtattcatccaatcattactatccttcccccttcttccctccctcacatcaccttcctttcccttttccttttccttttccttttccttttccttttccttttcctttccctttccctttccctttccctttccctttccctttccctttccccttttctttttctttcctttccctaatagtactcctttctgcatctgtactatttttatgtctatacatacaacctgaacttgctctgaattcctcaccctcctgcctcagcctcctgagtacccggactacaggcattctctaccaagctcagccatgtcttgaatgtctggctgccatacctgaggaacattgtctgtactccacaggccccaggtttgaagatctttgttagggcagctagtgtattcgagtacacggatgtggcagtagcttggagaagaatgtcttgtggtcaaggcttgacacaaaagtgaggaaaaggtttactaggaaaaaaatcaaatcaagctcagtgtggtggtgcaaggctttaaccccagcactcgggatatctggacaagtgaatctctgaattcaagaccagcctggtctataaagtgagttctaggacaatcagttctacacagagaaaccttgtcaaaacaaaacaaaacaaacaaaaaacaagaaaagaaaagaaaaaagaaagaaaagaaaggaaagaaaaagagcaaattgtataaacttccttccaactgatattttagcattctgaaatattaaaatataagttttgtttttatttattgtatatgtgtttctgtgtgtatgtgtgtgttacatgctcgtgtatgtgtgcaggtagctcacttgtgtgtgtacaccaagcatcaacaaccaatagcttcctttatttctttctatttaacttttttgaaacagagtctctccctaaacctggagctgttttggctaggctgtttggctaatgagttcctctgggactgatctctggaagtttgaggccagcctgggtctcaaaaccaaaaccaaataaacgacaacaacagaacctgagtgaaatataaatacataactattaaccagaaaaaaatgtagataatggggataaagagatggctcagtggtttagaacacttgtcactcatgggaaggaccagagttcgagtcccagcacctacatgatggctcacaaccatccctaactctagttccggggttcagactttctcttctcaacctccatggacacaagacacacataaggtacatatacgtgtatcatgcatatgaaacattcattcatataaagtaaggcggaagtctaaaaacatctttttttaatttcaaatgaagatagaatatactccccagctctactaaacactaagctcagagaataagagcaagactgcagccacagaggccaggccctcaggactctgggtctaatgattcctaactctctcccactctttcaggacacttcatccctctggttgccggtcagtctgtctcctcataatttttgggcaacctagcccagataaaggaactacttccagtcatcttgcttatgaaattgaaagtggctctaactctaggggatgggtatcctaaagataaccagagtgacatacgggggtggggagaagacttgttggggcctctgattccccagagctaaggacagatcacacgcacacgcacacaaacacacacacacatctgatccccaaagctaaggacggatcacacccactgagacctgccctggagcatttctttcattatcaaaggatgcagaaacggggtcagaattcaccgactaagcttttattgacttctctacaccagcggaggtaatttccatagttatttgctgtttatttccagtggttataaaaccatgttccatttttttttgtgtgtatttatgatcacattttatctttaaaaataaaaataagctcaacattttgttcttaactagcgtgtgattattctcaatagatcaataaaaattgacttagccatatagctagccatggaagctaatataaaaaaaaataaaaaaataaaggtgtttggaaggttggctcattggttaacagcacttattgctcttgtagagggcctgagttcagttctcagcaaccacatggcagctcacaactgtctgtaactccagttccaggggatctgatgccctcttctgatctccacaggcaccaagcattcatgtggtatatatacaaacatacaggcaaaacactcagacacataaagtaaaatagtctaaaagaaaaatttcaaggataaggaatggtctctgccacagaaagtgtcttcatactaactgagcaggtaaaaaccaaggtttttgtcctcttgtctaaacctacattaagccccacctacaagtacttgccaataggtacaaggaaaccagaaagaactcggcttgacttcgacaccagtaaaggcgttgtcaaggatatcagatttgagctgcttaaaaggactggctgaagggccaagactgggtgctgtggtgtgaagacctcaggaccaagaatcaagggcaggggcagggtagtacgtctgtgttgggagagtaaatatgactgccatcttgacaggagaaggttccagatctacatataggtaataaggagcagtggcccacaggcattcattttttatgtatttatttatgttggctgctttaaataaagtctcatccaacccaggttgttatataactaatgatgaccttgaacttgtccctccttcttctgcttcaaacgttggggtaccaggtgtagggggggtggcactgtgtgaccatggtgttctggatgctttgggtagtacttacagccacgaatggtgataacttcctgtcctccagcacttgggaggtagaaggagaaggatcaaaagcccaaggttagcctagcctgctttgtgagtttgataccagtctagcctatttactaccttctctcaaaatccaaacaacaacaacaacaaccaactgaaaaagtaaaaatacttcttagggctagcaagggatctgttggcatggtttcgtaatagttaaagtatggcgatagggatcaccaggctagcatggcaggtgtgaggatggctaaattgctgataaagtggacggaagcagtgtgccaaagaccagagtcatttatttctggggttaagcagagagtgtgtagtatactgtttacatggctggcgaagcccaagcaagatcagagatggtggaagtggaggtttggggaggaagactgagatcaaatagatctcaaacagaaagtcagcaagcctggagtccctcaaaaagtcaagtttgaaagcatgtatttcaaaaccagaagcatataaatatagcttagagccacgagtcatataggattacatgaacagtgagtttagactgaaaacagcattgattaaagccggctgctgagaaagtcaactcacatatgcaagagtggagcccctgaaatggctcagtgaaaggaagcgcttgtggctgagcctgacctcctaaggtccagccctgggatccacatgatgggaagaaagaaccactttccccaagtcctctgatcttctcacaaaacccataagtgagtgcacgcacatatgcacgcgtatactaaataaataatgctattttttctttttcttttttttcttttagaaaggagtatagaaagaaaagagaatagattgaccaggaaggatgagggaaacaggagtgtggactttctgaagccgtaataaataaaatatattcaagaaagcaagagtcagccactaagtccattgagagagtgaataaggagaggtgagcctggccaggagtttgctggcaacaacagaatgaacgggagggaaagggcctgatcagagtggcgtgagatgatacactggcacatgcccgtagtgccatcccttgagaggtgggggcagggaggatgaggaattcaaggacattctgtgcgagagtgagacccttatctcaagaaaaatatcaaccgatgaagcgtggcacggcgtcctgaccctaaaggaagggtgattgtgaggacagcctgggctgcctgacaccaaaggtagggtaataatgagtgcttgttttgggtctccattcttgttgactctcaggccatggagtaccatgaagtgaacccagagagatgacgttaaattcctgcatgattatccgaaggtggattcaccgtaaagaatgtgttaagcacaccaggtctaaagatgaataggatcaccaccaaggtcatcatagacactacctattttcaccataaaaattaaatattaaaactgctcaccaaaaggatggagtatgtggcacagtctcgatctgattttgtagatcctgtaaaagaaatggagacattagaagaattgtcatgaatatacagacaggtattgtttgtggttaggaaacacatgagagtcctttattcttatcatagctgggggagccttacctgccctgtctggcatgccagcaattcacgaggaggcctgggaggccttactcattgtttgtcccttttaaaagcctgatatagctctttttgtttggcgtgaccaatcattctattctgtggctgcacttcgctgctcggctatttaaaaatctcttaaataaccaaaccgtagcctttttctatttaacggtcaagatcaattaaatgtccttcagagttacttccagagacttgggagaagcctgtggtctttaccagttt

SEQ ID NO: 308 - DNA, 10664 bp, Mus musculus
tggagtgcctggtggcaaagatgggggggggctgtgcgccccaacaggcccactaaatcctgggtgtctatccctaaaaatcgaggtcccatgtcatgtttccggggtgccctgtgcttgtgcaacatgggcgcgtggtgcgaaccaacgtgcgtggcaccctaggcctcagtggtagtggcaggacctgtgctcagttagagggttacaaggtaggcgcatcccggccgactgagttaaggcgcaggtagctgggtagagggttctcacagggacctacttgctaagcaggggacagtcccctggatcggctgggggggggggggggagcgcgcagcctccacctgcctgagcaggcagggcgggctgtgaggcacctcgaatagcagccagatagatcttactaagcgcccctaacctctgctttgcctgggatctcctagcagcctttggggggccaccaggtgcaccatgaagggaaggctggcttggccacgccaaatctgggccccgcgtggagcccccgcacaatgtctgcgcccttcagcagaaaaagaagcagggcgggaaacgtagctcaaaccagacctgtaaaccagagctcactgaagtgcttctaagcggcgcgcctttgggaccccacccagtatgagcagataacagttccctgtcctcagcactttgaatttgcttagttgcaggttcggccccaggggccaatgcgataattccgggctattaagaaactctccccgggtggtttcagatataagaagccattgtgatttttaccaagtcaaaatcacttctaaaccggtgcaccttgtttccctctcccgacctccgcacctctaggcctctaaagggccactactggcggaaaccagtgcacccggggctaacctcccggcccgaccatcaatcaccgcgcccgcgctctacactcgcttccccaagccctcgacctgtagggttggaggctccaagccgcccgagcgctctgcccttcccgcttcctggccgcccaggcgctttccctaccaccgcgttgtttgcagagtgcacacaaagtggcgcgcgtttcggagcgcccagcccaaaggagcgctgccgccgagggagaagccagcagcccgctcccgcgctactccgcagcagccctgaggacaaactgcgaggtagccggtgccccgcagtggaagagctggggcacgagggagcgcgccacggggagctcaccacaaggccgaaggtcgggtccgctggcgcaggaggatcggaggagaagggcgggagagcggatgaagtgggagctgctgaagtggacgctgctgaaggtgagcgagaccccaagggcagtccccagtgaaccggggcaacgcccagtccgttggaagacccggggacaatgcccaaatttgggggaaactgggggcaatgcccagtcgttttcctggacacgggagcaacactgcccacgtcctggccgccgcgcagtgtccagtgcgtgtttggggcacacacacttttccaaaatctgtgctgccgctgggacaccgtaggagaagtgacgaggccgataccactgttatgcgcaggacgggaagctgccgaaagtggccagcggaaacaatgatcaaatttcggggatcccaagtcagacccttgtctgatttgcggtcctgggaatgagcggcccaaagtagggggactcgaaggcgactccataaatgggaaaactgtggcgaatgactaaatttgagattccagaaaaattagaatccaagttggggaatgaggaaaattattctatgcaaaaatggggggcatcttgatccaggcctaacgaggggaacccaatatcttggttagaaagcttggggaacccacaaaatcctagactaatttgtagaagttaggtggtttgttgttgctgttgggtttaagaaaattcccaacatgaaatttaggggagcttaattttaattgcttaaaaatgggagatgaaaaacaacagatggattttagggaattcaggtcagttcttttgaggggtgggagtggagactagggttcaccctgaagccagtgggccctacaacacccgggaaaaatcacctctaatttctgtggcttcagagaagtcctctagagaatgaggaaatgctgtctaaatgtggtggaattagaaatgcaagaagtccatttgagaaagccagaaaaaatcaatgtcttttaatattttaatttcctaaacagattcctattgatctttttgttgaacaagggggagtttgtatgttttcttggacaatgtttgttcttggagaaacatactccctgttttgtggatcaataaaaattacccaatggatgatgaaatctaaattgcagggaatagaattagtagctaggaaatttgtaagacacagacctttaaaacctaggaattgggggatctgggactttttttttcagtgtgctttggggaccataaaacattatccaaatatagggagactccagtagaagtcataaattcaacaaagttcattaaagtttaataaaaaccgaactctttggaagaaaaaaatctcaatttgttttggagtacctgaatttgggggggcccaggaagataatttctgaatctaaagtttcctggtccttcagggccagtctctacattacaaggaatagagattatgggttcctaaattatggggcctgagaaccaatcccccaaatttgcaatctgcagagattgtgcaagatagtgtgtgtgtgtgtgtggggggggtgtgtttgaaatgtaggggggctgagtgggtgtatagctggtattgcagtgggagaaatcagaacctttttgtgacccaaggctaacactaagtgtgttttggggggcctggaaaatattgcctaatgtttgaggacaccaggcatgagccaacacgggggatgaaaaggatacaggatggtactggattttgcaattggtgtctgagttaaaaaaaatttttttttccaaattgttaagttaaagggacccagatttgatgcagaaaaaaatgatcagtgttcaaggattggagacattcaacattctaatataaagaaaaaggacttggccaagagttaattttgtgccatctgtgacccagaaagacatggaacagtcatataagacttgggatagcatggaaagccctctgccacatagaagttcatgccttacatcattgctcagcctgctttgggggctttagtgagagagtttatattttatattttaaagaaccctaaccatggccagaatgcttgcaggagctctagggagccccaaagccttgtgaccagtgtgtattcgtggaattttttgggggggggtcttgttaagtgaattttagatgtgattggtgaatgtactctttccattttctggaatccgagaaatgagagtgagggctatttgaggtgtctacatttaggggaggacatagaaaaaaaggttgggactttgaaggtgccaggaaaattgttaaagctgtctgggtgggattcaacttgtaaaatttggagttagggcaatagactacagaatctagtgttccacgttaataaaaccagaggacgggtggcgggggaagagagtcagcaggaacattactgcagatataaaatgataggaacatggggaaaacaccccgctacctcatcccctggagacagtgcctaaatgctgtcaaaatgtccgctctcccaagtaaggaaattttgtcaaaaggactaaggacccaggcttactttaaattttagggaactgagaatggtggttttatatctatatataggagcttgcatttaaaatggttaggagccagaagcaaacttgggggcccaagccaaaatattctaattgtgaggagtcagcagaggcagaattcccaccctttaaaatatttggaaagcaagtatcaaaaacaaaacaaaacaaaacaaaataaaaaccaaacaacaacaacaacaaaaccttttccctgtgaacagaacaaatgctgaccgattttggagcccccacccccaccccccaaagcaatgcttaaatttcaaggatctcagtcaaactaagtcctgaggttcagagaagccggtaagttcctcgggttgtagggggaccacagagaactagagctgaatttgagaaagtgagctcccgggccgggaaggacagggcgccaggatccgcggtgccaaggaactcacacggagcaggggcgccctcacgggggaacccagacgcgggaaaggggcacaggcgacgcagattgggagcacggacgccacagagcgcgcgcccgagccagcttcatttttcgttctttcgccttctagccaacgagagggtttgggtagcagaggccgagcgggacgggcgtcggagagggaggcggaacgtcggggagcagcgcgctgctccccgaggctccttaggttccggcgccccgctcggctccccgccgcccctgcgccccacgcgctcagacgccgcgagcctaggcgaagtcggggccaggcagccgccgggggcagactcgtccctagctcagttttggggcccggggcacccccagtggctacccttgaccgcccctgtgctaacacacgcctatccggccgtgtccgctccctaacgatgaacaatgtaggaaatagttttgtttgggcactgtggaaagtgggtaaaaaatgggggagcagaggagaaagtggggggaaagagcatagcagaatgatacagtggtgaccgttgccggatgctagaaccctcatttcgttttctcagaaaatttctgccactagcctcccaatcctagctggggaaagtccagctccttaaaggcaaatattaaacccacacaccatacacaggctcaccgtactgttgctgggaacaaggccaccccctcaaagttgagcaatgctggaggtgaagggccatgattctagcaggacctggggggtgggggtggggtgttagataggggagcagctggagagcaggagaatgaggaaaaccctggggccatgactgtaagcatggcttgcctctataaccacccgtagaggatggtatgcagggaggactctcaaagcctaacgctctggggaggcaggagttaaagtcagtggacaggtgtggggacctagacagggcgaggcatctccatattatcttggcaggactgagagagcccccaccccacccattttccacccggagcatgaagcacgtggggaatgttcccctttcaaattccagtctgcatcaatcacccccgtgtcccattccaagaacatctggcctgtctccccccacccacacccatgctgcccccctccccccatccaccagcctctatccctggcttttctggcctctccgagtttgtgcctatagatttgaggaagcttccagctaggaagaccggtatggtgatgttcctcattccagggagacttgtaaatttgttgggagtaaggagcattaaaaaggtgtttgagaacacctctagtccttgtgaggccagattaggctgcaagccctctgctaagggtctcctttagagaaaaaaaaaatggcaagggccggcagaggggttctctacctttccccaagaaggggcacaggccagagatgagcaaggttctgggaacagagtcccgattctggagtcctgccttccttttcctaaggggcatctgagagggcagcaatcacaacctgtggcctgtttcagagcctaatctctgctttctgccctccagaggtctctggagaagccgctgactcacaccccggagatgaactcctggactttgccaggtaggaaaacgctgaggtcaccttaaggtgtccattgaagagccaccagggcatgcaggcgggatagggtgggggccagggtatgcatgtgttcttcttcctctatgtggctgcccacagagccttcacctgaccttatttagtcaaagtgtggctcaaggggcagggaagagcctggtacagttccgggtcaacctagggctcaaaagcacacagcctacccccagctaggatcagcgacagattctttctctaaggccctctccttttccttatttttgcctaccctctcccccctacaaggtagaaaggggcctaccttgcatgcatggggtctattgtttcttctagatagggcctggcccactagactttagccctgtgctgatcccaatccttgccctcccctgctctgccccaccaccgaggcagcctaggtctcctttctgggcttaaaagctcaaattctgaagaaactaaatatcctttaagattcagacttacccactaagcctggctggcaccctcagccagggcctctgcttgtctcccctctctccctccaggcagtggggcttccttatccccccgtgtgacttttcctagcttgttgtagtctccgggctaactgctcaggaataagccaagacttttacacaccctacttctctccgagggtccccagcatgctcttcctcatgcctgtgctggatgcctgccacagaggacacactcaactgggctgcggtcttggacaccacatagggactccacaccaggaagacccaagcaatgctctatgccaatctgcaagcctgggaagaagtcactacctgaaccaccaacatgaggattgcaccaaactgatcaacacaacccacaccaaaagtaagtaagggttgctgtgggggcactggagaggggtcagcagggaaggccagtgtcctgggtctggatagactgaagccataccactatgtaattgttttagtgtctgaaccaacatttgaaagaagattcttggcttctttctggcatgagcatgatatcctggaagaggggtggaattcacctgctgggaagcctgtgccatttgaggcttaggcacaaggacacagacctacatgctgccccccagtctccagtattccaccagacacagcctctacctccctggtccctacccagtacctgaccagtgaactgcagggccaccaaacagcagagcttcctcggcagagtccacagtgcttctggccccgtgccctctctagctgcttcccaccccattcacacacaggaaacccatggccttcagaacacaatagaattaggacacacactctcctaaggcccttcacagctctcagaatgtctctttggttgttatgtcatttgctgttcacagttcagccaggaagcctgagactgtcacacactttgacaaatggggatagacacagagaggtcaagccactggtgcaggagcaccacagctgtaaatgcatagtcaggggaagggggaacaggaaccctcacacacagctttccttggcctccagattctttttagctaacagtttgtttttcttttttctttccttagattctttcctcatctggaaccctgcctttccctctggagctgtctgacctccccccttccccagcatttgctacctttgcccctggactcctggaagcattacagagactgctgcctcgtgtctgcttggcttacaccccttgttcccaagaagtgacacctggagcgcacctgaatcccagatactgtgactgactagacttcctagccttggctggttccttggctgagtcttgcatttgcaggagctctgatgctcctgtgctagagatacctctgttctgctgtatacctgaaggacactcacctctgaggaaagactggggctggtgggaggtttctgaggtttcattcagttctgggagcgtggggatctcctgggccacaggccacagcacttgggcacggggctggagtctcgggatgctctagcctgtttcttctcaggttccggctcaggcttcagctcgggctcaggctcaggctcaggcttcagctcaggcctcggtggcagaggcctcggctcgggccttggtggcagaggcctcgactcgggccttggtggcagaggcctcagctcgggccttggtggcagaggcctcagctcgggcctcggtggcacgggcctcggctcaggcctcagtagcagaggtctcagctcaggccttggtggcacgggcctcggctcagacctcagtagcagaggtctcagctcaggcctcggtggcagaggcctcggctcaggcctaggtggtacaggcctcggctcaggcctaggtggtacaggccttggctcaggcctaggtggcacaggcctcggctcaggctttggtggctcaggcctcggctcaggctttggtggctcaggcctcggctcaggctttggtggctcaggcctcggctcaggcttaggtggctcaggcctgggctcaggcttaggtggctcaggcctcggctcaggccttggtggcacaggcctggacttaggcttctgcagctctggctggacgagaagtttagccttaggagactcagaaccctgggttaggggcctgcagtcgtcgtagtcgttctcctcttcctcctcctcctcttgcacagtgagctctgttttaattactcgtcccctgaggaggagaagcaaaaatccttgagattatctcaaaaacaaatcttctccagctgagtctggccccctccccccaccttgctgctggatggggaagcccaagggtcaccttgtcatggttggagcactcccccctaccctgtcccttcagctgcctactctccccacccccttctcagtagaagggaggaagcagttggtgagaagtcactttgccaagtttgacaactgttcagggagaggcaggagaccctcctttgggaaggacaatctggctcctgcctggctgggggcgggggtggtggtggtgtaaaactgctgctgcacacaaaaggctttctttgaggggtcacagctaaaaatgtgaatgtctcccattcctctcctcacacttctaccttggatgggaacaaaaaacaaagggcacatggatctgccttaggaaggcaacttctggaaggggtggcagggcttctccccataaacattataccggtggattaaggagtctgggatcccagttgcagggaaaaaaagctttgtgcacaaatgaatgtgcaactgggagtgctgtggctgctgctccaaattcctgcctgtgcacagggaacacggaggggggggggggagggggagttaaagacagacacagccaggagaaaagcagtttttgtacttaaaccctgctagggaatagcaaggcacatcatcctatctatctaccctccagtatcctggtggtagttaggaggtacaggatataaaaacagggaaactttgcttttaaaattttatatatatatatatatatatatacatacatctacataatatatatgtataataataatacacacccccacactgctctagaatctctggcccctctgcacagtttagccgggagtggggtgggggtgggggggaggagcggggggagcatacaccagggggaaaatgttcacacagaaaaatttcacatttgcaaaaacagctgtgtactcctgctgggaagagaaagagcgctgcctctcccctttgcatggtagattagagaacgaaaccatactttccttgtagctttgtgcagccctttaagtcccagtcccagttgtccttttgtcccctcagaagttgaagtcactcttaagaccgtccggtttagcggcaaccttccccctcttcagagactaactgaaggaccctaactctcccaagtccccagccacctacccacaccagaatatttaaactgcaccttcactcatacacaaaaggcatgaacaaggggaaatcaattagttacctgtactctagtcgcttcgtagttcctgaagttcccggacggtggataaagaggaccggggagtcactggtgcccaagattctcttccgaaattgcccggacgatgatccgctggctgggtcaatattagcagccccctccaaagcagggggtgctctggttgtggtgcccgggccctccagccggggcgacgatgttgcggcggggctggaaggggctgagtctgagtctgaagagacggtgagagggagttttagagcgtgcatgataacagagcccctagaagtggcttctgctctccaccactgagtaaggcacctgctcgaatgacaccacgcttttatccctcacctcgtcccctccacgcccacttccagccccctccaaatttgggaaatgatatgccagtaaagtactgcaaagacttatggggcagctggctatggcgctttcccacactagggtatgggggcattagagggtggggctttggcccctgcctgacagacaggaaggcgtctatgcaggtttgaattaagctagaagcacttcctgttagctagggggtagggactatgtgcaggggtggagagtgggtggggcttcactggattgacacctggcagtcacctgacaccctggaatgtctgtgggcgtggcacaggtaaaaaggggcgtggcttatgcaaattagggtccggatttaaaataaatattaaaattactttctaaggtc

SEQ ID NO: 309 - DNA, 15721 bp, Mus musculus
tccagtgtgtgtcggttttaatattgaaatggcatcttacacagaggcagctacaagcatgaaaaccaaaagagcccgtaattgtggctggacccatggaagtatctacatcttttaatctacatcaggtttctagggccccacgctcagtctctcccagcaggaacaacatggaacagacaactttgctgagatggttataaaacaatgggttccctagacagattccagagtggacaggaccaggctttcctcgctgtctccagccccaccctcggggaggagccaccgaggctcctccctccaagcaggctatgagctcttcagacaagaggccagtcccgctcgcacagtgtcctgctcaaacaagcctaaagttgaatggaattagggggcaggggcagcccagatgcaggcgattagaacgagcctcagggactccgttttctcgagttatagcctctcttttctctaccgtctctctcactctctcatgcacacacacacacacacacacacaccatcaccaccatcactgccaacaccacctatctccagatcttctggaggaggtgcacaccaccggggcctgtgttaagtttcaagttcctcgttgtcccctcagtcccttactttccggggatttctcacgatccccagtgaagggtggcacactatgaacccccgctcctctccagatggaccgaagtgtcttcccagctaccagaagttctggtggtttctataatgtggccagcgcacaaggcaagctcctccctgccccacctgggctgactcgaccaaggcagcctgagaactctggccctgcctgccaccttctctctcagatcatatgatgctagctagactggctgactggcaggcaggcagaccccagagatctgtctctattgtgcaactgctggggttacaattacagactatatctggtatcccaaggaatgaagtctgtcttttacagccaatgaggcctggggcttgtcacatattgagcttctcactttatacacctccccatgaatcttccagactcttgtttggttgctctctaaccctaaatcgagcgtgacttgttccagccatgccctccctgcctgtcaaggtttagctggcatgatcccccttcagcgagccctccctgcctacctcgtcttagctctcctgatccctgcccccttcagtatccagggcccaccacacataattacagccaccagggaccagctactgtcccaaactgggacgctgtcaggccttttgtgatcaggcttctgctcagtttccggagcaaagtcccctgtgcagcctttctcagggcattgttggtgaaatgtggaagattggccatgagagggcagcagcgagtacgtacaagccgtacctggaggtaaacccacgttcctacggggtctctccatttcctccgtggctcaggtccctccgtagactctctggcatctctacagtcagtcctaagcccgtgggtaagcagttctcacagcaccaacagatcaggcagcctgtccttgaacctccagccttctaagctctggcttccagatcactctgtgaaacatgctctcttctcttgcccacttcaatctggtgtcaccctcagctccacaagggtcctatggcctcatggctttctgccgctgcttccagaggacttccccttgccttaagggttcctaactccctgccagccacactccctgccctctgcacacctaccctgtgtaaaagatctgccttagaagacttgaaggtaaaggtcgaactattttactctagggtgtaagcgatggagaatgtatttctatctggagtttgacgttgtcatagggccaaaactccgtaagtctcctaaacaaagactcaagggaggccatgaccttgtgctcaatgagtccataggtaacaaattgggcccaccagacaggtgtcttaggctcctatatgagctaagaactgcttgcaagaactgacgctgtagtttacaggagctaacggccaatgtagattgtaaggctatattggatggagccagtggccacacccatggaaggttagctgtaagtctggtcccaccaaaatgctcagtagacagtatcctttcttctgggctgagccacaccccagcccggttagcactttgattgacatttggaagttctgacccagaccggtcacgtgtctactctcactagctacatcctccccatagcaaccaagctcagcacctccgcccatccctcgccagccacgccgccatcatccaagccgttagtggtaacagggagaggagtatgagacctgttagtcagagagaaatccacagccattcatttctgccggaaggaacagaccagaaaggcaaacattagtccagaggaaagggtggttggtttaaaggagcctggagccccgcgggtgggcggggctggctgctagtggtcagcccctggggcagccagggaaaggcagggattagctgggggagagctagagttagtgcaaaagagccagaggttagcccagagaggccatgagcctactggaggtgaggcatgaaatcacccccaggtgtggccctggcttagcagctggcgggctctgggggaggctggctggggcaggggcatggatataaaccgaacaaggagctggggtgacttcccatccgcctgtgggcttctaagattcacttcctggcacccatttgcccctcccataagccctaagggcccgtagagacgcttcccgactgtgcatcaggacaactggcagcctgtcctctctaagtgtggagagagtgtttctaaacacttcctgagggaaaaaaatatcctcacacctacttcctgtgtgaaaaatgatcccaaatagacttccagtttgagatttccgcctctctcagtgggaaaggcctggctagttgaccgcctatttggagaaccttcttactggtcatcggccatctcttctcaggctgagagaaaggccctcttacaaacttcctgatgccctctctcctcgggcttctctgcgctgtggtgtttcagggaaatggcccctcacatgtttcctgcttaggaaacatgtttatagctcccaggtagggctttgggttcagacacacactttgagctcctgtacaagatggccagcccctgatgttcctacccctctctccctgccctaaatcacagagggccccagctaggtagggcccagaattgccaattctagagccacgggcaccacaatggttcccacgaggtcccctggtcccatccactcctggtggcaaccagacttgtgcacagaggagagaggtcatgctcggagcccagcgtcccacgtccacaggacagcctcctcctcctcctcctctgggcgtcactaaatacggctgtcccctgcctcagatctggcctggacagcctggggacatctgcttgccaaaaggagggaccagcccccaggaagcccagagctcggcagggctgggttagtaagaagagaaaccagttagtagggccgggttagtagcacagcatcagcagacacacacaggagccactagagagaagaaggcagcggggtggccgttagttaaggggcagcagggtgcagagtggggtgccccggggttagacaattagtaatcaaaagagctgcctatgggagagaaagctggcaagaggggagaaagggaagagacgttaaaggactcaaagcacatgtctgccccaggtagaagggtctgtgtgcagaacacccgagatcagagaatgggcgtaccaccgagtcccccgaggcccgccctcagcgtgtcttattccattttgaagtccctgccatgcggcaacacctcggtcacctcaccacgggcatcaagggaagtagaagggtcccgttccgccagcagggagcggcagagttggtgagtctcttagcataccctgtcccgcaggatgggtctgcacatagatcccagcccccaggcagggccttcctgagccttgtccgcgtcccagcctctgggaaggcccctggcctgcagagttagtagggtttggctgctgcggggttagtaggacatgctcgggccaggttagtggattagtcggttgacagaaggccaggcatctcgtcgcgtgccacagcgtcctggccgagccctgggttggttagtaggttaatcacaccatgcagccttcccctttcaacccccctccggccctctgcctccccaccacaggcctcctgtccccaccagcgtgggcatggggcctgacctgggcagggggtctgcctctatatcccatcaacacccaccgtaggaaccccatactggaagcccagagcttccgtttctaggctgtgggtcttggagctccacagacacttcagatctgctaaaaatgtacccagcttgtcctcagtgcaaaccccctgcctggttgtggccagcctcttcccagaaggatctcctcatatgcttgtgcgtgtgcgcaccagcacacacacacacacacacacaccagcatctcactaccaaccccaaccccccagagctgctgcccttgaaaatgaacatctcttccatcaccaactcccgggtctctggctgctcccaccactggcctcctctacaaagaaagaactgcaaggaacctagcctgagtcctaaagcaaagtttggactcccctaagccccacccctccagcttctctttcctcccaggcgacaataggacacctgagcgcacttctaaagcctaatgctgtctcccagcattctatatgtttggtaagaaaataattctgtagccagcaaagacagataatatctcatccttccgtcccagcctgagtgtctgaggtgcccattagcactttgaggctctgaaaagtcctaccctgtatttgacctatttgaattttgctttaatttctttccaaaagcactcagtcaagccatacctttctcatcctccaacgtcccagtgggggtcagcctgactaggaagtcacttcctccctcgtgccagagctggcctctcttgactgcctattgtctaattcttcctggacacagcttctctctgatgactacaaagttgtaaatgtctgaggtgtggttgcatagcacctgtatttcccaagatggctacacaaataaaagaaccatggtgggatccatggtctagcaggaaacaaggttcatctccttctggaaaacatggtaagctacaacagaaaccaaaggtggccactgctccagactggtcagcaaggcagacctgagtggcccagccagaaatgcctctggatcagactgtatccaacccagatgaaccctcacctaaactccctacactcccactgaacagaactgtatggtgcatctgctgagtgcccagcactgagtcaggcacaggtctgcctgagagctgcctaggccaccaagagagcatatggtccacatgacatgtggaaatcaaagctggtagagacaagggggcttgtagagggtaccctgagacctgagctggctctgtactggctgcagccaccgtgtatgtccctaagacaactggcacaatgccagcaaccctgtacccatcttatgtttgtctgttccttcctatgtgaggaactctgaaggggagactagctgctcatgtctgtgagaccaccctgtcagagtccccccctcccccgagaggcacaggctgaatctctaggccctctgtgaaggcacagagagacaagaccaccgagctcagatgaggtcattcgtaagcctgggtcctgaaatggcaaggctgtcatggacaaatccctggagcctcgctcactcactctggacacagagaaagaccccgtgaagacataagctaccgctggcaccttggtcttgttttgccagcctcaagtcctgtggtgtgagtctctggggctgagcaccacaggccaggacgcagaataagcaactgccccacccctaccccagtcaagggattcctgtttctagactgtcccaaggaaggccatacagtgctccgttgctggttgtagaccctcctccagggctatgacaagaggcgaagaacggacaggttatactgggcactgggccctgaggagggagtatgtgccagcctctgtccctctgcagctatgcaatatggattggggtacaggctgggcactcccatgtcctgggcaaagcctttgtaactgactgggtgcagcccattctccagtgactagaggaagctggggctatggttctgcctgtgaacctccctactaggtctccttatcttagactgccccctttctctttccaaggttccttcctgtgctgaatagcacaggggctagccaggctcctcccagaccaggactggctggctgtcctcttcccacaaccagcagggagctaagcctcaccccaggaaacacccaaacagactcatcactcaagcagcaaacagacaaaaaaagaaaaggaatggaaacggaaaaaagaaagaaagaaagaaaaacagacaaagacagacattggactcctccccatcagctcctcctctgagcctatagagtccctgccctacccacaggtcctttgagacaccaccctgtggccaggagggggcctagctccaccccatttccagagactggaggattccagtccacatgggatgaaaagaggcctccggtgcccccccccattctaagctgcagcctccccccaaccccctggagctgtccatgaaagacagggtgactcctaagtagtacatcttccaggaatggctcttcttcggggggtggagggtccatctcaggtactgggaaggatagggtcttcagggagacaggttgctccccagttccaggaggtcagaatccaagggatctccagggctccaagacagatcagggtctggagatgtgcagagctgtctgggagaggcacaaggaaagaaggtgagggcgccccagatgcccttagtctatgtcctgggctcccaacatacaaacatacacatggggcaggaagcacagcttgggacacaaatctgtcagaataaatttagacaggaagtggtaaaggaaccaagaggcggggttcactcaaaagatcagcacaaagccaatgtcaggtggcccagagtgaccgcaagaggccagcgtccgagaaggggtggagtggactcaggaggagtccccagtggcttcagctgagaccctgtgtacacacacccccaccccacacacagacacggcaccccacaggaccgagagctcacccgcttgctgagctgtagtgatgcattgtcgtacttgaagatcacagagggtgggccatctctctggcgttcacccctggacacccagcagtaccaccttaaagatcaggttcatatctgtgtgagatgacgaccccttcccctgagagcctccactggagggggttcagattgttcttatactcccttactgacgccatgcacagcaaaccttctgcttcaggtcccctcccaccccaccccccagggctcctcagagacagaagggctctggtcatgggagggaatatgagacagaggaccaaccaccctcctaaaaggaagcatacttctcacccttacctgacatcattacatcatcgacatcatggaaggcctagctcctagctcctcctccacacagacatcactggatgactctggaagacagaagagctacccccccccacacacacacacacacaagatgcaccccaggagatgaccttgcacaagccctgccttggctcaggagccatttgcctcctcctcctcctcctctgtcacctagagcattgtgggttcttgtgtgacccagaaaaactcaaagtaaactgggcagataggggacaacagggtgagcagtgctgacagagggggatctagaactctaagcttagaactgtcccggctgctggaagcctgtgcctctctctgatccctgccctgtcccacaagggaactatagtggccattcaaggcatggttgagaaatgaaagcagccctctgcccacctcagtcccctccttcctgtgactcccacaacaaaaaaacaggtggccaaagtgtgcagagcttgtgtggaccactgcaagtcaccagggtggtggaagagagaagggagtgcctgcattccacaccaggactcaggtttgctctttcctgacagtcatgctacatctgtcctccaaaccccgagccaaggaaggtgagacatctcatagctgctcttagagcctactgtcccaggatcctggaggatcctgagtggaggaaccctgaggaggtccccctgtgtctgcaagacccaggagcctgttcaagcttacaaatgacatcttcaagagccagagtcacaggacggccatcctccctcccgttggggattccagagctgaccctttctcacacgcaccagcagagagcaggcaggctggtgaaatgatacttatctgcaaggctgctttgcaggctagtcgtgacctttcccaaatctctccactcttccaccacctgggaaccagcaggaactctgtgaacaaacccacagtgaccccgtcacagcgtgcactgaatcctggtcattgtgaggacagtggaggtttccagggaaccctagttccagagtcaggctgattcagtctcatagtgtagagagaaagctgtgggtttgggagcaataaaaactagggtgaggctgtggctctccaaccccacaggcacatcacctgtgactctgagccgttattctggaaacttagccaattaattggtgacttgaatccagaaacccaggcccgtgtcttagacagggtttctattcctacataaaacatcatgaccaagaagcaagttggggaggaaagggtttattcagcttacacttccacattgctgttcatcaccaaaggaagtcaggacaggaactcacacagggcagaaacctggaggcaggagctgatgcagaggccatggaggggtgctgcttactggcttgctcttcatggcttgctcagcctgttttttttttgttttgttttgttttttgtttttttggtttttcaagacagggtttctctgtttagccctgcctggctgtcctggaactcactctgtagacctggctggtggaactcagagatccgcctacctctgcctcccaagtgctgggattaaaagcgtgcaccaccactgccgggctcagctcagctcagcttgctttcttatagaactcagtaccaccagcccagggatggctccacccacaatgggctaggacctcccccattgatcactaattgagaaaatgccttacagctggatctcatggaggcatttcctcaacagagtctcctttctctgtgacaactccagcttgtgtcaaggtgacacacaaaaccagccagtgcagcccctcagcagaaacacaggctgcgtttatactcagccatcatacaaccctgatggagacacaccccaggtaggaaatatgggtcaaattaaaatcccaaaggaacagatgagatgtaccaccacacagtggcatcaactgggctgtaaaaaggatctggtgattgacagaccctggacaaaccacacaggccgtgctaagaaaagccagacccagaactgggtgtggtggtgcacttctggaatcccagctttagggaggttgagacaggagggtcatgagttcaaggccagcctggattgaatggtgagattgctattctctctctctctctctctctctctctctctctctctctctctctcccctaagaagatgagtagtgggtgtggccaaagtttatacaaaatgtccagaaaaggacaatgaggagtaatacaaagtatcttatgggtcaccttggcttggtgtggaataggaatggattcccaggcttgggcaatctcatgggagcaattgacatgcaacaatgtcattaaacagaactgcagggcctggtgactgtaatcaaaatctctgggctgtacccttgaaacaggagtgtggcactgtgtttaagctgtacaagaaagggctgggttactgagaaagagcaggaccaaggggcacactcctgatctacagcggggtcacagccactggccatctgaaggctgagcctaggaggggacccataggcaagagacactcaggcatttcttttgcttttgggttgtttttaaacttttaaacacgtttatgagtatgagtgttttgcctgcatgtatgtctgtgtaccctgtgtgttcagtgtctaagaaggtcagaagagggagggagggtcagatctcctgaaaatgaagttagagacagtggcaagccaccatctgggtgctacaaatcaaacccagatcctctgcaaaagcagccggtgctctgaatcactgagccatccctctagcccctggtttttgacttcttactgtttgtctattgcttgcttgttttgagacagagcctcaaatagcctgggctggcttcaagctcacaatgtagccagggttaactttgaacttctgggattgcaggctggaggtaccacatccggctcctgttgtgctggggcttaaaaccccaggctttctgaatgctcggtgaacactctacctgtgccaagcacattattttgtaccctaatttaaaaaacaagctaatcacacatctgtggggattgttttctacaaaaaatatgtatgcatgatgaaaagaccagagctaggaagctcatggtcagaagctgtgaggactgtggacctggctggtggctctgccccaccccccaaaagccaagaccaggagcccctttggaaacttgggcaaaagactaacacccatgagacatagatctctcctaccttgaggctcagaaggctcagtccctgtgttgagacagagccaacttggtaacaatgttggcctccaccgcccggctccctgctttgcccccaggtaccactgagacagatcagccatgtccgtgtgatgagaacagacggaattccagctatcacagagagaaagacaggaatgaaaggtgggtatccaggaccagccaaaccttggcatcaccacaacagagctcctcagagagccctgagaagggcacaggcacggagcccagagaaacccatcatgactttgcaccttggatttgtctttcttttttgagacagggtcctactgtgtagcccaagctggcctctaactcagactcccctcaaacttgaggtggtcctttctcagtctcccaagtgctgagctgagcctcagtcccctgtccatggaatgagtgtggcattgttttcactatgagtgttacgtgaggtgacaggacaggccatcaacactcataccatcgactaggtggtgtggtggttgactatacagcacactcacaccgcccaagaaatcacatgattccattcttgtaacagtgaagagctgccagggagatggcggagggctcctcttgaggtccctggagttgctctttctgcccgacctggggataaaatctctgctcacgtctcggaggcagacaagagccgctggcacaaactgtttcaggaggctctggtgctcagagctccagaacccccaggaatgcaagtgtcaagatcggcagggcacttgagcactcgggcaggagacagagcacagaagaggacacattggggccagagaaaagcaaaaggcaggagaagggaagccagctaaaaccatctgggttgtggtccccattctatagaggaaactggggctctggatacagaagggggatgagaaagacccacagacgctgcagacatccgaacatttaacgtgcgtcagggtcagcttactgcagctgcattcatagcccccaaacgactcgttaagtcccttttaagggacaggtggcactttaagggacaggtggcagcgtgtcactcagaggaacaggttagatccaggtttgaaacctgactacggtctaaattgatggatgtgacctttgtctctattttctcgccccattgatatctaagtgcaaggtttttttttttcttttttccctcttagagggagagagagagagagagagagagagagagagagagagagagagagagagagaaaggatcccgtgtagcccagactggcctagaacttgctaggatgactgtgaactcctccacccagctcccagctttgcacaatttatcttccttacaccgggataagctggggtttgtttttattgtctcctatgcctcagggacacatggtcaaaactctcattccccttggctcctccagaggggccacctggcaccaagaggaagaggggacacctgccccatcagtgcagaaaagaatgagagacagatgtcaccctcagccagctggtgcctcagaaccctgactattgtttctcagagggacaaatgagccaggcctcaaaagcgggggtgagggtcccctgggaacagaggcctgagccgcaagctattcaccggcccattgaacctgcacaaaaggccgggtgccccagaggcgtactgtcccaacagcagaaggtcacccagaagggtagcactgtccagaggcacacagccagactaagacaggtaccacacgagtgagctggcccagcaagtgtgttacagggtctgccctcaataaggtggctgaccctggttcacagccaacagccctccacccccaagaacatggccccactctacagctgaagaaactgaggctggaaagagcctgactttgatatggcaggtaggattgacacagagacctatgctctcagccctctctctctctaccacaactccaatgagtaaatttgaggaggttttggtgtgggctgggccaggggaaagcaatctaccacagaataggttgatggggcggggggcggaggaggcagcaggagggaagtctcccgtgaagccctaccaccacagtgagcctagcgctttgtgaaaatttagttttctcttatttctgtcttttccaaagctgcacaattcttgctcttattaaatttaggaaggtggatttcaagggggggaaatgtaccaaaattataaattttaaaaattgaggtagagtgccatgatgtagcccaggttggccttaaatgtataatccttacccaggtacagtgggtgattataagcattcttttaatcccagtgcttagaaggcagatgcagaactctgtgagttccaggccatcctggaaacatagtaagatcctaccaaaaaacaaaacaaaacaaaacaaaacaacaaaaaactcctgtctcagcttcccaagtgttgatgtcatctcaagatgacaggggtgagcagccagcctagcttttgcatggtctccctccttccctatattcatcccttctgccctctttctccctctctctttttgtttcttacacagggcctcactatacagccctgactgccttaaaacgcactttggtagcctaggctattctcaatcttgccatcctcctgcctcacaccaccaaaccctgagactgcaaggaccatgcctgaccaacactcatttttctatggatgttaaaagagattgtcttcaaccgactggaaaagctctttgggacgctgaaaatgtcaaatgtacaccaacacacacacacacacacacacacacacacacacacacacacaccgttatggggtgagaagatggtaggctaaattttctgcaaggtcagcgtagggcagacctcagacccattctcaaccgcaaaggatataaaaagacagatttagggtgtgcagaagttaaagttgttaacccagaattctttcaatagggtagggtgagttcagtgttttctcacagcatggagcagatggggtagcgccaggaacccatttgccccgcttctgaagctggggttgggggcagttctctggcccaggggacaccctccccccaacccccattccacccccaatccccgctccaggatcaggagcgattctgagcacctccagatgtgcagccccgccctagatgtgctgacgcagcgcggggccacgtggcgggacattggctcacttgaggggagccccgggagtgtggggttactcatccttgcccgtcgcactccacacccggagacgcctcctggaaagagcgctctggggaggcagcaaggctgcgcccagctcagcgcaacgctggcgccgagaaaaacaaaccggcttccagcttccagcaagttctctctctgccctcgatcccttagcccctccctgcagcaggtgggggcgttttcctggcgcgactcctctccgcagtggggtgtgagcgccagcgatccccgacgcctggaggcctgtgctcgggagactgggacgagagtggggaggcaggggtccccggaatccctctgtccaagaaataatctcgttcgcgtcctagatgaaagaggtctagacctttccctctcaaacccccagcttctgcagagagtagtgtctcagagcccaggagggttgagaaaccgagctagtgagttctagggtcacccccacaccgttttagagatgccatgtgggcttcagagtccgtcgtgtcaaactcaaaaatctttggctgagtgaccttggacaggccgctaaacctctctggacctcctttttctcgtctttaaaatgggttcttaccacctcgcaggactgttgtgccaaagcagtgactccccaaggatatgcaaacagcatccagagcgacgtcgcgatgagagtgcagagatgccctgggtttgaggctgcgctggacgccccaggtctgggataaggcccataagtggaggaatggtaagggctgggcgtgtggaggaagggagtcagagaaaccacccgctaccccaccctccatgcctgggcgcagtccctatcccagagagttacctgctaaccttgtgggttggtgttgtaccggagtccccacgcccatgtgcatctagctgtgggggaagggaagggtctttgttccccctcagaccgtgactaccagaccctgagcatcctctgtgtttccatccccatggtccatccactggaccctcacatctggtcattgcgggtttggagccccgtcacccactcagcgcgggccaccattgccctgggactgtgggacaccccacccccaccccgttgccctcccgaggatcaggtgcgcacggcggggagtgagaatggcgaccccggcttacctcggctcctcctcgctcctgcggctggagtgcaaagggctctttgtgcccagctcttaacagaactgggggagtcctcccaagcgcctcccctcgcaaactcctccccgctctggtccgcagcctccctccctacggccccccagcgcaaccggcgtcgtcttcgcgtttactgcagcgcccatgaaattttaatgcaggagcggctggcgggcggagttgccgcacccggcctcgggcgtgggggtggggtggggcacacgaacaagcacccatcttgcggaccaggactcaagcaaagagatgtggggtgcacatctctcccgcgcctcacaaaggg

SEQ ID NO: 310 - DNA, 2165 bp, Mus musculus
gaagaggtgacacagggacacctgatagctcaccagattatgtagaagcatcaaatgtgttgtctggacacagacatggtacaggaatctgcaatccacacagcattgaagcatctagatacaaagtctgaagtgatgcggggttgcacacatagcaagttgcgggccgcacaggttacgtcctagcaacaccgagagcagatgtggggatggcatatggacttgggattctcaagagatggggaagggtagagctacaggggcgaaggaagagctcacccacaaacttctggagagcagagtcccaaagatcaatacctcacaggagtggggagagaagctgggaagggaaaagaagactgggatcaaggcctggaactcagcgggtgcccagggaaggaggacaagttgagcacaatcactcaaatgctaagtactcataagacgcccaggctggatggcacagaagaggaggagctggctcagatgccctcctgcgtgaagcactgaggctgagtgatggaataacttaatttcccgttaaacggggttcggccaatatatggaagcatttctgatgtgctgtgtgtacctgtatgttagtgtacatagaagtttctcttttctcccccacccctcctcctcctgctcccacctcctactactcctactatctgctgacttagccttctctcttatgttagccccagctagactgttaacgtttttgagacttagacccagtatttaggacaatactttgaatacacagtcactcatgtttgttgaatgaaaagccaaaagtaaataggataatcagtcaacaagagaagtgggtgctagagtattcacattagtaaatactggacgcgctttgagctccagcctcaacggtggtaggaaaaagggttgcctctgtgtctgtctgtgccctggggcaagctcctcgtgtaagcaatatgctttctagaagagtctctaaagacagcactctcccaaatgataaatagatttggcaaatatttagtatgctcaatttctccaaaattctgacctgagaacaatgtctagaaaacaatttaaacacttacaaatagatgactggtttctgttgctgtttttgtgtttgtctgttttggttgtttggttgattagttttgggttttttggctttgttattttattatttattgattgactgggtggtgttgttgttgttgagacagggtttttctgtatagccctggcggtcctggaacttgctctgtagaccaggctggcctcaaactcagagaaatcctcctgcctctgctggagtttaaagacctgagtgctaccatgggggtggaggtgagggagggctggtattttttaagacaggatctcacatagccttgaatttgctatgtcacaaaggatgaccccgactcccagcccttctttcccatctctaatgctggggtgagcaactttacctactaatgtttactgcaaccaggagctgccctgcacatcacaacaaagccatggagacagccggcctgcccccatagggacagcaagggtacggagaaactacatgaggtcttttacagaagaaagctttagcccgaagagaatgtaaaaaaaaagacccgttctcgccactgtgtactcacaaactcttcttctgtaacttctggcggctctggaaggagacaaaacgttaccttttcgtactcagatcttccttttagactaactgaaatcatctgcgacagcccctggcgctactgtatatacatatatcccgggtgagctcagtaaaatgttcattatccgcacatggattacattttaaggtaggattccaggtgaaggtggggaggaaagacctttggactttggcttgggacccactgtcaccccagagctaacctaaggcccccatttgcaaaaggagagcttagcgtggttagcgcacaaggtaatagcgactgccctgggggttcgtataaaaggcagggagctggggctggggacccgggcttgggctggaggcttggggctggggtcgagcgcggtccgggtgcccgagcactgcggcagggcgccggggcccacctacccgccgagagccgcttctccggcatcctgtcgggggaacccagctgcccggccccgct

SEQ ID NO: 311 - DNA, 120471 bp, Mus musculus
cctgctcagggctgactgtggcaggggacactctcctgctggctctctctgtccacacttagctggctcctgtcctcaggtgcacggccacaccctcgcacccaaccttgatcctctgatggggaaggtcccaggacttgtctgctgggacaggcctcacccccaagagctctgggcagtaccgagaaggtaagggattgcgcgcgcagcttctctgcccgggtgggctggcctagctcggaaactttgtggagaaccatggattttttaacttccacctgtctctgttctcctcttcctcctcctcctcttgcttcttcttcttcctcctctagcaaacctgacagatttctccagaacagtggccatccatgggatgagtgaaagcctctttctattccagtaagtaattgacttgtaactaaaaaattgtcgtggctgctgtgtcaagtgcagggtgagtggctgctggcacaggtgctgcttctcctttagaatggaaagaaagggggcttaacctgtgattaagtttcaagtcaattgacctccacatgatagcacataattctcccttgcctcccgaaaggccctgcctggttcctgttttgaccctgggtctgacacctgtgctttaatgtctcccagtgcaaaggctagagttgctcttttcctttattaagtaagtgagaatataaagagcccagggtgaatcccagtggtatggaccataactatctgaaagagtgcactgtgacgttgtttgtgaggggttggcttggtttggtttggtgtttttttttttggtttttggtttttttttttttttttttttttttttttttttttttagtgcactaactctaacttcatggaaattattcttgtacagttttaaactctgatttttatagacaaatgtcatgagcttgctagggttacacagggaatggcaggcaagtaagggtgttaggaagttgacataaagtgctttggagtgctcaactccgatgcaccacacttcacgagctcaacacgcctcaatctttgctgatttttttttttaagctgtaagaggaaatagcaacattgtttctctgagtttctacaaacgggctcaaagtctatttaatgtctgctggatgccccacttgaattttggagtcagggggatacatactaaccaaaagcaaaataaataggtgacagctaaaattactgctctccattccttttacaaagaccagttgcatgctatgattttctgtaagattcaggcagctccgggctgctgtgttttcctctttttcttaccatgggaattaaaagtgcacgctgatggtggctactcagcctcattttggggccaggctgggatgagctgtctgagccatttctgaccctccgcttgcagcagcgagcctgaattccccccttgcttgcccatcactgtcagtcaattataggattgaactgaaccagaaaatctggtacagtctggtaattagtacaaagggtttccagtctagtgtgaagactgagatgcaggagccccagcagccccagaaatcgttttgattggacatggacattgctttttagtgctgcctggtgacttcctaaagataatacctcctgccctacaggtcttccttcaagtacattatgggcctttttgaaagagtcgtgtgtgtgtgtgtgtgtgtgtgtgtgtgtgtgtgtctgtgcatgtgtgtgtgtgtttctttttttagaacccacttctcccatttttagactgtcatttttacctatcaaacagacacattttgacttgcccaacaaagaaccaagttatcaacactcgcagaagctgacgtttttaattcaggcttcattatggctttgagttatgacagtgaagtacaaagacattttaagggggttttttcattatttttttaaatccagaattgggatgtttatctttcttttgtagtcatgcttccctctctatcttcttcttggtaatatataattagcattatcaaaaccatcagctatcatcccttttgacttctgacctttattttttttaatgcgtctcaaactaaaataagagaaaaaaaaaaaagaaaccctacataaccgatcttaattaatttgggattgttaaaacaaggacacattttcaagtgtgaatctcttaaaataaaataagaatagataaataacatttcttggtaaaataacagtgacaaaattaatctcatgaaaaatatttcagctgaaagtgtggttgtaccatgtttatttcagcacacatttttaacttatattctagagacttgggcttgttggcagtgctgggttaggatacattgtggatgttttagggtgatatatatatatatatatatatatatatatatgcataagcaagcatgctctttgattcagaatcacaatgacctaatcttatatcagataaaatgaaagaatttggaaacctctcaatgtggctaatgcctacctccaaaagatagatatatgtctatgtaagaacaaattggaagatgctgggtacaaaattgcaggaccagcagggtccaaactaagacaagcagaaaacacatggttcttcatttccgagactcttgtctttagaacaatctgcacagcgattccttcagacacacgtgtgtcctgaatcctctagaggaagattaaccccggtcttgctggagcgttaagtacgtgttttattctgtttaccttcttcagaaaatggctggtaccacgcctgctggggagccttacatctctgactttgctattgcatttcaagaaggttaatgtcgcttttgtagctctgtcagaagtaaagcattttcccaataaacatgtagtgattcccaaggctgtttgtgcaacagcgattctgctgaaatacttctgtattcatttttccattgtttattaatcataacacagcgttatgctttgagaatgagcatatttatgtaattaacactttttgtttttagctaaaccttgctcattaaaaactaagagcgtctcagaaaacaatataaataggcaacttctctgggatgatatttacattgattttgaacttgctgttaggtttacatgttcagccgtacccatgaattctctaaagcacatttggggaatagttcccttaatttttttttttttataaatctaagctatatgttgaaattacaaaggtgctggccacatgtagtataacacagttctgtacttgagaacctgaaggctaggtggctctgtgtaaaattcctggagcccacaagcttcagtctagacacattccgtgtcatttcaatcttattccaagaggcaagagccaaacttttttatgtttccattttttaaatcagcacataaggtgttaagtagcagagtaacatggtccaacagaatgtgttgttattggtctccttcagcccatggcctctaccccattccccttctgcctccccgacccccctactcttttccactttcctaagagtacaagctgagaaaaaccttaaaggctattaagcattgtgactttcagactaagttttcttggggacactgaggctgtagagaacagaaggctggtaactgtttggtcccttaagctcagtgaacctgtgccgttcactgaatgtacgtgcgagatacaagataaagaattactcagaccgtcgtcaccttacacgtgggagtgcacagcaaacccaggattgtccacaaaggtggtgacacagtcaactttggatctcagtcttggactgtggtggacagtcacaggtcattgtgtagacgttctgttactaaaagaacacactgagggaaaaatagccctgtgctcagagtcaagacatgagcatgtaccaaattcaaccctttgcttcagcagtacaattatttctggatgcataattgtgttattaaagtattgtccatcttttttttccctaggaaagtaatattttggaaataattcttaaaatgtgagtgtgatttttaaaggtgaccaacataggcattttaaagcacatggctcattggtcttaactggtaggaattttttttttcccgaagtggaaaattttaattaggacttaaattcaaatgtaagaaacagagaataaattaaggaaaattgagttacaaattttccaaaaatgcatttgatgaaatacgattcccataagccttgacacatgacagaatatcatggtatatttaaggacatagagcacactgtctttatctaggcaattcatagtgaaagttggaaaatactagagaaaaggggtgtgtgtgtgtgtgtgtgtgtgtgtgtgtgtgtgtgtgtttgttttcagaagtgagtactctgaattatataatatatatgtatatatatatttgtgtgtatatatacatatatatatagtttgtttgtatatgtgtatgtatcaccccaaactatattatttgcaagtttcattacatatatgcacacacagcttttgtgcaaatttgctgccttaattcttcgatcctaatattttatcaaacacatttcgggtagttcttgatttgaacctttgcagataagccacagcccaaacaaaaagccctaccaagtaattttcatatgatttatgtcaactatgtgcatgcttacccatcttttatcttcatcttatagaaaggaaatcccatttatttactccctcaacaaatagttaagcacagagctcaggtgctgggagtccaggaatcagttaggtaagcggagcccattacctacagtgctggcagagcgggggagtgggaccgtggatatgaagtcagaaacagctcaaacagtttttttgaatttttttatttgtttgttttgttctgttttttttttttcctgactccaaactgagagaaaagagcaggtggtctggggtgcagaaggtacagcttggtggacctcctgaggaccacttatgcaccaggagatacctctgagattcttccgtggtaatgcaggaatgtgtgcattggtggcttggaaggcagatgtgaagggggaaaggaggaagctcgtgggcacagcccacttctgacctcatcccttccccttccagactccttagccgtgttgtccttcagacacaaagagtcctttcaggggctggcacaagactttcttcagtcagaagcctgcataccttacttgtctgtcatagctcagagagtctggtgatcagattcagttcttggtggtaccatgggccctatctcaggcagaaagtgttttctctgactggtcatccaaaagtctctctcgagctgtaaccttcactgggatggcagtagggtgtcatatgagtgacacacagtgcaatcagaccatgagcagttaacttgtggtcttcagaccatcttcatgtctctagaacatgagaacagaaaatgtggtactatccaaagaagtttctggaaatggcaggagagttctgccttcctgttggattgctctctggagatcatcagaggcagaatatttactcctgtggccatacttttgctcagaggcttgaaaaactgtggagatttcaaaagtcaaaagggcaccgtgctcataagtgaaaggaagtgaatccctgtgtccactgtagcatttgccttcgctgtcacagagtccctgtgtccactctagtgtctgtcctagccttcacggagtccctgtgtctattatagtgccggcctctgctgtcacagagtccctgtgtctattatagtgtttgccttagctttcacagatccctgtgtccactatagtgtctgcctctgccgtcacggagtccctatgtccactgtagcatctgcctttactgtcagtctctgtgtccactgtagcatctaccttagccatcagagagtctctgtgtccactatggggtctgcctctgctgtcacagagtccctatgtccactgcagcatctgcctttgctgtcacagagtccctgtgtcctctgtagcgtctgccatttgctgtcacaaggagtcaaagtggggtctctgaaccatcctaccccttttggatgttgcaaatcgattttgtttgtttgcttcctcatgttcacctcagcatttctctctgtggaccattgttaggaaatacgagggaaaggcctaggaaagaatttggggtatttaaggtaaaaccaagagctctgtctgtttccatctagttagcttagatcaattttctaatctattctcctgtgtcatctacctattgatacatgctgggcctcagagtgctggcttcctttgactcttttaattaacttttaaaatcaattatggttatttgtatagattcctattgtgtcttctctttgcctttgcatggtttaggttttcgctttgttttgtctttttgctttttgcttttttgtttacgctactcactgttgtgaattaacagtatcttcccttccacctcttgaactagagaaactattagctaataagaggctaaatgagcctgagactatagggacgctgggatccttaaattatttaaattgaaaaatggctggttttacaatcagaaaaactcaagtggactgtaagccctacttgaccgtccccttctctggatgatcctgtaatgacagctggagttatctgccgtccacatcactgtccacaaaagctggggcattcactactaacccctgctgcagctctggggagctggggccaactcagggaagagaactttaccagaatctgaggctggctctggtggcatacaaactcagtgaagacagcagatccaacagccaaggccaggagcaccccctcctcccccagaatggaggctcaacaactcacacatggaaggaaggctggaggggagcagagggaaggcacagagtaagggaaaggcaggacgcagcacagttgctgctgtgaaaggtttgcaagctcccataagcatccctgattatatcttcaatttctttttaagctgtgtgtgtttcatggtgtgtaggtatatgcacctgcggaggtcaaaggctggcactgggcatcttattttataattttaccccttactttttgagacaagttctctaattgagcctgggcttcattgagtaggcgagactggctggccagtgaacccctggatcctcctgtctctggttactagtactaggttacagggaatgctgcctctatgtggatgttggagatttgaacccaggtccccatgcttgtgaggacccatctctatagtcccagattttcttttggtaggtgagtcacactggggtcagcactgattgattttctgaaatccatcactgccaagagcattaaatcagagatgttaatagacatgggccacactatgacaatgaggaattcattcatatatacacataatacagacaagcatatagatatcacacagacacgcgcacacacacacacacacacacacatgcgcgtgtgcgcgcgcacacaaatatgccaacacctcaagtgcatttaccaagctagatccattatactataaaataacaaaataagattttgattcactacctcccactaataaatcagaatattgaaatcagaaatacagaacacattacaaatgattttaacatgaaaaaaatactaggctttcataaatctctcattctttattttacatttaaaattcaaaatttcgtaaaaacaaaatctgacaaattagattcaaaatcgcagtcttttgttttgttttgttggaaagtagcctgttccccctttcaaagcccaactctgaaaacatttgtcaggaaacttccaacactgctgtcaccatggcaaccacctgccaaccgccattggctgaaggctggctataatctcctaactctattctcttccccaagccttgaattcaagcccgtctgcctttctgctcaggaattttggggaggggagatgaatattaaggttatattacctaccagtagcccctctttgcatgtagctgacaagctcaggtagcaaatgaaggagtggagtgaagcctgtgacgtcacacaaatgccctcgtgatgatgacagcttatgtcacaaggatcttgagggcccagagaagccagcctgtctgtctagccacctagcacagtttggctcttatatctcaaaatgtttatatgttcatgtgacatgtttgtagacttggggacacctatgggaggtggaagtcccccagggtgacttaactccaacacattctcccaacatgacaacatcctgggggtaaaagttcaatgaacacacaaaggcacacagacacagacagacacacacacacacacactttgggactagaaagatggcccagggttttttggtgatgggagattgatgaaattatttaggactttttttttttttccattttgagttcagatgtggcttctttctccagttaaagaacataaggccctttccactcccacaccaaagtgccacaatgacagaacattgaaggccctgtttgaggctcccttgggctcccccccccacccactgatagtatactattttgtaagagaaacttctttaacttttacatgacttcaagatttcttccttggggacacctatgggaggtggaagtcccccagggtgacttaactccaacacattctcccaacatgacaacatcctgggggtaaatgagcaaaagcatcatgatttcagggttgaccttgaatttgctgtgactgacccttcatagtcacctgaacacggaaacatcagattagtgcatgttccttcaagctcagtgctagtcaagactgtcctcatgaaatgaaggagagagagagagagagagagagagagagagagggagggaggaaggaaggaaggaaggaaggaaggaaggaaggaaggaaggaaggaaggaaggaagaaagttcaatgaacacacaaaggcacacagacacagacagacagacagacagacagacagacacacacacacacacacacacacacacactttgggactggaaagatggcccagtggttaggagagctgatgttcttgcagaggtttggttcccagcacccacatggtatctaacagctatctgtaactccaattccaggggatgagaccaacaacccccttcaggcctctaggaacacacagtacacatacatacatacagacagacagacagacatacggacaaagcactcatacacataaaataaaaataaatcaaagtcaggcacggtggtgcatattttgaatcccagcacttgggagacagaggcagcccaatctctatgagccagaggccagcctggtctacgtagtgagttccaggacagccagggctacacactgagaacctatttcaaaacaccaaaataataatagtaataatagtgcttttttaaagtgaagcacactaaaaagaaggaaatggagacttagaaggaccagggagggaaggctgtgaaggagaagatggtaaaaatagcattacttgggttgaagctgctgtcatgaggcccaggctgtggacacaggcttaaaaaggcaatgataaaagagaaagtgaaattggcagacaagcttccagaagaacaaatcgcacaggagaacaaatcgctggattcctgacttcccggaactctcctgagatgtgagctggggcgcctccgagccatctctggctctccacagtgagtcctctgttgaagctgtccttccagccttagtctccagggagccacagtgctggcactgtgcacaatttaaagcagatgtgggagagtcacgtgacaccacagggttgttaccagatgaacatcattgtacgatcatgccgagtttcatcgttttactaactgtactgctggtgtatgctactccggactttacattgaaaacatagctgttttctaaaaattttagtgttcaaaatgcaatcattttctcacaaggattttaaagtccaaaattcagactacagccaaactcattacatcaggaagtctgaggataaaacccactcatcaatatattctgaactctattgatgactgtcaaaaatgcctaaggtagacagaaccacaagtccaaagataggaggcaggacaaagcaagagagcatgggttataggcaccacttgtgtctgtacactgtcagtttgtcaacctgacattcccagatagtctccactccttccttctgtgccctggtcctcggacactcaatgagcaaaaggcaaaaggaagcagcggcctctccatagcttcagaattctcattaaagataaacaaatgatgagcagttgggagacagctcaatctgtaaagtacacaaatgtgaagacctgggttcaatccccatcacctatgtaaaaagcttatgtgtatctgtaatcccagcactaggaaagcagagacaggaggattcctaggagttaagaactagctggcctagcctaactagtgagctctgggatcaatgagagaccctcaaaaaataaagtaagagggctgggtgtgggggtttgtgcctttaatcccagtacttgaacggcagaagcaagcagatagctgtgagtttgaggccagcctggtgtacatagagagttccaggtcagccagagtcacatagtgagagaccctgtctcaatagatagatagatagatagatagatagatagatagagtttaaagagaatatatagtatatacatacatatatatgtatactccagagaggactgaccaggtggatcagtaaagatacttattgccaaatgcaaaaacccaagttcaatccctgaaatctgcatggtagaaagagagaactgactccttcaaatttgtcctctgacctccacaggcacaacacagtgttttgccccacatatagaaagagaatagtaacttttcaagttaatactaaggtggaaagcaatctaggaagacatttgacgtgcacctctggtctccatacacatatacattcacaacacattcagtccctacatctcagaatttacccaggaaggctgttgtccacttctctctgtgtgtccagatgggcagtcgagttacagcataaacctcccaagcaagtgcgtatgcagatgagagccttaaatgtgtttcagacaaggagcaaaaaaacaaagttttaaattacaaaaatctctgctggcatggtgctcatctgaccctcactccaaccatggaagcgaggctcctctggctgtatccccattttacagatgaaccaccatggaactggacgaagaaagctgtgtgaaatctcagggccagtgtggcctctttctggagttcttaccctaagacagatggaaaattgaccaggggtcaccctcgctattcatggacagctgtctatgtcaaaagaatctcccattctttaggtgaagaatcaaattagtatgctaatagtgttctgcatccgtgttcatagcgggcattatactcacagacacagggacgagccttactacgcagacaccagcatgccgtttgtcatcttctgaggcatcgacactctctctggtgaccgattggagacttttggagcttctttgatttaacaaagaaataaaaaagttggaagagataagagctcccagttatacgtgcatctctaagcccaagcttcagtgagactttgaaagtaggctacgactccttcttagaacatttctcaaaatggaaatcagcctgaatgagtaggagagagaaaaaagaggctcagtggatccacaaagccctggaatagagtagcataaccgagatctggcttggacccaagatggttccagccatctgtctcatttgttgtagacttctcaaggagaaatttctggctacctaagagcagcctgagatgggaccgactctaggccaaccccaagaaagcagtcaatcatttgctcatgcaccagccattgcgtgtgtctgccacacaggcgttcttctaaatctttctttccctctcacttgtctgctactccttcctcctcctcctcctcctcctcctcctcttcctccttctcttctcctcttgctcacaacagccttgttcttgtggctctgccccacctttacgccctccacacctgagaggtaaggtgaatcttggcagcgttttgattaagctgtgcgtgttttccagggtgctgtgcattataacggggaccagatcccttatgctgggaagctgatcatggacagtggctcctagacacagctccaccttctctaggcatctgtgtatgggggcagctcttcctctctcccacagacaggacccaatcctttcccgagctgcatcccacatcctcagcagtgatgaaggcggccctgacaagacaacagggctgaaagcagccaaatcggaagaggctggatttgttttgggccgcctggcatgagaggaggctgagaagggccttgagagcagacattggagcccccttattcgaatccttctaacagccagtgttgagttttaagagacgtctggcagtggcaagtctggttctgctgagggccctttcagttcattgcatttgggtttcaatcaccatcgaattaaggtgtaaggcaatcacttatgaagcatgcattaagtgccgactgtgcaccagaacggcactaggcactatgggtattccaactagaaatctagcttctgtcctcgggaggctgatacaggagcagaggggatatgttaattgtacagttcaatattgggaaagtgcccagttctactgaaaccctggggaagaaggtgatctgatagaaaagattaggcaaaacgtctcaaggggggcaatgatttaaaattgacatcagaaggacagacagctgccagccaggcaggggactcgtgggaaaggaggctctaccaaaaatgcttatcaagttgtgtggggtgctggctcccatgcagaatctatttctgagaacttccatggcccccttttctggcattgctaacgtgggaaacatcttgccgtttccatgacaagcagcctgtaccaggtgtggaagaacattggcacgggaagaggaatcatttcattcatgttggcatccttgtgagactcacgggctgtgatatggcccatctctgctgcacaccgcatgcccacccgggtgcttaatggatgtacatctgattcatccacaggcatgctggaacccaacaagttccagtttgaaagtggccagtaactggacttctttggttctgtccagaagccttgaagaagaaaggggatttgaaaaaaaaaaaaagagtcaaggaactgcagacatcacggggagccttcttggcaggtctgcagggtggcttgacacaagcctagataccctctgtgcaccaagccgactgttcctgttttagagtcaggaagcatcttatcttccctgactcgaccttcagtctttgcctaaactccctgagtcccatcctcagctaattaaatgcctgttcctaaaatccctgattccgacaccacctcaccccaccctcccacctccactgggctctcagggcctcggcttatcgccactaaatcttatcccagctgtattgataataattgatttactgctctacctcatctgcttcttgagggaggactctcctaaaaggcaagactcatgttttaatcatcactgtatcccccggtccccagcagaacacttagaaaagatcccattgaattagtgttcagacatgatggtaaattctctgctcctggaagacatggcgcttctagctctgtatatccagtgagcaaggctgggctcctacgtaggaagcttctgacccacgctagccacagttttctctgcttatggataaacctgtgtggtggtttaactgggctgttgttctttagccctttaaaaactaaatagccccaatgttcccagcagccacacctgttgcagaacggaactgttaaaacgtgaccttctcctggggcatcttctcttcggtgcatctttcaagtgattcaagctagaaaagagggaagagtaatgggtgggtggcagaggatctgtaattagtaaatacttaataatggttatctgatttaaaaaggagctacctaccaccaagcctgctgacctaggtttgattccctggatccatatggtagaaagagaaaattgactcccacatgttatcctctgatttctatatgcacagcataacacacatgcacacagctcgtttctccaatcagccaaaacctaaaacccacacacgaaagttggatgaaaccagaagtgtgtttgagagcaagcactagcagggcgccttgctgcattgcctttaatggccagcctttgggtggtagaggcaggtggatctgtgagctcccagctagccccagcctgcatagcaaactctaggccattcagggctacacagggagacattatctcagagaatcaagaggtgggggtggggggacagactaactgaagaaagaagcttatgattcggaaaggattagaaattccaaagagccccaagctttccccttctgctccctaccttgagctgtccttccccccccccccacctcctctggctccccaaaaactcccacttaacttcccagctgtccactcacacttaacatcagctgtccactcaaattcccttcccagatcccccatcacactgccagatcccacagacccccaacggtctccttttattgtccccagccttccttttacatccccttaagcttccccctcacaactcgcaagggtctttcgcaaacctctccccagattccccctcacatgtatacacagtcaccattcacgattggatacatgcgcacgcgcgcgcgcgcacggacacacacacacacacaggtcaggtagacttgccattttgtgaagtaactgattttaagagggacccagatttacagcaaaacgagagcacgttcccttcgggtgaacgctccccttctccctctctgcctgagattcttcaggagaggcatgaattctgccacgctccttgtggcccccaggacaaggccagcagggctgctgctcctctttcaactttcaactgtgtgtgtcccttggctctaccctgcttctggagtaagaactttgaaacgggcagtcttaaagtagggtgtacaagtgtgtgccggtaaacttggtgctccggaggctgaggcagaaagatggtgatctggaggccaggctagaatatacagtgagaccctgttgtcagaagatggtggtgtgtgccagtaatcccagcactcccagaagctgaggcaggaggatcaggaattcacaaccatcctcatctacaaagtgaattcaaggccagaaagagaagcaggccactatgcctgtgtctggcatatttctagacacctccaacaccaacaccctcccccactctccacccctacttcttaactttaagtacttggtaaaaggaattcagaaaatgttttgtgaatgaaaacaggaagaaaagcaaagaagttttacttgtgaataataaaaggttattgtcttttctgttttgcttcgtttttttactttggttgtattgctgcacgttattttatggcatggtctcatatagttcaggctttcttcaaattccctttcttgtaggcacggctggccttgaactttccatactccctcccgcctaacctccagagtgctcagcttacaggtgtctgccacgtactctaacctttgtctgctttattctctgcatcgcctccatcgttcccttcctctctattagggtgcctgccttctctacccccttgtaaagagcctgggtgttctttccaaccagtggaggcgctgttggcagccccatgcttgctctctcgcggttgactttacatggtgagtgggccctgttcagacctctctaagctctgctctcttcactagtcgtgccgcctctgggcagcccctgcgcctgctctacctgggcctggcttcttagcctcaagctcactcagggagtatgagccctggtgcatacacacttcttgcccattttctctcccagaatacccagtttgtctttagaattaaaagctagaatggcaacaatgaaatcagcttcagaaagtagcttgaatgcctttcattttctgtttttgtctatgccagtggtttgtaaccttcctaatgctacggccctttaatacggtttctcacgttgcgatgacacacacctccatcataatattattttgttgttacttcctagctgtagttgtgctactgttttgaatcataatgtaagtatctgtggtttctgatggtctcaggcaacctccaaaaggttgcagcccaccggttgagaacgtctgatctatgtacatcagctacctccttgcagtttgcaaaggtaataccgtttcctgagcgactgaatagctgccatccctaaagcctgacagacacatcttgttttgcagagggaactcacatgggcagaaatgactatgaggctgtaggtcagggggtcccctgagcaccccatcccttagcaggtgtcccaccgcacctgctgatcagctgatcagccttagtagccccctattatttccaaaaagacagcattttccagacttttctgatctacaatgaaacatgcgttttcttaaagcggtggaaatagaataattcatattgagagcttatttactgccagccagaccctcatcttgctctccagggctctgataatcacctatttcagaagccattagcctctgtgtgttctaaaggactctccaccgagcccctgtgtgcctttgtgttcttaggggaggaacggtgtgcactgaagtgacagacctctcttgaccaagtaagaatgtctgtgatgcacaaatagtatattaaacgcttttatttgatagtgttgaaattaaacagcgtgtggaattcctgcccaggtatagggacatgtaaaaccttttgagactgtggctgttcattcaaacgttttaacatttatgaaacacagtcatattaagaaaaaaaatacgcgttgaaataatgtagtaatcaagacttagccacttacaggaggccagtgggagctgagtttatgttattgattttagaactacagcgaaagagagagagagagagacagagagagagagagaggtgaaatattgccttcactgttttcagataataatgactgttgttgcaaattataaaatttaattagctatataaattccagaagaacaaacggtatgccattgtcttgatatctttccagaaattagtcttttaaaaaataaatttgccatattaatcatctaaaaatatttttgatcactgaattaatggttttaggcctgttttcaggtgctcattgctataggtgattgcttcttaattactacatggactctctattcactcatattaattcatgtttgctggcacagtcccagaggcagcctgccctggatcttctaattacttctataattgaatttgcccactttttctaacctattttttaaactgactgtgtttgtcccaagcttattgtgtcttttttgtgtcagttccctgcaagcagagtgtacatcgatcctttcctcgtttctcattaattttcaagagcttggccgcatgtcggttttttttttttttcagtccgtcagacctattgcgaaacggaaaagaaaaaaaaaaaaaagaaagaaagaaagaaagggaaagaggaaaaagggaaaaaaggacttttattattaaaggttaggtaaaatagactgaagttaattaattcattagtaaccctgagccaattactgaagccttctcttatttatatacttgttaacaagacagaaacgagaaaggccaattacaggcacatgcccttcacaacttcagccctctcagcacttacactctcctctcctgacacctctcctaaagccacatatgtatcagatgtgtgaggtaccttaaaataatgttggggcaggggcagctctctggcccattctgtttattgacatagctgaaagatttccccccatctatacatttcaatatgcctaatgcttactgatgtctcttaaaaaatttctcaaagagtcctgctcggcctcaggcagttgcaaaaagaaaaataaacttgatgcgttttttttttttacatttacataaaattttttttaatttatattttatttctttgctattacactttaattcttgaaccagggtaactgattagcagattagcagatccaaacaatagagtccttctaaatatgtcctacttgatttttaaggcatataccaaagctgtataacatataaatctagctttctctaaatgattggcaaaatgaaagtttcgctattcatgggggcaaagtagctgcttcgtccacatggtgctagtgcttgctctgtcctgcctgggtactttgctaagatctccagggttatgaggcacggggagaaggcttccctgcccatccatattctcttcacacatttgtgccagcatggagccaaaaaaaaaaaaaaaaaaatcagtcaaagtcaattgactctaatgtttcaataaactaactgatttttggaatgaaaaccaatgggaatcgtgaggattattttttcctccttttcgctcatataaacaaagtttatcatggttaaatgacactgaggaaaaaaatacaacctgtggttcctacagtctccgttgtatctgccctgagtctgttaaaatgtgatcagttgttttgcatcataacaattacaatcaaagtttcaggagagaagaatctcagcagggtggataacccaggattctttaagaggcaaagttagaatctaggggtttcttaatcccgaattcctcggtgcaatgtgaatgcttcccctgctctcctctcctgttggcagctactctactctactctactctactctactctactctgcttttcacgttcttaaataacttgagactcctctctgctgagcgactgatagaagatagtcaccaagatttatgtcctctgtagtcccagaacttcagtgcgcaccaggcaaacagaaaaggagcccaagtcaccccttaagtcccctccactcccacccctgagccccccacatctcaggccttggttgattaaacaaactcttggctttaaaatccaacagtgtatctgcattttcttcagtaagtgccctaaattggtaacaggtgtcccagcatttgttcattatggagtcatccccacctctcctccaagattagaaatctatactaatttttcatcaaatcaactgtttttcatttttaaaattactatattagttttaaagtgtgtgtgtgagtgagtgagtgagtgtgtgtgtgtgtgtgtgtgtgtgtgtgtgtgtgtgtgtgtgtgtttgtgtgtgtttatgaatctcagatgtgttgctatgggccaggaccacacagggcctggttactctgcctacgtccttccttgtctgctgcaggcagttttcagatgccatgtaaaccagaaatgagcttcctgactccatcatgtgagggcatgggtttatctcattagttcactttcaacaagaccaccatcttgttaatttgtgaatgttgttggggccttctttctcctcctttctcctcctttctccctctcaccttcctctctttctattttcccttcctcttcctcttcttcttcctctctctccctcctcctcttcctcttcctcttcctcctcctcctcttttcctcttcctcttcctcctcctcccattccctttccgaactcctgcaataaggtggtttcatttacccgatgccttcacagctgttgcctcacacagttcctataggccaagtgctacactgataaagaagctagagttcacagttaaatgactcgcccagggtctcacagtatttacctccctgggagacgaataggtcactggcctccttttctgaatgaagtcccgaccttgatgagaggaaatggcctaaagtcctaatggctttttaggtggtttctgtataggtcattagaatgaagataatgtggctatgcacaatgtgctgccattctgaaatctctgtgcacacagggccccctcccttatcctggtgagaaggggtgcagatcttatgagccccactcagggactgggctcagagctgtcaacaccttccctgaataactgaagtctgaagtcccaccattcactcttgctcttgagttggttcccggagccttgggcaagtccttagcactctgcatcttaactgaggagagtgactctgggggtgctctcagtgccacatcctcatgagtctccccaatcctcccctccccagaatcttccagtgagccttaacatggagaatcacatgcagactctgccttcgacctgaaaccctcaatgcggcagccaccaccatccctcctctctgccctcctattccttcttcatgcctatagcccgaagtcgggctggagactcctccctcaatcctggctgtcccctcaaccttctgtcacacctacagaaaccgctctgccagcggggcccagaggcaacatggtttgcactatcagtgtcttctcacttcagagaacttacagctgtctgggtataacccccattgtttcatttttgttatacctgaggctctaattttccatttaactgtctcacctccagtcagggtctccattctatgcagatggtatccgggtagcattctggtagcagtggaaaggaaccccatgacatcccataagcctgagtggataccttagctctgtaactgctctgtgtagttaacctagcctatctaagcagcttctcagcttcaaagtgtgcctataatacacacagctactaggagggaattttatattttaaaatatatatatatatatatatatatatatatttaaaagtctcccatggtgcccaacacataggaagggctcatatcagtggaactgaatggacctaaaatggctattgaatcccagcacaacctagatgttcattccagctgtgggaacaactggactgaatccagacctccaatttgtgtgtgtgtgtgtgtgtgtgttggaacagtttcctttgtttatcatgtgtttgtcactgttgaggcttatgacagtatccctattcacccaccttgaaattaaacttcatttgtccacctagctgggattaatacagtcataataaagaagtaataatactacatttaaaagaaacaaaagcatcagcttcagggctggagaaatagttggcagttaagaacacttactgagctaggtaccagcatggcagctctcaaccatctgtaactctagacccagggaatcccatacccattcctggcctctgtgagtactagatacacacaggattcacatacatacatgaaggcaaaacacttgtacatacaaaataagaacaaaatatttcttaaagcattggcttgtaattcaacctggttttgactttatttggctctctttagttcaatctctcctagcagtaataactcaggagttatgtctgggccggttgttttattttgtttttacttctttggattggaaggaaatgaggcaaaaatttcagtttatagcccaggttagtccagtctaacctgtagcatgtggttgattctcctgcctcagtcttttgggtgctgggattacaggaatgaactcgtctgaaactgttgtactagagaaaaatttaaacacaacattatagaagtgatagcatattgttcctgcagctcgacacattaacattacaacatgaccagaagaatgactccagtgcccgaaatagccctccttacaagtcaaaccttcatattttggtatataactaagtgttttacacttatacttaacctaaatgtatttgatgtctaactacacaattatttttatatataaagattttgataaatgaaacagtttttactttaacttctaggaacatacaattttaaaaaaatttgtatgtgtgcatgcttgctgtagaagtgtacatgtgtgctcaatgtatgtgcatatgtagacagataagtgtgaaggccagcaagaagccccaggtgtcatgccctgcctaccttagtggttgaaacagagtctttccctgttctggagcatgtcattgttcatgattggcttgctttgcaaggatgaagatctcagcttgagcgccgtatctacgtaaagtggctggtgtggtggcgttccttagaaaccttgccctgttttttgtatccattcctctgttgaggggcatctgggttctttccagcttctggctattataaataaggctgctatgaacatagtggagcatgtgtccttcttaccggttgggacatcttctagatatatgcccaggagaggtattgtgggatcctccggtagtactatgtccaactttctgaggaaccgccagactgatttccagagtggttgtacaagcttgcaattccaccaacaatggaggagtgttcctctttctccacatccttgccagcatctgctgtcacctgaatttttgatcttagccattctgactggtgtgagatggaatctcagggttgttttgatttgcatttgggcccccaatggaggagctagagaaagtatccaaggagctaaagagatctgcaaccctgtaggtgcaacaacattatgaactaaccagtaccccggagctcttggctctagctgcatatgtatcaaaagatggcctagtcggccatcactggaaagagaggccattgaacatgcaaactttatatgccccagtacaggggaatgccagggccaaaaaatcaaaatgggtgggtagggaagtgtgggggagggtatgggggacttttgggatggcattctaaatgtaattgaggaaaatatgtaataataaaaaatattaaaaaaaaaagaaaaagaaaaagaaaccttgccctggggaagtggaagcaggtagagtcttagagctaagtcttcagccaagcccgtacttggcaacttccaggccagaaagagtatatatatatatatatatatatatatatatatatatatatatacatatatatatgtgtgtatattaagtaatcatgataaataaagtagacagcaccacacatacacacacacatacagacacacacatttgcatgcactgcacacatacaaacaggaaaatagggcaaatcctgttttaataagagagtatatggaaagaaaattaactgcctatattggatccattattctagccagccagtaacatttgtgctgagtctctagagaggttcacagaacaatggctcccagagctcggaacaggaaggaggtgggctctgggcaagcagtgtcgtgtgagagaggatcccaatgcagagagaggctgttgctgtgctgagggaaaagtcttggggctctgactccagtgcgtatgcaccctatgtttctctacattgtgcgtcttaattgctagaaatatttttatgaaataattctgtgcttccttatgctttgtgggttctgatgtgcacgctctcaaatctcacttactctttgaaacatcttgagctattcaaaccatcaagaaactgtctgttgtttgcaaaagaagtagccagccaagcaatgtcttggaaacaagggtcttaactttatgcgagggggaaatgttctttctcattataagctaaaataagaaccgactccaggacagagagggggacagacactggaaagcatggtgaggaagcggcccacagccaacagcgcagcagagactcttggcacgtcagctagtgtaaaccacctcacaggatgatcagatcctgaacagctcttggggatttgagttcccagcctcaagaaggagacatttagttccaccttatgcaatataaacgcacgctgagacacactatgtcacatggcgaacaccgaggccttccaccaaactacttcatgcaagctttgccttggctctacctaactgtgggcctactcatggaacccccttgtctgcaattatcattgtcaagctcggtcacatctgataaaaggtgtttttcacattttggtgtctctgatagcagagcattaaatcttacaactagtgaggtatcttagttcacttttaaaacattctttgctttcttacaaatatataaattgtgaaagtattaactcacgtaggcatcaggaggttggggagatggcttagtggtcaagtggctgctgtacagacacaaggacctgagcgtgggtccctggcacctacagcttggtagtaggcacccgcacacccggtgctggggacatggcaaaaggactgtgcctgggacctgctgatcagtcattctagccaagctggataaggtccagatgattcagtgagagaccctgcctcaaaaaaaactaaaatagaaagcattagaaacaatgtctctctgccacacactaatacacagatgcatacagtaaacaaacaaacaaacaaacaaaccagagacttattttaacatatgaattaaagtcatgatgtcagatcttacccctaagcctggtctgtaacatactgcaagcaggaagtagccaccaacgccgttatatacagtgtgagttttgaaacctttggcatttccctctttagtcataatttattcttgccagcaagctagaagctaatttctttgcaaaaaaaaaaaaaaaaaatccttaggttggctcagcctgcctgctgagttactcaccaatttcctcaatttgtctggcagcaagattctgacccttagggctaaccataccacatggtcaaaataaaggttttgtgacagacagtcccaaccgctctgcccactgagtgccttaccataagaagcctaacccatgaatttgcttccaaggggtctggcctgttgtaggtactgtgcaagtactactagcggcaagccaagagttgtcaaggagtctggactggggagccacacaggctggattcaaaccttgcctttctgtcttacctgtgtgtaaccctgaacaagtgcatctccattacttccatttccctgtaaggcctaaaaggtgctgtgtgggtttgtcgattttcagtggtttgaatgagaatggcctccacaggtttgtcatatctttgaacatttggtccccagttggtaaactgtttgggaaggataaggaggtgagaccatgtcacagggagttggcactggggggcagggggactttgaggtttccaaagcccacagcaagcctagtctcaagcttgtggatcagttataagctttcagctgctgctccagaactatgcctgactgcctgcctccatgctcagcaccatcatcacaaactaactgaaactgtaagcaagcccccaagtccccaagaaaatgctttcttctatatgttgacttggtcatggtgtgtctcatagcaatagaacagtgaataagacaccattgttaaagaagttagatccctcctttattgaacttccaaagaaagacctagactgtccaatgctgggaaactgtcctctgataaagggaatattctactaacttttcctttcagtcttatgattataataatcttaactctaagagtcttgggctgcttgcaaatagttcctctgagatgctgaaaaccgtgtgtctagttgacaaagctggcccactcagtagcagttgtgagtctgaaaacaaaacactgggcaggtccaagattgctcctggccactgctgccgtgtctacgtcacagcaatttatcacaacttaaaattccgagtaacatggacatcagcactcaagaaaggatcatgaggcctcctaggaatggtggtgttgttgtcgtcgtcgtttttgtttttaatgttggatctcattatgtcaactaggctgacctccaactcatagagatccacctgcctctgccacctgagtattggagttaaagactcataacaacacacccagccgactggcagggatttcaggatggccttggaaacatttggcagtaaggatcagtgacattctggtatcctaaagcctgttctggactaaccatggccgccaagcttaggtctctgagcactgaactgcgatgtggcttttgacttactggtcatgcaattctcacaccaaaccaacaccaagtcaagtctagcccacctacgggtgatcattatgtggtgattcacctgaaggatcacaatcaggattccttcttcagttttatattttcttttctatctttgggtttttttttttgtttttttgttttttttttgttgttggtttggtttcgtttggtttggttttttggttttttggttattttattttattttattttattttattttatatatgtagctatctttagacacatcagaagagggcattgatcccattacagatggctatgagccaccatgtggttgctggaaattgaactcaagacctctggaagaatagtcagtgctcttaaccactgagccatctctccagccctctctctttgtttttaattcaacccctaccccaatatcaataggaagagaccataccagaatgtgtttaaactctgatgggtctgatgattggctctaagacccaattctatcactaatcccaaatgttgaatgagattttgtttcgaggtctgggtagccttccttaattctgctgctttgccatctgtagcatatcttacaaggtcacctttggtagggaaagcaagagtcttgttggaaatgaatcttagaaagagcctctgaaatgctctgctcactccaatgattaccttgaacctcaccccacccccagtttgaaagtaactagaaagtggcatcttcacggggtcccaagaagaaactacaacaatgtggtgaaaaacattctatctgccatagctaccaatgacctgtgtaacttctgatgcactgagctaactaactataatgactttagaaaatggttgtgggctgggcagtggtggcacacgcctttaatcccagcacttgggaggcagaggcaggtggatttctgagttcgaggccagcctggtctacagagtgagttccaggacacccagggctacacagagaaaccctgtcttaaaaaacaaacaaacaaacaaacaaaacaaaaaaagaaagaaaagaaaaagaaaatggttgtggaataaccaagagtttcccctccccgctcctgaaacatttacattcccagtcaccacacctgactgtatcgctctctgccttcggctgactctccagctcctacccagcgtatctaagtgcagaactcacgtaggaaagtcccttgtccctgagatgtgacttcagcattatacagtaggagctgagcgaggaggacaaaccaggatgggactaagagggctctggtcctcaaggagccttggtaggaaggatttcaaggttgtgcattagagggaaagggggaagtaaaagatgactccattaggaaggtagtctttctctttctctttctctttctctttctctttctctttctctttctctttctctttctctttctctttctctttctttctttctttctttctttcttccttccttccttccttccttccttccttcctctctctctctctctctctctctctctcacactctctctctctctctctctttctttctttctttcttcctttgcaagcttgaggacctaaatttgatactgtagaccatgtaaaaagacttagtgtgggtcctaggagatatactaccagtaaaagtgttttcctccaggcctgaccacctgaggtcaatccccaaaacttacatgatcagagggaagagaaaattgactccagttgttctctggcacccatacacatgctgtagcacacaggaacacacacacacacactcatgcatacccatgcacaaacaattctttaaagaatggttgtggtggcacatcctagcattggggagaccacataggcactcactgtgggtttcactcaccagccaccctagcctacatggcaagttccagaccaatgagagaccctgactcaaaaacatacatcaatggatcctgggcaacaacacccaaagttgtttctagcctttacctatgtatgagtgcatacacatgcatgtacacacacataccaccatacgtacgcatcacatgcatgtatgagtgagaaagactcacatacacacatacaagagggatgagtcaccaattgtaagttcctctgaaaagagacccccaagtctcaacatagcaactcgcagttaggagaagcagccagcttactccaagactctgaggagcataagcaatgagctatgactcactcattcgagtctcattggtccctcagctttaccctgaaccccagttttctgtcaggttaaagcacctcttgtaagctcttgaccaaggagcaacagaacgggtgctagaccttcattatctagatgctatgttgttgtgtgctggtgcctcacgtctgaggtaggctgaagaacagtaggtctcagggaacaggcaggaagacctcttcagagaaaggaagacctttcctgcttcaaactatgcctcttctcctacctcccatggaaacaggcactcacctcaaggtcacataggattcagtgagttatcattgattctttcctaaacatgcacaaacacccttgcctgtctatttatgtttgccattctagtcattgacagaggagggagagagggagggagggagggagggaggaagagggagagaaaaggagaaagaagagagagaagagagagaaagtctacaggtatccacctatgcatatgtaagattccattcctcatttgggacaaggaggatggagttattttactgagggtagcaaaaacttgggtggagaaagtcagtcagaccacagaccctgcctccactctgtccaaatgaaatctccaacctttttagcttcaccagtgtggcatatggtgggaactgggccgccgccaccatcccacgaaatgagctgagtgccattccatgcagtgcccttagggcatccaaatgcacccagacaaatcaaggtatgtggggctcagcattttacagggcccttgttcaaacagtagcccaacagccatgcatgtgagttcagacttccaatctgtcagaatgcattcccttggagcagtgagcggctgactctccagtttcagcccagtctctgcctttgtcatgatagcacattggggttcaacctggtgaattgtgcagtacaaaagacagtggctcagcatgcctctctgactccagcatattctttaacatgaatttgcctaacatacacgggaataaaagacaagaaggtggagaagttggggttattctagagccagacctgatcctgtacaggctgatttggggtgagttattttgatgtgtctcagtttccttgtgattcaaagggggaggttaatgttgctatcttgaaaacttttttaaagcttaaacaatgtgatcttttttgacacacacacacacacacacacatacacacacacacacacagaaaagtatttgatacctagcaagagttctgttctccagcaaggatgtcaagaatgagggaaagagggcagaagggcagagaggagaaagaaccaagcctgcagttgtaagatggctggcaggcacagagtgctctcagccgtctctccagtccacacaccaaccacggaacagtatccaaacaggccagtgcttagtctccctgaagagtgttaacaggtctgttaggtgtggaatataactggagactcttccttcccctcttctccctttctccacccatcccccgccccactctgtgtgtgtgtgtgtgtgtgtgtgtgtgtgtgtgtgtgtgtgtgtgtgtgtgcgcgcgcgcgcgcgcgcgtgcacgcacacatgcgtacacacacacctgccttatgtttgagacagtggcctactgagtgttcaccaaataagctagtggctgaccactaagtccagagatccccttgtccctgcctcctgagtgctggggttacaagcacttgtggggtagttctgggaatcaaacttgagtattcatgcttgcaaaaccccccagccagatcctgcatgtctggccatcaggcaatgctgacactggagggcttaagatgctacattgagaagcaaaggttttaagcttaccttgtccctaaatgctacctcgactctttcttgagattgagaaaactttgtgagtgactttccatttacctaagctcttccgtcatgtttgtcataagtcaaaaatatttaaactccccctaggggaagttggaggtggttcatggaggggacggggaagatataatcatactatattgcatacatgtatgaatttatcaagcaataatactttaatttattttaaaaagatttagaagtagttactgcttcggagggaacagcatagattaccttgaattacatgaaatatttttaattctcaagttctgagtactttctccttagaacagaaaataagctttcctttttatcattgtttataaaataaaggattgagatatttctgagtggggtaaaatatccctatctacttcctaaactgaaggagaaaagcgaatgtcctcttgcctggcttgaacatttccgtgcagccagggctttgattccaacttaatgacgtatctccaaggagacaggcccagaatgcttcactgatacacaaggcactgcgtttctctgtaaaagtttgagtgttaaggagcttctagctgccaggatgtttccccccaggtcagagccgggccctaccaaacagccacgttggatgttgtacagacttgaagattgtaaatttggcaaagtggcatgattaacctttcaatttcccagctgcagagtgaatcaaggcttaagcctctggtccacttcctcactgttctctcggggccttctacacagaaactcaggttacacagaaatgtcaatgttaaaatacacctgcagcaaaggcaacagcagcatttcttcttatgtttggttttagttttggtttttggtttggtttggtttggtttggtttggtttggtttggtttggtttggtttggtttggtttggttgaggaaagacttcatggacccagactggcctcaaactcactacaccaccaagatgaacttctgatcctcctgcttatgtctcacgagtacgctttaggcatgtgcattcctttaaaggatgagaccacactcacactctggcacggggacttttgagtcacttagactagtctccttatccaagggtgagtttggatgcagacctgcattagagagtagggctcttgtgaagacaaatcagagactggggcgacacagactaagacagccaaagctcgccaggatactgttgagcagaagctgggggacagtcatggaaactgccttgtgttttcagcccacaacactgaaatgccagactctggttgcagaacccacgggcagtgatacctgttatagccactctccctagcaaacagatgcacacctcccaactagctgtgcctgctctgtgtatctccgaactagccgtgcctgctctgagcacctcccaacttgctgtgcctgtgctctgccctacttggctgttagacactttggtgaatcctagtgtaaggctcgggcttgtgaacttgatggaattaaatgtaagaattagagtctgagggtggtatgtgtgaggtcctgattccaatccttagtgtgaacttgagcttgaatactagtatacacgaatacacacacacacacataagaattagccacaagaaatgtggtggtgcattggggctttagagctttggtaatgagatctcttagagctgtctgtggttcgtttggtaaactgtttaaatagcatgcgtggaactctggattccatctctagcaccacatgaaccatggagctttggctgtcttagtctgtgtcgccccaatctctgcctttgtcttcacaagagccctactctctaatgcaggtctgcatccaaactcacccttggataaggagacttagtctaaatgactcaaaagtccccatgccagagtgtgagtgtggtctcatcctttaaaggaatgcacattccacaatcctgttactaaaggtctcattctgagatattagtgccctaggacttgaatatgtgaatttggaatagggagggcactgttcatatcctatgatattgtctcaaccactgagctgtgtgaccttgaaatacaaaagcagccatataaaacatagacagaggcagacataatgactacaccttcaattccagcaattgggaagcagaggcaggaggattgctgagagtctgaggccagcctgatttacatagggagttctggaccaaccagagctacttacttagcaagacacaaaggccctgtctcaattaatgaacacaaggagctgggtcgatgactcagtgattgagagcactcattgcttttgtagaggatccacgttcagttcctattacccacatggtggctcccagccacctgtaattcaattgcaggggatccaacatcctctttcagcctctgtgggtaccaggcatgctcatgacacacatacacacacataggacactcgatcatgtaaaaaaaataaaataaacagaaagaaaaagaagggaggtagaaacagaacgaaaaaggaaggaagggagaaagaaaaggcacacatagcaatatgccagttgtcatggttacttatcaacaaagctctgcccacaaaggaagcgtcaggctacaggcaaaatgtgcacttctgtcagagcctcacaaactcttggcataggagaattaaaaaaaaaagaaagaaagaaagaaagaaagaaagaaagaaagaaagaaagaaagaaagaaagaaagaaagaaagaaaaatttaaacatagcggttttatattttgtgttctggtcttagtggtttgttcacatttaagccttaatgtcttatctttgcattcagatgatatctgcagagttacaattaagcatctcatgtcgatttcccaaggatgaccctgataatcagcccacagtttgttctgccgctgaatcagagagacagagagatggttgcacttaacattgtactgcacacttgaacactgaatgacagtgtgtcaaacactgaccggtgttctggagcttcttaaatcgcttctaggatgcacgtatagttgtcctcatgaaatacgataggtctccttctgtgtaattagtattcccgggttcctttcatggtctgtatcaggctgtgcacagttagcctgggagaacacaagtgctgtctccagggtcttcctctgctccagaatatgcacacacaacgaacaatcagtgccttgcagacttgtctactccctggcctgaaggccacctagtacaaagcatggctatgaatacagcccaacaaatattaggaatttacttgggacatggaatacttttgctatttttcttttcacttgtttcttgtttcttttttcttttttttttttttcttttcataactcaattgcactgttctcatgtgaactttgtagatgataatgtgatcattgtgtctcagtgtcaaaagaccaggtacacacacggcacagagcaatcttcaaataccatccaaagagctgcatatacccagtcattggaagaaatggctttcttctcctctagtgcacaaacagtatagagaaggcagagattttactcatgctaccttggacagaacgagtcaggggctctgtattgggccatgggtgtaagagcagttgaaatagctttcatggaccactaaaatgataactatgccctagagaaaggctatcaatcaggcatgcatgacctagattgtacaaatgtatcaggcgtcatagtcccatttagattgatgtcagttggagcttagcaataccctttaatactgcattgatggacctctaggttctgaactttcctcctgtggatatagaggtacccagactcggggccaagatctgctctaatttggcgtgtgtgctgcagagagacttctaaccgggatgcagggtggagtgaactgactagagatatgtccgagtcagatgctgggctcatttggcttcaacagaggtaggcctagttcactagatcacttgctaagactgccttaaaatgttttaagatatgaaaggaatacccactagagggctgagaggtgtgtcagccagtaaagcacttgcagtacagacatgaagacctgagtttgagccctagcacctatgtgaaaagcttgggggtaaagctgtatgtcattattcccagggctgggtgcagggagtcaggtggatgcctggagctcactggcttgccagtctaaccagtttgtgtaagagactctttcatcatgatgatgatgatgatgatgatgaaaatgataataataatagtaaatttaaaaatacaagtacatgcatctactcccctacacacacacacacacacacacacattaactcaatccacactaaacatatgtccacaacacactcatccacaacacacacacactcacacacatccacaccatgtacacattcattccatcacccattcacacacacacaacacacacacacacgaaaaagacccattaaattatacccattataaaatatgtctaatttaggggcaaatataaatcaggttctcttaggaacttgtaccttaaagcttttcagtttgcacaaagactttcaaacactaccagctgcactggtgtgtatgaaatgcttcctaaaatattaagtttgtgctttgaaaattgtaagcattttaagtcctaagaatcataattgaaatgcaattgttctgtgtgtgtgtgtgtgtttacactaattctgtttcctgattaatatgcctccccaaccttcaataatgcaagcccaaatctgtctgtgcattgcaattacttatgtaactgcaaacagttgtctttggattcccaagataagatttcacaaatattatagccaccactggctgcatggtgtgtacagcaaccaggaggccgaggctggaacccctgaagtttaagaatgacctgggttacctagccagattctatctcaaaacaaaatacagaaacaagaaaccaggggctggagagagggcgaggggcagggagtgttaagagcactgtctgctcttccagaggagtcaggctcaattcccaaaacctacatagtggctcataactacctgtaattccatatccaggggacccaattatcatgggtacatgcatgtggtgcacagataagcatgtaaacaaaacacttatacacatttaaaaacaaaacagaaccaaaccaaaagaaaccccactaaattgttttaatctaaaaactctaaattccttttttctttgccttacaagggcaattaattaggcaagtgctgaaccactgaattacatccccagattttattatttttcattttactcgtctttatcttaagacaagatctcactaggttgcctaagctgacctcgctctcaccctgcagcctaagcaagccttgaacgtgtgactctcctaagtagctgggaccactggcctgtgcaaccagatccagcctagaaacgctttaaaatctctcttatgtctcccatccacacccttggatgcttacatcctgtgctaagaattgtctgcatgttgttcggatgtgcaatttctcaaagttctttctagatttactccaataaagggaaagataggcttcgcatctttccagaactaaacaggcggtagagctaaatgactttttcgtttcttttcaacacttacactaggaaatgaagcactagagcgagcctgtcaataaagagtatcgacaacattaataatgatggcaatgatgataatgatgaattatcataacgctcttctccttctaagcatggggctgaggcccggtgatgaagccgctttcccaagagcagggctcctcaatcagagatggcctctccttcctcacctcttctttcggagaagaacaaatatcgctaatgtcctcctcgccaggggaaagccacactggcccattcaatggccaattagaataaattgtaaattagaacaaataggacaggtaatacaaaaatcaaaagctctccaaagaaacggaacaaaaaagctgaataaataaacttaacattccattgtttgtaggggaaaatgatgaaattatcatcaaaatattctacaatttgaaagggaagataaatttttgtgtaaaaaaaaaaattgtaaggaaaaagaaacctatgtagaaaagtagacttctagaattggcattagtttttgtaaaaggctattggtatttttccattaaaagataaacttatgccttgtgtgtgtctcacagtatcgggatttgtcgggctaacccgtatttaagggaatgttcacacgagtgtttggacattaacactgtccactgtgtctctgagagctctctgatcacccagggtttgaaccattgaggtaaaaggtgttctttctttaaaagcaattttagggacacaggcgcgttgcataaataccacgtgttaaaaccaaaattcacatcccaaaccggcctctatctccttcctgtatgaactctgggtaaggtgtctctacactgggtagcgcgagcccctggaatgcaggggggtcttcgtgtggtcagtgtggctttcagacgacaccttcttctattgatttgttttctcctgtctcctttctccccgcttttgtttccttatcatagcttcaggttattacgtgcggggtattgatggggacggatggttctggtcgatggctggctaatgcatctctaatcctgctattgttacagagttatgctttcctctgctctctgatgggggaaaggggcaaagctgttgatcctagttttatttgtcgcaaacccatccatcaatcaagcgcgcgcacgtctgaatgccgaatgacatgtgggtctcagctgaaaacattcgataaccctgtgttgtcaggtctcttactcttttttttttttttaaataagaaatacatttgactgaaatagataagcaagcactactaaagacctgaagagaggatgacatatagcagaaaaggttgcatatctttggtattaatgatgctatgagtaaataaaacaggaggggcacctgccccagagacatacaacaccccaaggctgggttatgattaagggttgtgtagtttacggtcactcccgactttcaaatgttagctggccatttcacagttagctaccctggctaaaatgcatgccagttgatgaaggtaggtagggttgggacagaccccatttgtcaagtatggtgggtaaatatcatgaaatatttctatgaatatctaagctcatatgttcacaagtatctcctgttatgagcagaagcattgagatggggttaaactttaattattttaaactggaaatatatatgcatgtcatcttaatagtgacttaacttataattacagactcaaaaatggattctacgggtccccgctattcaacttactaaattaggtactttaatacattacgaaagcctgtctttgctgttatatccaatattctattcatggttatttcaagataattgcatttggaaacagttaaaacattaaaaaaaaaacacaacactggtataatataattttagaagcgaagttaatcaacaaatcaggacatttttaaagctgttttattccattgtcatatgttagagaagtggtttttaaatgaccgcaaaccgcacataagaaaagcaacaaaaagagagtcgtggactggaggcctcaacaccatttgtgaccttgagtgtcctgcgccttaagcgacagccttccccactgttctgttcagagatggatctacgcagggggcttttgggtctgctggggagttccatgcattcagctgcccccattaggcctgctctctgctctgtagaagctgctgggagatgctgttccaaagtagaaattcttcatgtccactcttggcttccatagatttaacagaactcgcactgagtccacaatacagcaacctgagtgagtgtacctctgcttccatagacccgagcacctgagcgacttgtgaaattaagggaacactccccaatttgaattcatggtaggaagcagaaggagagaaaagagaggagaaagagagaggaaagaaggaaggaaggaagagagggagggagggaagtaaggaaggagggagggaagaagggagggaaggagggaaaggaagagggagaagagatcaagtttaatttccaattctcactttatggttttgtttctcttgtttatgtaacatctttactttctgtttactgaggccttggggagttgtttcattccactggtttcttgtttgtctgcttactggctgacctgctggctggctttggagacagaatctcactacagagcccaggctagcctgaaactctgtatataggccagggcagttgagaatctcagagatttgcctgcctctgctttctggatgctgggattaaaggggtgtgccacaacacctgactatataccatctttaaaaagatattctaaaccaagctcagtgtggtggcatgtgcctagaattctagtactcgagagacttggaaatgtgaggccagcctgggctgcctagcaagatgctgcttcaaaaagcaaagacaattgggttgagggtgtagttcagttagcagaatgtttacctagaatgcatggatccctgactttgatccctgacatgcgaaaaccaagcaggaccttggaacctccagtgccagcactcagaaagtgtagcaaggaccagaggcttgcagttacccttggtgttcagcatgtcttgctttactgcataggatgtggaggctgctgggagttctgattctggctttatagagcatctgaagccatcattggggatcagtaaggagtcacgtacccgtgaggtggctgttcctcttgacaccgcctaccacttgcactacacacaaagcacatatgcataatatacacacacacaaacacgtgtgccaaacatatacaccacacacacaaacacaccacatatatactacgcttatacacatacatatgtcccacacacaccatatatatacatatacacataccacatacatgtcacacatatgctacacacacacaccatacatatagacataccacatactcaacacatgcatactataccaacacatgcatacatgccatatatacataccatataaatacacataccacacatactcactatacacatatcacacataaacacacagcacatacatataccatgcatacacatacagcacacacatactatatacacacatactacacatacattacatacatgcacatacagcacacacacaccatgcatgcccatacagcacacatattccatgcatgcacatacagtacacacatacagcacaaacacatacatcatacacacgcatacagcatacacgaattccatgcatgcacatacagcacacacataccacgccttccatacatacacggtttagtgagttttcgctttaggaaggacgttagtgatcatgctatttctctgttggtgcaattcactatgtgctcatcatgaatcgtaactaattaaagcctgcctgctcctgactccccccatcccactcctcaacggcctcttgcacggaagtctgccctttatgttgagttggtttgccatcctttctttctccagctgagtcttctcacctggatgagctcctgttctgtcatccattttcctgtcaatagagtaatttcactatttacggctgaataagacattatgttttatggcgtatagtgtatgcatatgtgtatagacatcgttttctttaccttctcatgtgatttcctgtcttggctttgtgagtggaactgggtaagcaggtgtccatgtgtatctctcccatgctgacttcctacttagaaacaaaatcctggaacttacggcacattactctgcatagttgttgaggcctgattcttgtggatactgagttagcctgttataatagctgtgtttttaaacagaattcaaaatgttccctccagcagctgaaagtctaacaccttaaaaagggggggggtgcaacagttttatacaaaacagtcgattctagatttttaaagcagactaaagaaacgtatttctctgataaagcttaaaaacttaaagctattgcatgacattgttccaatttagattgtgaatttcctaaattgtataacagttaaacaaagaagtaaactagcatggagctgcctggggacactgcaaatttttatataattaaggttatataattaaggtatattttatgttctgtgcatgggtgttttgcttgcatgagtatctgtgtattgtgtgcaggtagtgcccacagaggccagaagagggcagtggttcccctggaactggaataatggattattttgagcttccatatccgtgctgggaactaaacccaggtcccctgcaagagcagcttgggctcttaacctctgggtcatctcacaagacctccactgtggggatttaagtaaacaaaatgctcttccccacgtaacagctgtggatgaaaaattagatggagcaagaagacctggatgcctttatcgagcagggtggttccaggcaacagtaaggtgtggtacagttcacacaatgagacaaaaaggttttttaaaagttttaccgccgggcttggtggtgcacgcctttaatcccagcacttgggaggcagaggcaggcggatttctgagttcgaggccagcctggtctacaaagtgagttccaggacagccagggctatacagagaaaccctgtctcgaaaaacaaacaaacaacaaaaaaagttttaccaacaagtatagaggcaggagaattactgaaagttcaagaccaactggtttgcatagcaagttctattccagccaagactgtatagagacactgtgaaaacaaaaggaaaataatacaggccaggcaggtggtatacactcataatcccggaagtggaagcagaatgatcaaaggccattctcagctgcatagtgaatttgaagtcaacctgagctacagtacatgagaacttggctctaaaaggcccaattaataacaatatgaataataacaaatgtttaaggagagttacaagtttaagtcaggtttaaacattgtatacggtattgaaacactctgttaccttctgatacatacagtctttatgtttttatcaactaagcttaacttcaaaaataaataagactggtaaaccaatggagaaggcatttttgcagtgtcttataaaatgcaagccgtgctcagcccaatgacctgacagttccactccatgtctcctgagaaactagaacacacaccagggacagaatggtagaggtcacaatggtggcttgtgtcatgaaaactctggaagcttggcagcaacagacacttgattgaactctgttggagtcattcctcaaaggtaatacagagacaggaaggtacaggtcattcctttgttctattaaaaatgatctccaaaacatagcactcgctggggtaagggtgggaggtagcaggtttcagtatgtaatatacacccgtgcacacatgtgtgaagccatatggccagcagggacgatcatgccaatgcttattagtctatacatcaaaccatccaacatatatttctaatgcattaacaacttaaatgtgacatcttagaaatcactaagaagaaaggaaaaagaatccagaattttatttaatcttagcatgaaacatctcaagaaatcaccaagagaattactcctagcatgaacttcatgaggaaataacataaagttaaaactggcaagtaacagtgtaacaggaattaaaaaaaaaatcattgtgaaagagtccatcagttacattaaaatgcccctacctgtaccccagagatacctacctttgcacgattctgccacagaaagaatcattcatattgtcttgacattgtgtgtgaagcaacattcaacccagcagtttgcacacagcaaggagagaagcagaccctgaagcaaaggaaacaattaaacagacggtgatatgtctgcatactaaaccattgtgtggctattatgatggacaatgttggttttagcctgtgtgtatatatgaggtactagaaattgaacccagggctgcctaggaactaactaagcactctctaccgctgagctgtgtcctcagccccagtgttaatctttatgaagtttcttatataatttccttcaattctctaaaatatgacttgaggtacataagaccagaataccctttaaattcatactaaagaaggtcgctctggaacctggtgaagcaaagcccccatagcatacaggttgacattgctgagctggggctcttggagccatgtgcactgacaaggaaagataaagctcctatataaagaaaaggcagcaggctgctgggatcgctcagtgggtaaagagcctgctgaggaagcatgatgaccgagttcaatccctagggcctaagaaaaggtagaaggagagaagtgacccctagagttgtcctctgacctctcaatctactctgaagcacacatccacttcacacacatggagaaagcagtgtcgagtacattccttatctacccacacattgttcatctccagatctttatctggtacataatacacacattgtatatataataacttacccctgcttcctccatgcatgtgaaatacatgtcatatataattcatatattatatatgtacatatgaatataacatatatgtgaatgtttgaaaataaactatagaatagaataatgttggaattttaaaaataaaataatttttgtcatcgtaacaaacataggatctggggttgaatgagaatgggctcatagatctctagttggtgggactgtttgggaaggattaagaggtgtggccttgctggaagaagtgtgtcactggtgggctttgaggtttcaaaagcccagccattcattcccagttagctctctgtcttgtgcttgtggatgtagatggaagttctcagctactgctctaacgccacacctctgtgcctgctgccatgcttctcaccatgatggtcatgaagtttcaccctctggaaccataagccacagctaaagcactttccttagtaaattgtcttgttatggtatcctatcacagcaatagaaaggtagtattcagaggcttgctatgcctcagtggtggccgtatatcaggcagtggaagatgttataagttagaacctgggaaggcagttgcctttaagagtgatggaaactcagtaaactggctgagatttatgactggactcttgtatgtatggtagtactcttgggaaattccaacactctgcttaggaggctgagacaggagaattgtaatgagtaccaatccacactcattggagctacataacaagactaaataaataaataaataaataaataatccgttaaaatgaaaacacagaataaagctaatctcttttcaggacctaattacccagcaactcaggttctgctttcaagcatttgaagtctcgtatgttcacataaattacaggtttcctgacagaaaggatgaacctgtgcaagctactataaccctattgtctgcattttccaaagactagccttagaagcccgttcttttcagcattgccaccctgggggaaccccctgggctggtgggctgagcctgccagttcaatggatggagtatgtgcttgtcactttggggggtacagctctgcagacaaagtcaccatggagcccagcccccaatccaccacaggcctatcaggcatgctcatgctctgactgtttcttttctctacattggtttttgtttcaacaaaaaagaagaagaagaagaagaagaagaagaagaagaagaagaagaagaagaagaagaagaagaagaagaagaagaagaagaagaagaagaagaagagaagaagaggaggaggaggaggaggaggaggaggaggaggaagaggaagaggaaagaggaagaaagatcacgttaaaatggatatccgtgatccagagatttagctcaattgatagagtgcacaaagccttaggttttgtcctctgcaacacataaagcaagcctggtatgcacacctataatgccagcactcaaggggcacaggcaggagaatgaggagtttgaggccagctcagattacatgaaaccctgtgacaaaaaagaaggagagagaatatcagcaaagttcaaaggcagatgctggtgtgactgaaaccacagtgggaaagatgggaatgagcagaagaattcctgtttgtgtgtgtgtgtgtgtgcgcgcgcgcgcgtgtgcgtgtcagtgtgtgcatgaatgtgtgtttgtgggtgcacgtgcgcatgtgtgcatgagtgtgtgcatacatttgtgcataagtgtgtgtttgtgtgtgcacctgcatgcatgtgtatgagcacatttgtcgtgaggaatgagagttaggagcttgcatggccaaagcacgcatcaagcaacagttgagccaaaaccaatgagaatagagacaaagttgatcattttatagtacagtatgagatgtagctcaaacacagccatgcgtacaccttcatgcctgaactttgcacagctaggactattgtgttccttatacacatgcatagattcccttagatgaacagcctactacagaatcttcagcctcgccatgttcacattcaaataatgctgtctatcaaagccttcacggctaagaatcaacattagatccttctcctttggggcctgctgacctcaagacccaggtcacagatttcaagtttccttgaactattgctctggagcaaggcttccccaagtgcacacctcccatccttagcttagctgcctctgtgaacactaacaattgagaaatcccagcctgctgagtttcagtctctagggacaaggattggaagtgataatgagcttgctaaataatccttgggaaattcaaggatccaagcctgggtccatggcacacatgacgtgggtgccagctgtatacagtgtatactgtatacagtatagatgtcaggttcatgcccattggctgaacagaacgcaacagaacttgccttgaaaccaaacatttctttcatttcctccagagtgcccatgagttcctactttcaaaacagaggtcttggggtcatccagtaagagcactgactgttctcccagaggtcctgagttcaattcccagcaaccacatggtggctcacaaccatctgtaatgggatctgatgccctcttctggtgtgtctgaagacagctacagtgtgctcacatacataaaataaataagacttaaaaagcaaacaaaaccagagatattggcactcaggacagggaggctttcttagcaacgcagattagatgcccctgtacacagaagaggaagttcttaagctagtgaatttagacaatcttttctgaagaggtggtgagagtgtcctctttaagaataaagagactgaagttcaaatccagcctagcagccttgtaagtgttgcttaagatctccaaagctaacttcctcatctatacaataaaacaaagaaaaaaatgtttcagatggcaatgcttagtgaatcagtctgtcctactctctgggagatgcaattggcttctctcataatatctccacctagctcatctgtgcataccagccgtgcagcaggaactgtttcttcggggccatggtggcctcttagggtgtggccactaatttctagtcactgtccatgcttttagccccttctttccatctccatgttaggtgaagaatgaaacccgagtcttctgtgctgttcttgactgtcagcgatccatacaaagcagagaggccttcaaagatcagtgtgtgtgtgtgtgtgtgtgtgtgtgtgtgtgtgtgtgtgcgcgcgcacaactgtacattgtgtgactgatttcgagataatttgaatctcaactaggcagattgaagttttttctttgttatttccttgtatatgtatgtggggacggggtggggagacggtgtctctccttccactgggtgggttccagggctcacactcaggtttggcaagcttggcagcatgtgtctttacttactgagccatcttgcaacccctcaaagtatgtttttatttgaataatagtgtcgggtagaagcctcatttcttctctttccattcacattgactcaaaaccaaatttctttttgcattcggcaaggttagaagcactctctcctctcctctcctctcctctcctctcctctcctctcctctcctctcctctcctctcctctcccctcccctcccctcccctcccctcccctcccctcccctcccctcccctcccctcccctcccctcccctcccctcccctcccctcccttcccctcccctctcttcttttctccttctcccctctccctccctccttcttccttgtgttgtcctctctctctctctctctctctctctctctctctccatcatcccagccccatcttgctgagtgaatacagaaatcagcatggcatcttgttgaaatgataaagtagtccaaatgctgcataaaagccctgattccgctaaacctatctatctcggagtccctaaaaggtctgctaaatctgcaagggataggatatctgacgatctcttttaaatggaaaagacttgagaaatagcagtcttttttgccatcttatctctgtaaagggaaaaaagcaaagcctcccatagcccaacaggttttcagaaataacaaggaaagcaaaactctccacggttcttctagaacagcaggaccttgatgttatgtggagagagcctctccagtagctgcaagtctgctcagaacttgggattgctgttctgtctctcccttccaccctttgccaggtctttgtttgtttcattctgggttttggaaatgggcataggaatccagagctttgcacatgttgggtaagtcattcgccactgagctacaccccagatactgtgcttctaactctgtaacagctaatgcctgcagagagggtggtgctgaggatgggccaacaagtcctcttctccattcatcttgtgtggcgtgtttagtggtgacacctgctaagctatctgtcctcagagcattgaaagggacttcgaaggcctcgacttgtttactagtcagtatcagctatgcagagcatggctcaaatgaagtccccaaatagccaagatacacagcaacatttactgcctccaaaacacagaataggagtccctaggcctgccctctgggctgcctgaaccatgaaacatggctcattaacacctgtgcttaacagaattcaacctggtgctccaaatcacaagctgcatatcagaacatctaatgagcatggcagtgtcagaaacgggagagactcatggttgctcattaggagacagacagaagaactccatctcccatggcctctaaaggggccaccgctccatacagcacattaaccacactcgtcactgttaccctgagtcaccaagacaagaggtcatcttctaagcagagcagcaacccagagatcctaagaggacttcaatgacggaatttgacctgtattgtggtcctaacggccctttgccagtactgagaccttacaccaattattcagccccttgtgttgaggagttctgccccttgtaggcatatcatctaaaggagacttccttaagtcagagaaattggcaagtgtcatcacggcatggaatgaggcagttgagccatcaacagcccttatttataatgagaagttctgtgcatcctaagaagaagaatgttttctgtgttggtgagagccagtccaggggcaacacacatagggactttcttcaggaggtgctggctgagcaattgatggtagcaggtgtcagggctcagtggaagcagaggcgcaaagatagaatagccacacacagctcaaaagcaagaagattgaatagaggatccaggccagatgggcaggaagagatgagcttaggatagaaagaggtttctgacaagaacaagactctcccagggcctggggtgcagctcagaaatagagcacctctctataactccaaggccctaggttccctcctaggcataagcagcaagaccaccaggagtgtccttacctatcgtgagctgggtccttcacatcagtcatcaaccaagaaaatgccttaacagacttgcctacaagccaacactgtggaggtaatttctctcagttaagatcccttcatctcagtggtggtggcccacgccttaaatcccagcactcaggaggcagaggcaagcaagctctgggttggttcagagccagcctggtctacatagtaagttcctggacaactgggactacatcgagagaccctgtttcaaaatgaattagttaatttaaaattaaaatctttccttcttcccagatgactctagcttgtgtcccgttgacataaaagctagtcagcacagatatcaaatatatattcaagaaaaaaatcacagattaggctggcaagatggctcagtgaataaagacatcatccaccaaacctgttgacttgagttcaatcccaggggcctacctaaatggtagaaggagagaacagattcccacaagctttcctctaacctccacacacatggcatgatgcatgcacgcagataccccattcatatgtgcatgcataataataatttaaattttaaatgtaattttactgtttagtttgttcatttgtttacttgttttgagacatattctttctatgcagacctggctggtctgatgctatgtaggcctgatttacctctaacttgaggcaatcctcctgcctcatcctgactaccacaagctttacagatacatgtcatcagacctagcaacagaagaaactattataaacattttgatttgggcttttttgccatacactttttcagactccagaggatactgtttctgtggccctggtcctgaagtctctgtcccaccgtcatgctgtgtaatcaaaagtgtgttacgcaccacttggagggtgtaaatattacacaaataccacagatttgagccccaaagccacaggactaagtagggaccctgccttacctctcttcagctgtggaagtgtggccagttcacccacagctctgtgcccacctcctccttgcaagtgtaatagtgtaggcttgcccacaccatagctgtagtgtgaggattaaatgagccaccacctggaacacttgtaagcgcctggcccatagcagatgtttaataaatctttattattgctgccactcctgtgtctgacatgagccatttaggttgctttcagtttgtcagttacgaatcattctgcaataaacatctttgtagcaaatggattttcaaagagactcctcgtgatctgaactctccggctgcttattttgtttgactgttttcagttatgaagcattgactaagctatttgcctggaacctaatccatctttttttttttcaaaggaagaacaatatatattcctattgttctcttttttgcattgtaaaacactatatacaaagctatgacacttagtacatcgcaacagtgtacagtactccaatatgtcttcaggcgtattggaatccccaagattgtcacatagaatacatgggattaaaaaaaaatggaaaagtaagccttgttagcattgaaatgcctcccattaaaaaggaaagcaccaagctggagagatggcacagtgggtataagtgctcaccgtgtaagaatgaggacatgagttcgaatcctcagtatggcagtacactcccataaccccagcactggcaggtcactgggccacgagcctagtctaaacagctagcgccaaaggaagtggggaagcaattgaggaagacacaggatgtcgacctctgacctacatacagaaactcacagctacaaatatgcatgtgaccatgtctcagagctggggctgggggcagggggattggggtgtagggaaaggggaacacatgggattcagtcaaagggtacagaaatctaactcctttctagggcatcctgacctaaccaagcctcaactataggaagggaggaagggcagagggcggagggaggatgtgaccagagtatattttatatggatgaaatattgtcaaagaataagtgggtgttttaaatcttcattgtgaattcatgaaataaaaatgaagccttcgaggcctgtttctactgtgtctgaaacagaacagaggcatcctgaaggagttcccgtatggcaagggggctaacagcaattacttcacaaagaccacacgtgatccctgtcaccctccataagacaaatgagactgagagtaggagacatagaataatttgtctaaatgccctcagctaagacagaatagacaggggtacaactcagaccccagtccccagtaccgggcccactttccttccacagactttgctaaagtgagcgtgtgatggtgtcacagaaagcaactctgaaagccacagcagaaaccacagcgaaggccctgccgaaaggacaaggacatccagcaagcacacttccacagctggtgtccatggggacaaggtctaacctcagatcctcttctcacctccagattggctgcctcagtaaacccaggagagccatggtgaccacagtagctttctcttcaaaatgacaactatctcatctcttcagactaaattaactccatccacagtcagaagaaaactcacaaaatggtggtcaggaagactgatctctagaacattcacgggacgaaaggatgagagaaaaaaggtgtgacaggtgacgtttctcttttcttccctcatttgctttctgtcatgatttcaatattctgtatttctagaatgttctacagcttataaatagtaaatttttaaaaaagtcacgggatctcagcttggtctttcaatacactagagatatggacaaaggtgggtattagagaagcattttataacttttaagatataagtttaaggcttagaagatagctcagctcggtggttaagatcttatactgcttgttaggaggacctgggctcagttcccagcacctgtatcaggcagctcacagctgctagggattcaacactctcttctggcctccatgggcagcacactcatgtgtacagatctctttctctctctcacacacacacatgcacaaatatacacatagttaaaatttgtgaaagtatttttaagctataaatactagtagttattaaaaccaagaggaggtaaagttctgggtgtacctggctgtgattctcatataggaacccccagggaattcctcaagtgacaggctgatgacactggtgtttaactagtatgatattaatgttcattatatcattgctgagatttttttttattctggactgtaagacctgattttctaataacctacagaatataaatacttagttgataaagtagttttccagggaaatttttaagaaaaaaatatctgaaaccttttcttatgcaattagggaaacatctatcaaggtcaccctgcatacatttcactctgaatctatgagtgaggtaatgatatatactctcacatgcatggggtagcaaacacccaaaatcactcatcaaattatcataattgtaaagagttggagataatggaaatgtcctttaataagaagtcacttaagtgaagtgtggtggacagatgtctcagagtataaagccataggaagaaagaaggcctcagcaggcatctctgacctgggcttcctgtggcctaggagagctacagatgcagcccaacacaaaaccgtaaacgtgcttctaaagaattggaatttcttgtgattttcctaacttagctataacattgtactacaatgtcaaaaacattgacacttatgggggtctgaatcggaatgtgccccatgggctctcatatttgaatgcttgggccacagttggtggaactgtttgggaaggattaggaggtgtggctttgttggaggaagtgtgtcactgaagtttcaaaagtccatgcctgtccagctagtgctcctgctttctctagcccaaatactacatatgtgtacacacacacacacacacttctctagaaataaaataacgtccccataagaagagatacaaggtgtgtgtgtgtgtgtgtgtgtgtgtgtgtgtgagagagagagagagagagagagagagggagagggagagagagagaagtaaggggtaagagggaaaaactctgatttggattttgagtggcagaaaataagttagattaaataagtttaactaagttagataaaaatgactaatattcttgaaaaaaatatagttaggatccaaaatctgcataatctttttataaatattttggaaccagagtaacaaatttctttaaaaaaaaaagtcaaatcaacgatgaaaccctttgattatatatgtaatatataagatgaaaggcaatgttggcatgcaggagagaggtgtgaagattgttacaagttcaaggtccacctaagctacacagagagactctgtcttaaaaagtaaaacagaagctgggcatggtggcacacacctttaatctcagcactgggaaggcagaggtaggccgatctctatgagtttgagaccagccatattggctctacattatgagttccaggatagccaaagctacatagtaaggcgctgtcttaaagagtcaggtgtgaggagcagctccatttttgacccttcacccagttggaaccatgccattgggtcaccattctgtatctgaccaattagaataagcatcattatatgactattaaagaacaatgattctcttacgaatttaggggacacctatcaagaatgaactgggttccttttttttttttctttttaatttagtattgaataaagcagacatcctctctgacctcctggatggttctggtacttcggctattaatgaccaaaataaaaaaggcctttttagcatgatccatgtggctctcaatagctgctttcccagctccgtaaaacagtaaacactggaaacagtgggccagctggatatgatttagtgttacacgaagaagccctggggcatacattgcttattctctccatacatgagcaaattctgtttcagtgggatatggatatgtaaacccagtgtagactgcctccactatggctcattttcctcccccaccacagccttcctcagcgcagaagacaaaaacacacgagagccttcagcaaggttcaagattcggtaattagtggttggattaaatgatagatgtctgcctataagctgcactctatttttagggagttttgaagatgtggcttaacacttgtgggaaaacgaccgcccaagtccttgtagcacctcattagcatacttgttctgctttgagtgtagacatgcaattgtacgtctctccaaactacacagtgcaatttggtgagaagggacgtagaggaggggttcaaagtactgggggtagagaacaaggaagcgaagccactgagagcaacttcagcctcaagagcctcctttgctcctgagagacgtcacgctcaagatgcaagatgttctgctgagatgagagtccaggctgaagatgagagagagcagactagggagaggctgaaacggctgaagtcaccacacagatgtctggcgactcacgggaagatgtgctggaggtccgcttcctgaggagcctgaagtattcgtggatgaagagccagtcagtcacaaaaacaccaccagggtcgtgagctgaccccgcagtacagacttggaattccagttacttcagacgccaggatagaaggaccatcatgagttcaaggccaacctgggcaacatagtgatagtctcaagaagtgtaaaaagggctgagggcagagtaccatcattcagtcctgataccacaagaaggaaaacaagagagagagagagagagagagagagagagagagagagagagagagagagagagaaagagagagagagaggtctaacccgactattctccatgctcagagttgaataaataaagtacatttctagctttatttccagaatttttataaacagttgctgtgcagtgcacttagcaggtacgcacaagttttcccctcactaggcctgtggaggaacaacatagacttgaaaaacctgggttgaatcaaaaagagatttttcaatgtgttttagactttcaaacaacacatagaaaagggagctggccttgttctgtgcatatcatgacgctttctttggcgtttccctttttattcattttttatgtttttatctatttatttattttttaagttaagagactctctcataaagcgcaggtcacccttgaactcttgatcccctgcctcaaacttcccagtgtgaggatgacaggtgaccgccaccccaactgcttacagccaccgtttctttccactgtcagagaggcagttacaatttgaagcaactgtgcgtcgccgactttatccataaagaattccagcctgcctcacagttttcaagaccacacactccgagaggcggagcgcataccaagcagatcgctggtgagtgccgtacctcacgcactgacgcacagctggggtgtcctacatagcacatccacagtgcgtgccaaatactctgactggaaccatggggaacatccaaaaataagtcaccaagatacccaggcaaatcctttatgtccttagaatagtatgttcacacagggggaaatcaagtcgtgtaaactaaagagaaggggaagcaagctctcgtggagctcctgaaggctgatctgacagtgcacatggtacatacctggtaacccacactcagtactcagaagcctgcagtgggaacattgtgagttctagcccagcctgggttacacacttagatactttgggctttttggttttgtttttctatttttctcctattgaaaagagttgtttgttttttcatacaatagagtgtgattagagttttcgctcccccaattcttctgagttccttcccaccttttctcccatctggagccacaccctcctgtgtagtggagttttctgtgaaaggcagaggacctgaattcaactcccaagcacccacataaaggtccagcatgtctatgagtgccagtgaccacagagccagggtctggagccgggcagatcctaggagcccactgccacctgacctaggcattttggagtttgagattctctggggaccctgtctcattaaataggacaggaggggacaggaggagacacccagtgtactccggcctcaacatgcataagcgcgatgaatgcattcacaacacatatatacacacatacacacatatcatacacacagaaattaattactacattttaaaaataaggatgaccccaatacaacaaagttcagagcatcaaaaaggtcttgaaacaaagtcttttatttatttatttatttatttatttttgagatagtatctttttatgtagaccactatatcaaccaagctgaccttgaactcacggagatccacctgcctatgctaggattaaaagtgtgtgccattgtacccagattgaaaaatagtctttatgaaaagagattatcaagattatcctgggatggggctggagagatggctcagtggttaagagcacggattgctcttctgaaggtcctgagttcaaatcccagcaaccacatggtgactcacaaccatctgtaatgagatctgacgccctcttctgatgtgtctgaagacagctacagtgtacttacatataataaataaatttcttcccaatgttatttttggtaattttaaggagctgatggtgatttgtgattcatgagtatgtaaatgcagatgaagttcttcctgaaaagagaaagttaaggaaagctgtagggctgtgtgtttgcttgttgctttgttcttagcctgttgttacaggctctggatgtgttagcccagaataacccagaagtcaagcccctccttccttagcctagccaaggctggggttacaggcatgacccaccatgcctagcaacacttacagtctatatggaattaagatttttctacactgtatattctttttaattatgcataattttatgtgtatgttgctttgtgggtttttatgtaacacttgcacacaggatcttgcagaggtcagaagagggcaccagtcagcaggaactggagccacaggcacttgtgagctgctgtgggggtgctgggaatggatgccactaaccactgagccatctctccagacctggaaatatcaattctgcagccccattatcacataaattgtagtgacaggaagttggaatatgaagtctcaagcaaatgatcctgaatgtcaccactggcatcatgaatggggagagcagtcagtagcaaacaagatcatgctggattaaaggagtccctcgaggctgtggagaggctcagctgggagagcgtctgcctggccgggatgaagccctgagtttgagtcccaggaccagaaaagaagaaaaggaaaatcttgctgggtagagaatggtagtccacatccttaatctatccctagggagccagagacaggtacatctctgtgagttcaaagccagccttgtctacatagtgagttcaaggacagccagggctaagtagagatatgctgtctcaaaagaacaaaactaaacaaaacaaaacaatcttaccactacttccaggagaaactttaataaaaatactattttagatttatcttatgctatgtgtatgagtgatttgcctacatgtatgtatgtgcactgtgtacatggcttgtgggtgtgggagccaaagaggaagtagacctaaggataattgtgagtcaccaggagagtgctgggaactgaacctgggtcctctgtaatagcaacaagtgtttcaagtattcttaactgctgagactggtatttcagaaatcaaatgggtctatcctgttctcctcagacagcaacttgcaggagcttctggcagttctaaggctgctcattggaggtctctggcatatgtgagaactgtaaagacccgatgtcacacagtatcctttgcacagtgaaacctgtgacctctctactgcactggcttgactgtgctccccaaatgcactccaggcaatggcttcatgagccactgagacattctctggcaggcaggcatgtactgttgataatgaaaaggcctttgacaagcgttttcccaggctgcattcctgctccccctaggcctgagtgggtgaccatctccgcacaagattctcattcaagaactttccagcactccatgcttgacccaatccatcctcagaaacatctgtgaaacttcacagaggcagaagtaggttgtgagctctctgagaggacctcccattctcctagacacaaaggcttatctccactgcccagacacgaagtttaacctgaacttaaactctgacaatcagagtttgatcctaggaccccacaaagtggaaagagagaactgactccaaaagtataccatagcatgtactctgatgtgcacacacacacacacacacacacacacacagagagagagagagagagagagagagagagggagagagagagagagggaatatcagtagtttgatcttattgtatgggagaaatgtaaaagcgttttgaccttgactttattagttattaaaattaggagttcataaggtggtaattttttttacttagagataatttaatgatgcagaaagatcaaaagtatataaaaaataaatgactacaattacatcataaaaatgcattttactaagattctttttttcaccaataaaagctttctaaaagtcggtaatgaattgtttgttaccatatgtgcatgcctgctaacatgtaggcaaagctgtgagcgatttcatcctgcaaatcaaatcacatctcaccctgttttctcaccgtctgtcagatagttgacactgcgatgagctgtgaacctctgttgccaatagttttttctaagagagattaacgacaattacaacgtacagtaaaaggagtgtatgataatttgtgttaaacatgacaactcatgagagagtaattaagaaaataatatggcctcttactccattattggtcgtcagcattaagtatatttcatataatatcatgttaaatatacattttgactaagcttttatggggcatttcctgacattgcagtggtataaggatatgtttgcattcagacatcagcgaataagcagtaagatctcagagctaaagctcttcagctcagcttctgtttttacgagcagcaaaggttttagttaaaatttccagcgtattgtttattcgatacaataggaatgtgtattcgtggtcggttaaaaataatggttttaattctcagccataaaagtctcgtacagacaaacgtctatccacatgagatagctcttccttaagaagcgtgtgcatatgtatgtgtgtgcatgtatctgtgcctgtgtatgtgtttgtgcatgtgcatgtgtgtttgtgcatgcatgtgtgtgtggatgtgtgtgtacgcacatgtgattatatgatgtagtgctgctaaggtcttgagcatgactcacccactgagcaacctccctcacccctagcttttccattcataaacacaagctcccatccatgttggatcattcaaactggaagtacagctcactcactggaagagcatttgcctgttgtgcacaagaccctagttcctatctttagcacaagaagggaaaatataatatattccaaaaattaaaacatgtggagatcggtatctaaagtcttcctcctgctcacacctttgagagcccctgtcatcgcagactcctccatttacacaccacacacacgtcggcgcgtgcgacggacaactaacagtttctaagtttttggtgataaaacaaatgcaaaatattatccttttgttcccatacagtttcacatatattcatacacaagtccgtctgcaagaaaactcgcaagaagcagaatttgaaggctgtttctaaattgctctgggcaggaggcattccaacttaccctcctgtaacagttggcaggatccccgttcctcctgaatgttgccaggatgaactgaagcgaagggattagcctgcctgctaggtgggcagctgtgttgggctgtggctctgactcctgcttaggaagagcagagttaaatatcttgtgatgtgataagggaccattcacacttgcttctgtattagcccattgttctgtaggttctgactctcagagtagtaaggagttttgtcccttatttggcatgtcatagatatttgtccttgactctttgcaaaactgctcttttgtctgtttgtcttgttctgtttttcaagcaaggtttctctgtatagccctggctgtcctagaacccactctgtagaccaggctagtccgaactcgaaagattctcctgcctctgcctcctaagtgctgggattaaaggtttgccatacccagctaagaagtacctttttaaaaaaaaattatatatatatatatatatatatatatatatatatgtatatgtatatatatatttgtaaatataattgtttcatatcttataaagtcattgctggaaagctttttcctactttaacactataggatatttaattgcttaagttttactatgggaatttctaaagctactgtatagtcgtcctaaaggtgaaacacaccccgcccccaacactatctctgtttccatctttctccacacttcctttctttttttttccattttttattaggtatttagctcatttacatttccaatgctataccaaaagtcccccatatccacccacccccactcccctgcccacccactccccctttttggccctggtgttcccctgtactggggcatataaagtttgcaagtccaatgggcctctctttccagtgatggccgactaggccatcttttgatatatatgcagctagagtcaagagctccggggtactggttagttcataatgttgttccacctatagggttgcagatccctttagctccttggctactttctctagctcctccattgggagccctatgatccatccattagctgactgtgagcatccacttctgtgtttgctaggccccggcatagtctcacaagagacagctacatctgggtcctttcaataaaatcttgctagtgtatgcaatggtgtcagcgtttggatgctgattatggggtggatccctgaatatggcagtctctacatggtccatcctttcatctcagctccaaactttgtctctgtaactccttccatgggtgttttgttcccaaatctaaggaggggcatagtgtccacacttcagtcttcattcttcttgagtttcatgtgagaaactcacacaatatgtactcactgataagtggatattagccccaaacctaggatacccaagatataagatacaatttgctaaacacatgaaacacacttcctttcttaacttctcctgttagaataacttcttggacctccttctaaactgctacttggaacgctttggaggggaaattaagccgttctagctaatgcactcttcttcacaattaggacatagaaaagccaaaggccaagtgagggtgcaggaaacggtcattaactcttacaggagctggtgacgtgtaacatcaaccacaccgcagccaggactgagtttgaggcttctttttctgcagcctctttattcattattgctcacctgcatagtactctgtcgcatgcatcctctgtggtcaacgtattcactcagctactgatggacacctcagatggagcttgcgtctcctctcctgttgggggccactatatccataagtgtgtccctaaccaaacttctgcaggatctctaagaaacttgaatggaattcccttctgcatttgatggatcttgctattgccaggttgctcgtagatcattcacaataatacagacaaatgctctgcacaaaccatctctaatacctggtaatattcacctttctaatccctgccagtcaaatacattgaaggtgatattttgttaatttgcatctcatgcttttatattgaatgactgttttcatatatttgcaatttatttggatctcttctgaaagctacctatttgtccttgtaaatttttctttcttgagttcactatgttttagtaacctaggagttttatataatttggacatttttccttattggctttaaacattacaaatagcattttctttttgatgactttataaccatttgttaattatatataatgggcttcattatattttcatgcatacttattaatactatcgtatgacattgaaaaaatccttgtttttcatgtagttggatcgatttttactttgagttaattttgtttaagaaccattttgctctcctcagtcaggaaagctgtagtggccattgtcacctccagccattgtcctgtcactcaatgctggcagcacttatgactccaggagccacgtccctgcactccccactctgtgtccttggtctattacacatggtaaagtcagcaacattgctaccgcatgtttcctggcatgttaacactggtgtgtgaaagacacatctttcctgtgttcagtttaagacatttccagcctgtggacatcatataaatgttattttgttcctcagaaatccagcaaaaggactgagcccttagcatagtcacagagaaggactcctggatggagaagccctgggcccagtccccagcattgagaacaaaatccagttagaacaatatcacaatcacactggactgtatgtgtctttgcaatgtgtggtatcaactgtggtgtcttcttttcttactaatggaaacaacagaaaaaggtcttgtatttatttgttctaactttttcaatgtaaaattttattaatttacttagtgtgtcgcatgcatgtacacatgtgtctgtgcatgttcatgcatattcatggctgcgtgtgtgtgtgtgtatgtgtgtgtatgtatgtgtgtgtgtgcgtttgtatgtatgtctgtgtctgtgtatttctctccttcttccacgtgggtcccagggagagagacatagccttactttgaaggatatctctctgtggccctatttcttaacatgttaacatacacttctaatttttaaaaaagttcaggtcacatgtagagggccacagcagtagtcccggccacctcggaagctgacacaagagcaccaccagggggtcaaggtcagcttggttagcacagaaagaccccacctgaacacaaagtaaaaatgaaagggggtcagaagacagaaggcgcagctgcttggacttcactctcaagcacagcttctttcccaccacccctaacaggcgcactcgcagggatcaccgtgtgcttggggtgttaggaaggtgctccggagagacccaaaccctggccaccagatcagtgaaacctcccagaaggtttgaactatcttcggggcacctatgttttgggctcttagcagaatcctcaaagatagtcacgcacatttcaaaaatatatttaaatatgtgtctctaagtgtgtacacaatatttaatatggactctatctctctttttttctttttctagacaggatcacatgtagcccaggctacccttgaaatttctatgtagccaaagctgaccttgaacttctgatcctcctgtctcacctgattgttgagattagaggtgtgagacccaatggatgatttcagccgttttgggaatcaaacccagggcccatgtcccgctaccctgtagaccctgatctctgttctgtaggttcttagccagaacaaaaaggatgctgtttgacgagctgtttgtttatgctccccactgttatgcagagcacctccagcactcttccttcccaccagcagccgctaaggagtccagcttctccatgccagactcctgcaaatcgtactctgagctccacacataggctgtggcatgcatgtacccaacacatgcatatgcacaagtgcatgagcacacaaatgcaaataaataatgcttacatctaaaaaagaagaggagaaggaggtcagatggaagggtttccttgaccaaagtcacgagtccttcctttacctgtttcctctccattccatgaacagggacctataaagatgcttgcatttttataattgataagaaagaaagaaagaaagaaagaaagaaagaaagaaagaaagaaagaaagaaagaaagaaagaaaggaagaaagaaagagagagagaaagagagagagagagagagaaggaagagaaagaaagaaagaaagaaagaaagaaagaaagaaagaaagaaagaaagaaagaaagaaaagtagttgcttcagaagctgaaccaagtgaccagctcatcttagagcttaacccccaaagcgttatatataagacaaaagagaaactttgcttgtaaagacggaatctcacaggcggctcagtaacctgctgacttcttcaatgtgaagaaaagattgaccaggaagacactgtccaccgtgggttttgagacaggaactgaaactcagcaagtagggctggctggcccagtgctggggtcacaagggtgtggcaccacgcctggatggttttactctttgcttgcaaggcaaacctttaccaacggagccgtctacccagcctggaaatgtttctctacttcaaatcttgaccacgcatgcccttgctctcttacctcagagttcacctttgtctaaaccttacttttaagttttgtccccttccccctgggatttgtgtcagtgcttgcctacatgcacgtatgtttaccacgcaggatccttgtccctgcagaagtcagaaaggggaccggatgccttagaatcagagctacggacagttgtgagccggctcctctgaaagagcagcggtgctcttaaccgtggagacacctgtgaagcctctacgatcgattgctcatgtctgagctaaacaagccattttcactcaagcttgcctatagagacttatttctctaggtgccttagtttgttcctgcttagagacaggagctgatgcagaggtcatggatgggtgctgcttattggcctgattcccatggcttgcccagcctgctttcttatagaacccaggcccaccagtcccggaatggcaccacccacaatggtctgggccctcctccatagatcactaattgagaaaatgccttacagctggatctcatggaagcatttcctcaacaacggaggctccttcctctgtgataactccagcctctgtcaagttgacacacaaaggcagccagtacacttataaaatgccaagtgtaaacaaaaacctttagatccttactcgttctccacactcgggttttctaatatctagatttagatattaggaatctatcaaatatctattattttcacttttttcttgtcctgagaaaagaacaaggaaagtttccaatcaactttagtaaacagggtgccttagcttgggttttattgctgtgaagagacaccatgaccaaggcaactcttacaaaggaaagcattcaaccgggactggctcacaggttcagcggctaggttcattatcatcatggtgggaagcgtggcagcatgcagaagacatggtgatggagaaggagctgagagttctacatcttgatccccaggctgcagaaggggactgtgattctacactggatgaagcctgagcataagaaacctcaaaacctgcctatatagtggtgtacttcctccagcagggccacacctcctccagtaaggccacacctcctccaataaggccactccctatggccaaacattcgaacacattaatctatggggatcaaacctattcaaatcaccacacaacatgtcaatattttgacaattactacttcaaggcttactggggagctttctacagtgctggggattgaacctggaacctcatgcatgctaggcaagtgctctgtcactgagccatattccttccagactttctctgtacatttacactctccactggatgtatcttgaatgagtcccacaaattgggcacataatgagacgtcttggcaaacaaaaacctacatacacggctccagagttcatcttaaatagttgtatttattatgttgcagctgttataaatgacttggaatctgcaaaatagttcagacaagatgccaacccatatactgaagagttagccgtgacaatgtgtagaggaacacaatgggtttaaaagtctcttggtgagcagacttttgctgcatcaactccagccacggagtgagacaggaagagttggggaccctgctttacaaactactgactgggaatgagaaaccatggggagagggaggggctgactgtttaaaaggctttcggtgtgattgtatttttgttggctttttgcctgcaacatacgatgagggtggtgtgccgtcgggccagctggctggggaggtagaatgagaggaagctgaacacaggagccaagatggtgtttggagacgctgcctgtcctcaaggcatctgtgactgaccacaggcagtgatgtccatgagcacaaatacagtggatcactagtgcgaccccttggggatgaatgaccctttcacaagggtcacatatcagatattctgcatatcagatatctatattatgattcacaatagcaaaattggttatgaattagcaatgaggtaattctatgattagggggtcaccacaacgtgaggaactgtgttaaagggttgcagcagtaaggaggttgagaaccactgctctagcacaatcgttctgatatctgcagtttgtgatgcgttccttctgcttaagcaggtaggaaaagcaacaacttcacaaagcccaggtcgccattaaatcattcacccagccattcagaaactgaattctttcctctctttcctttttctggacttcggaatataccaaaacaggacattgaaacgtatcaaataagcccgcttcaacaggtctcaaaaccaaacttcaagtttacaatttaaaagtatttctcttctcaagacttattcttaggactgacgtctgtctgtaggaaacatcacctatacagcacctactttcagctggtcccaaattttctgtttggccatcaatacctccttcctttctccttcctcctttctctttgttctttttctctaccgaccttcactcttgggtttggtttggtttggagtttgcgcagtctgatggttgtttgagaagaaaaccctctctgtatctttgccttagcctccagagtgctgagaatacaggcatgagctatggcagccaccagagccacctttatccccaatacctccgtttacttctgcctaccctttctagatctttagattacaagtttgctgacacaacattttgccatagtgagcccattaatagactatccatcctccacaagatattcctaagaaagaataatattgaacacacacaattgtggctaaaataactttcattttactgcagatgtttgagaacagttctcacccagcgttcttcacaactcccttttcttatacctttcttcattttttttaatgagatctccatatttatttttatttttatcttgagtgtgtagatgttttgcctgtatatatatctgtgtaccacttgcatgcctagggcctgtgaaggacaaaagagagtgttgaagtccctggaactgaagttataaaccattgtgagccatcacgtgggtggtgagaatcaaacctctgcatgagtggccaatgctcttaatggctgagccatatgttgtggtttgagtgagaatgtcgtttctaggctcatgtggttgaatgcttgtccccagttggtggaactatttgggaagaattgggaggtgtggccttgctagaggaagagtgttttcaggtaggctttgatgttccaatagcccacaccatccccagttagttctctaccctgtgctttgtggattagatgtaaggtcccagatactactactccagcaccatacctgcctgcctgctgcctgctgccatgcttcccaccatgatagtaatggactctcaccctctggaaccatgagccccaaactaaacactttcttttctaagtcaccttcgtcacggtgctttatcatggcaatagagatgtaatgaggatctccaaccccttcatacgtccttctgtgataacatggaaacttcagcaaactgttggaatggtgaccttaccattcttcttcactgtgggtagaattgataaaactttttcaatttttctcttgtctttgcctgaacatactagacatacagcctctgacaaaggtagcatcccttttgtagcagaaacaaaagaagtgtgtaattagttgcagccatgacactgcatgtggaaatgagtcctcttggctataccaccccctctatttgctagggtgagtcctagtctttctataagacacaactggccatcatcttcccctagcacaggtgctttggaagacaatcttgtccctcagggtggtttaggctggaaaatgactaaacagaccaaggggatcagagtgaaacagtgcagcgctgcctctggtaggcgatctgtaggcaggctgaacttacagagtgaaagggccttgggtacacataaggtgtgtgacttttagggactgggctggcacagtatgaactacagcttcatttgccacgtcgatgcagaattctaatgctgaaagaagagcgggcagatgcaggttttaataattcagcagtgtggactgtcttagagtgatatcttaaatgaatttttaatttcttatgaagactcaattaatgccacaattgtgtagttttagcaaatgctacctttttatcccaaaccatagcaccttcttttcctcagaatgctggtcgttggcttcttcattctctcatttgctctgtctttactttcaaacataagaccttgcgtgatatttgcttttttatataatacatatccaaatcagctgcagaagatatttaaaatgtatggttttttttaaagatcagatcatttgttcatttttagataaaaatataattacatttatctcaattttttttccaatcattggaacgttaattttactctttctcaaaactgaaatagcaaacagtttatgtaaggtgttgataattacctacattattatactgctgtgacagatgttgggggagaaaagcctgaaatgcctacagctgtgcaccccatgacttctagtgcaggctcaacagaaggctagcagatgttctgagctgtcactttgcctagatggttttaaagtcggagggcctgttttagtggagtctgtttgagtttcacagatatcctcccaattcctgtctgtgacagttaatattggtgatgttgatcagtcaatctgttttccttctcctttaataaatagatataaacagacatcagtttgcacatggattattaagcagtctgtgcgtaccattctgtaaaaatctcttctttgaacacacatttgggttatctgtgcacgtgaaagcttgggaagaatcagaaattttgctaaaatcgtatgctccttgggagcaaaacatttgacaattctctggaggaaaagttgcattctttttcctaatagaagaattttgctccacttatttctcattcaacaactctgctcaggacaactattaattttgcagtctcttagagtaacgcaagaggaagataaaggacactcagactcagcgcacatccggccaagcctgacccaaatgcttcctcttcgcagacagactttcatatccttcttgcagagtcccaaccctgagcagaggacatcggcacctcagtggctcttcattttaatgggtcagagttctgtagtacacttgtctaacagtgtaaaccttctgctaacaatcgggtgtctggcccaccccgtttcctctcctctctgcatagaaatagaactctaagtaggacgtctctctgggtttgtctctgtattagtccctacacttaattatgaggaggagaaagatgcctcctcctcctttgttataaactaagctttcagtaatcccaaacaaaagagtcagttctaggagatacaggatttgctcccaggattatggtctcatagataatacgatgcagtcagcagacactgaagctttattttaattcaaatatgccagtaagcccacccctggcaagtcggcggtgagaggagctagccacagttgccacgttggcaagcaaagtgtaaaaaagcttatactttgttcaccttgtaaaacatactatacatatgtctagttttatgtgagatacaaaataaactctccagagtacctattaaaataacaatgtttattttatatttcactgacttaaaatgagggctactgacctcgaagggcagttttgatttaagttatcacctatggagtgcaggggtaagctcagagaaaggaaacactctgctgcctttctgggaaaagacaaatgttaacatcctttagtttgcagtccttaatgaggttaattaacaaccatatgccctgctatttctgtatttccctcccagacctttggcttctaaggcaggagctttaagactggggcttctcagagttcaaaagccctaagtctgagacccagcactccataatctgggtatggtgactctagcctgccaccccaaccctagagagatagaggcagggcaatcagaagttcagaggcatcttcagctcaataaagagtttgaggccagccgggcggtggtggcgcacgcctttaatcccagcacttgggaggcagaggccaacagatttctgagttcgaggccagcctggtctacagagtgagttccaggacagccagggctatacagagaaaccctgtcttgagaagaaaaaaaaaaaaaaaaaaaaaaaagaaagagtttgaggccaggaagggatatttgagaagctgtctaaaaggaaggaaggaaggaaggaaggaaggaaggaaggaaggaaggaaggaggaaggaggaaagaaaaagaaaacatcacctgtttgcccaagtctgaagtagttcaggaggacacactggtacaccagagatcttaagacggtgcagaattattggagtatctcagctctaaccctgaattctagaggcagaggcagaagattgagaacttgaggccaacctgggctgcatagtgagatgctgtgtccaaaacacagcaaagtggtcggggtgagagatggggacaaaggggagtctgttttacaggaaaacagaaagacgagaaccggagtgtgcagccagtttcctcctgtgctcacagaggtaggtcagcatcaagggtatctgctcgagtccatttggcctcagtctaccgaattctaaagaacaggcagcgtttcggagtcaagtgagaaagcccggtctcttgcccggctcagaagcacaggcctttcactcagcatctccttttatgctgtaaggtaaagggaactagggtaatcccaacttcacatgctgttgcaagaaattgagacagtagctgctgtcctgattcaaggttagttcctctcatgttcatcttcagtgaatagattgctgtttattctctaaagaggaagggagttttagggtgtactgtgggtagagagcaatagaaaccctccccaggtgttcctttgggtcattaattcctcctacacaaccccccccccgaaaaatacacttcttttctgtcagagtctgccacaataatactttctaagaacatatttaccgttcatggctgtggctgaagaggtggctgcatcggtagaatgctcgccctgtaggcacaaaaccctgagtttaataatgctaaggctggctagcctgagtgtggtagtgcacatctgtaattccagcccttgggagagggagacaggaggatttgagtttatggtcattctcaactttatacaagttcaaggctagccttgactgtaggagatgatatctcaacaaccacaaagtaccagtgagtcagtttccccaagccaatgcctgctcttgtgcctggagagaggggaatggaaagaagccagtgccattcatttctgcgccctgggtctgtgattgcgattgcgattgtgattgtgattgattgtgattgtggggttaaattctaagcacttgggctaaggaagctcaagctttgtacttggatctggtgatgtgagaggtgcatgatgcagtcagctgtgggggtgcacacctagaaccccagctcctcaggcaggagaagcagaaggttgcatttgtcctgttgctcttattcttcctttaaaattttacttctttttcactttgcatctgagtttttgcctgtatgtatgtatgtatgtgcaccatatgtatgcctgttacccatggaggccagaagaaggtgttggatccctgggaactgtagttttgacttccatctgccatgtgggtgctggaaattgagcccaggtgctctgaatagcagccgatgctcttagccactgagcactttctccagccacgaaggggctcagaaacttaaggctgttacaaaggagctttaagcaaaccaaggatatgtgggactcggttagaagacatgccttttgaaaatggcttcagtagcatgagtcttgaggtctaacaggtaacactagtgttttattgatgcagaaagactcacctgacactgcacagcagcctcttgctttcccatagttagtaccaataacactctggtagcacaacctgcagtccctactttccctccaacccaccatgcctctgagtaacatgcaggtgaattaatacataagtgaattaagaaacttagagccaggcagtggtggcacacgcctttagtcccagcactcaggaggcagaggcaggcagatttctgagttcgaggccagcctggtctacaaagagagttccaggacagccagggctatacagagaaaccctgtctcgaaaaacaaaaacaaaaacaaaaacaaaaaaaacaaaaaaagaaacagaaacaagttcttaaaatgtgtagcatgttttaaatgtttaatgttttacttaatattctttattcatagttttcttttttttaaagacattttttattatatgtaagtacactgtagccatctttagacactccagaagaggacatcagatctcattatggatggttgtgagccaccatgtggttgctgggatttgaactcaggaccttcagaagagcagtcagcactcttacccactgagccatttcaccagctccatagttttcttttgagacagtagcccaggctggcctcagattctgacaatctcagtacttcaggtcccaggtcctgagattatagacaaggaccactaagattatagactatacacagtgtagcgtattcacctgctatactgaggcaacaaaggaaaaatccttaagggaacaaaagaacatccaaaaaagtggaaaataaggaagagatcaatatgttcattgattggtgtgtctgactgtcaatcatattggtgtatagaatgagttcagctaatttattttttttcatgttttattttatactcctttctttatttacaattctagtgattggacctaaggtcttgcacacactaggcaagctctcttccacaagctatagccacagcctttttgtcatatttgcttttgtttctttgtttttgtttttgttttttaaatacagcccacccccaacccccatgttcctggctggaactttctgtatagataggatggtcttgagtaagaggcagtgattgatcctgcctcactctccctctcctgaggggtgaaattataaacgtgaggcactagacctggctaaaagaaatattttcaaatacacagataaagcatatggctgtttgtataatctcagttcctatatgaaaagtatccctgaaggagtccacagtgcagtctcccaacagccctggctttggctgaaccctccacttagttagaaagctcacctttcttagattcaggttgtctgttgataccaggaaactcagagtgtgcctcgctgagcaaatggccttcttacagcccacagcccactcctggttccaagtcagatttgctgacctacctctctgaggtaaccaacaagacttttcatcccaggtcctcgtccctccctggtgactgttacccagtcctccctggagaatcccagggctcctctccccaaaccagtctggccacactgtgtgctcagaagaagtattctaaagtcatttcaaagtctgagcctgtagtcagatacgcacacgcgcacacgcacacgcacacgcacacgcacgctcgcgcgcgcacacacacatcattagcctccctccagccacctatgagtgagcagtagcaggaggccatgtcatttgggtttaggtccaagagaacatggaccggtagtgccgggcatgttaacaaagctgacctcccaaagtggctagtcccttcccgtcttggcttgccaggagcccttcctcaggctgggggtaagtccagcacagtagccagcaggtcaccttcgccatgtccttcctgcgcaggagatacagagattcctggaacccgagggaagctgatggcttcacaggccagctgtctataagctggctgccatctgtgctgcctcctagatcacaaggttctccacctttctctcctccttccctccctctttccttcctcatactgaacggaacgattcctgcagagggctagccactcccattctgaagaaacctcacccattctcccaatggaagacctgtgccacttagcctaggtcccagagagcccatctaaacacccggagagcagctactgcttcccaagcctctagcaaccttttcgtggctctttgctccaagcgtggggacagtggttggggcggaagactagtcagctttgtccctctccttcctccctcctctcctcaaacccttccttcttcctttctaccattccctccttcctcttcctgttcctccttcctgttccacccttcttgctccccccctcccttctttcctccctccctctcactctcccttccttcctccctcccgtcttccttccttccttccttcctttcctccctccctcccccctcctcctctcccttccttccttcctccctcccccttccttccttccttccttccttctttccttcctttccttcctcccccctccctccctctctcccttccttcctccctcccctcttccttccttccttccttcattccttccttctttccttcataagtagttccccactgactgcagatttcttatctgcaatggctttgagccatcacttgctggaacattttctcccttccttaattagctcagtgttggacttttttcttattgcgtgcaaagcccttgcattaaccctttttagatttttggtgacttacattcttctctctctctctctctctctctctctctctctctctctctctcacacacacacacacacacacacacacacacacacacgaacacaaacaagcatgtgccacaccttcttgattgcttccaggagacaagggacaactaatttcaaacttcttagggctgggatggtacagatctaatctcagcttcctcagtggagaggggtcatcagcttgagtcttctttcagtccatgtaaaaaatggggaaactttgaccacatccttgtaaatctaaatagtggaaacatagggagagaggtacaatggtcactctggtctttccagaatcagttgctatgacaacgtgggcattcaagtcacacttgccttcctcatccccacagttcttggaagtgttcctactgattgtatggtgccacacacactcccacagtgccccaaatagaaaatacccacacattccataggcaatcataaagatccctccctccctgcacacacactcatacgggctcaaggtcttttcttgttggcagcaatggggattaagcctatgacctcatgcatgctaggattgagctttacagcaccaaatggggctcacttttttcaaccagtcttaagaaatgcttaacttcacctttaatcccagcactggggaggcagagacaggaggatctctgagttcaaggtcagcctggtcaacagagtttgctccaggacaaccagggccactgggaaaccttttactttgtaccaaaaatacagagagagagagagagagagagagagagagagagagagagagagagagagagagagagaaatgcttaactttttaaagttgtgccacaatttttattcttttcagacttctattaggttgcttatctcaacaatttatacgataaataatttaagccaggcatgatggtgcaccctttaatctcggcagtctggaggcagaggcaacgaggccagcctggtgtagtgagtcccaggccaactggggctgccttgtgagaccctgtctcaaataatttagaaattaaattattaagaaataagccctaaaatgattttgctgccaaggttttgttacaccactgacggcataagtcaggagagtatagtctgtggctctgggctcttgcaggcctaaagagcagcctgttctccatgtagccagaaaggtccgccccaaactcaccacttccctgcagtgtctcctgtcccattgtgggggcgctgctcaaggttcattcggaccctctttgagttttcatgtttgggtttcctaagtgagaggaagcaactgaaagaaagggagcagatggctggaagagccaccctgagagtggggcactgcggctggaggtgggccatcagtccgatcccaggacccttcaaagtcacaagtagctaggaatgaatcaaagagagctaagagtaggattcactgggtgttagagacctttaactgcttcctctcagcctaggctcccagcctaggatttttagattagcagagaggaaggccagcttggagtgggggggtggggggggggaagtggaggggagccatgcctcccctcctgtgcacatggaagaggcacatctcaagatggaagaagcccttgttgagatacgtgtggctgattcatctggtagcatggtccgccagcctgggaagaggaaagccacatttccttaagttactggaactgggattgcctgtctcttctccccccaaccgtcctttcccccagaggcagttgaaactgcgttgccttcaagactgtagtgagcctgaagatttggggtttcataaggttactgcactactgatacaattgcatgcagatttttaaagccttccagagacagatgtttgggctgattaagaattgaggaggaagcttgcagctgcaccaaggaataatgtattggacaaatattttaataaaaaatatgaagagatcagcccgaccttccaaggtcttctgcttaaaaaaaaaaaaatctttatcaaccccctattctatgggcttcaataaacagaacccattacctcacggaatcttttgttggccccatacaagagagaacaaaatggttattcaggggaacgctttggattttattgtgagtagcctgcacaaagaaccgtgttattgtatttaaaagaaccatctgtagcagaaacaatggcatcaaattatctttgaatacccactgaaaaacataaagcttgtttttttttttttattcttctgtacggtgggggatagagcagtgttaggataactgacttttttgttgttctctgggtgcattcttcccgctccccctctctctccccctcaccctctctctctcctctctctctctccctctccctctctctctctcttttaaaaaatcagccatttggggttttaagccataaacgatttttcttgttgcaggggattgcagaggcaaagctagactaggtcttggaggctggtgtaaggtggtgcgcggaaggcaggacgctgatgggagagactggtcgaagaaaagcctaaatggattctccgtgctttggatggagaaagaggggggaagtgcgagctccttcaactcgttctgtccggtgaggagtgatccagcttgggctgacgagaggctccggagccttcacgttcagtgctttttacctgccaatcaaactgctacaagacaacaccctgatctggcatggtcgcgtaagtagcttgcaacccaactttgacattcaaggctagctacctctccccaccccccaacacactcactcactttcttctcctctcattctgcctctttgtgtgtgtgtgtgtgtgtgtgtgtgtgtgtgtgtgtgtctgtgtgacctttaagagagctggatacccaccctgtgtagcagttatttaacacaggccgatttaagtcagaaggtgttaagtttgggaattaaatgctaattaagatctctttaacaaatgcagaattgaagtgacattttattctctttggggcagatagttttgaggtctgaacgtaatcaaggtgctgtatgtatgtatgaaaggggtgtgtgtgtttctttttaagcaaaaactaaacgtctgtgagtccctataggtaaatccaataatgaaaattttcgggtttccatcttaaaactgttaaattctagtattgctctcctactaagatccttgtgcagaccgcagtgacttagatgctgaagggctcacttcgatccctgttgggactgggggagtgggggtgtgctgtaattggggtgaaagagagcttgaatttaaaaaagtgagacaggggacatgactaaccctcattctttatgcaactggaatagagggagatagaaacgcaagggggcaggatcatcaagaaatattacctgagagggaatacagaggctgacgaggctgggatctgggagggctgagaaaagctggctagggcgctgggctactctctggcgccctctaatgacaaatcggacgacattaccttcgccatcccacgctcagcaaaggttttttttttttttttgtagctgctgaagctgtggtttttgttgcgcttgtttggttggttggttggttgatttggtttgtttttgctttgctttgctttgctctgcacttagtagaaaagataggtatttttccgtccagaaacttagtacaggtgatttttggcgcgcgtattgcctccaagctgaggatggctggctgtttgattcgtggagcgaggccctgtggggatgagcagtgtggggggaggggggcttctcagcctgagaagtgtggttgggaaggccagtctgaggatcctgacacccgcccatcatcgcaattcaaggaggctcctgaggacctctgtcacctaggcgtgcagtggccaggggcctccctttccttctttctcctcctcttcgtcgtcgtcgtcctcctcctccttcttttccctcttttttttatttaaaattttggtagataaaggttaatcttgggctgaatgataaagctatgattgacaagagaaaaggtgttgagggcaggtcgcgcggtcttatttacagcccactgcttgctgtagagcctttgttagaactgcaaaactaatctagtgctgatcaaagcaccacggagttaaaggacggtaatgactgctaatttcattccagcctcaggcaacccccgccgctgtaattaaagacacgctatttaaatacaggtgaagggtagttggttggttttcttttttttttaagttggggtgggtgtgggtggggttacaattttatttagacttcttgtactaacgatggttatgtggcccaacacccagtttttcctattagaattcctttttgtcatttatacctgtctttgaggcgccaacagagtaaaatgtgtccatcacataactgccgcgtttaaagaaagtatggaaggaaacagaccagtaactgtttagtgagggatttaaatatttgagtctcttttttccacttcgaattaacagaagggccttcaacacagctaaaataaaagtattagaaacttgtggcagggtcaacaggccagccagaagaataagcgtcagcttttaaagtacttctaaaggaacgtatgaacgtatgaaaaatatatttttaattaaataatttccacacacagtgtagctgcgtattggctcagaaaccttataattttacaacccataggagtttctttacaagaacatcaaagctctacattttcatagttggttaaaactgataccctctcttcatacacacacacacacacacacacacacacacacacaccacccaaaaagaatttagcctttaatctctttttatccgcaaagacgaaagctctacgctcgacctcgccagcggctgtcgcggtcgggccgggagcagctcagaagagaagcgactccgcggtctcacgccagcgccccctattggacgcagtgggagatacacagcgccctcccgaacccgcttcagcccttgccctggggttaaagaaaactctttattgcccccagaaaaggaagtgggggtgcggaaacaagtttttatgccccgaaaagataactatacttcaacaaaagccaaagagattacattcttttccatttcatttatttaaaaaacggcattcctccttacaccccagtttcccccacccgcatcctggcttggtttgaggtcttcttttaaaggctaagcgatggtactacagggaaatagaaaaaaaaaaatgcttcttccgcttgtccgcttttcataaaataacactaaagcgaagagagtgcttcgcttaagcgccagctgcggttcagatacaaggtttccaaatataaagtgcttgggtgtctagtggatgaagtaactcgtttatatttgattattaattccagaatgtaattaaaagtcctgtctctccttcaagtatttacctcccctcctcttccctcgcctcaaaccactcttgatcaaacttttccttcctggcaatcggttaaatacagctattgtctaccaaacaggtgtctttttctactttgatatcaatgtagaatttcagggaagattggtctgtgatacattttattggttaggactccaagttgtcctggaaacagttttgatttgttttatttaatacttccaaacctgtctgtgtaagaaagagttgtaacttctgtcagcgagggagggaaagtagccgccttgtgactgattcagaaaggccggctacaaaaagaacacagcctctgacttcccaacaaagcgggaaatgttggtttgtttagtttaaaatttaaaaaaaatcaacaaatgaacaaaatggccatttcctacttcggggacatgtttgccgttttaacttttatcagcaaggttagggcttgccatcagaaactagcttaacatatcctaacaggatagcattctgcacatttaatgccatatccctgcaaatctgctgttgagggtgtgtttattcctgctccagattagcggatccaagatggtttttaaaggagctgctccgcgcgatgacgtgccctctcatctgattccgggatcggatctcggacgagaggggatttttgagaaatctacccgacagtcggtcgaaatgatggacattcaggagccgttgcctcggcacctccaccctttttccacgaagaggctaggcctggttagggaaatcccaacctgagactagcctcgcgaccccccacgcgcaccgaggagcctgggggacgcttcttgggcgtcctgggtcccagcgctgcggtcatctgtctcgcgaagcagaagagtagagaaaccaagaacaggtcctgcctcggaagcggactgcaaaagggttagacaaccgccattgcggagtgtggaagaattgtcggcgaaggagtcttctctccagcatacggacagaaaacctaggcaaaggtcagaggggacaggcgtgcagcccactaagtccgcaactaagccatgtcggtggagaatgcacagccaggttgagcaaaaagcagtgagccaggcttgagcgcgccacccatgctcggttgcattgtgattctgcagccgcaggtggctgagccccggccccaatcccacgccacaggactgccagccgggaggaggcccctccacctttggagactaggaaggccgccaaacagggactgagatctccaagaaggcagagcctcctggggctggcatcccgccggatctccccagccgcgctgtaccctttaggggcgtggcaggcgctttgggtctgtagccgcggcatccaggcttgagccctggcgggttggctgggcgccctgctttgtaaagtagtgagtctttcgagatcctgtgagccagccagccgggtgggccaacttagcttaggtccactgagtccaggccaagtcctcaacccttccttccttcttttctccctccctacctcccaagcttaaaacgctgagaagcagggtgtgtggtttggacttgggcaggctatttggagatggggcagggacaaggcttattaataagatccaggttcgaggatgagctttcgtttattgagtttagtcttcttgttcggggttctttctttctttcttttttttttttttttttttttttttctggaaaacctttagctcctagaatttaagtcccagacaaagagccagggaaagaaccggaccagactgaaaggagcagagctccagacagatcatcatctctcaataaactgccaagctgtggctccagaaccagagcccagcagctacgtgggctgctgaagagtgcagataccacaagtacaacttgacaccattgagcccacggtgcttgtcaataagctgtgaattaggtgtagagactgtcaccatagatcataacagtttctgaaggactcattacagcatagcgtgtcagtgatctccaaattaagggagggggggtgagagaggaagaaggagtgggggccgccaacaaaaatccaagaagggtgggaggagagataaaagtcagagccccagctaagaagaaggctttaaagattatcaggccagcgatctaagaattctgtaaggatgggtttggaagcccaattctgagcctgggctgggagggatgctgaggccaagcagaagtgggcctcagggaaagctgacgttctcagacattgcctttgaggttagaagagcttttggaagcgacctcctgatgtcagcagaaggcctgaaggatgccagcccgcccagaaatgggagcataccgattcacagctctttagcacgaaccacagtagccttggcttcctttaggtctggtggtgattgtgggtgactttcaccacgcaggtttgctttggcttcttgtcatgctacaggtggaaagctttcctctgttccctgaaagcaaaaagaaaaaaaaaagaaaagcagtccagtgcagtgaagcaaatctcccccttccttcggcctgctcttaggcatccctaagacccttgccttccgaggcttatcactttctgttgtcccgtcgccaccgggtagaggttccggcaaggaagcttttgagtgacacaaagcagaaagttatgtgaggtcacggaggaaagacagagctcgaggctaagtgttctagctccttggactttgctgcagcagtcacatgtcaccggcctgcattgctgtcacttaatatgggtcagaaaaacctcaaggaagggcttgggtttgtttttagatggcacaattaaataaagtaattgcagctagaaaaattttaaagaaacatctttttcttgaaattacgggaaacaatcagggccatcggacaaaagaggacatgtgtatgcctttggtaggatgaattgcctaaaatatttggctgtcaagtaagtgtatacatagacttccaagcgttgatttggaggtgcaaaaggactaatgtctctctggagtgtttggactctctggtgatcccccacccccccacacacacacccctgatttttagaatcagaagtgcaattgaagaccaacagtagctgctcttcctgcctccggtttgtctttaacaggggaatttctgtctttaaagcaattagatcatctaaagggcaaactacatttcccctggacagcaacagcagtggtagaaacagaatctcagggttgataattcatgaaatggaaatgaaaaatagtgaagtgtgaatcctttgcccagaaaaaaaaaattaatgatctggaatatctgaaagatctaagaatacatgaaccattgtaagtcatgtgatttttttttacatacagcccagaagactcaaaaaggcagttttaatatatatatgtatatatttaaaagcaagagggaaatatgttaagtttctaactgccaaactcttttttttttaatgcatttacttcatcagtgagaggtggaatgaattgagcacaatggtcactgggcagaccaccctgcattccgcaggtttcaagggtccttgcagctcttgagggaaattatttggtaaaattgggtctaggcttcaacagccccttgtccatttgtttcatataataccacttctgaaaattaaaggcaagatcctggagagacacaaggagaaaaaaatatgattgagcaattttaaattagcagtgtaccttgtatccatatggtaaacaaaaaggggtagaagtctgtggttgctctttgtagcatcttgaaacatggattatggaccctgtcagtcatctctcacacttaccaagtttaacactgaccatgggaagaaaacgggataagtaaggcaccaatgaaagaacagccattttcctcagttatactaggaaaatgaaggtgcccctacagtctggtcaatgaagggaacttaggtcagaggaaacctcacagcgaagggattcattttctaattcctaccttaactttccgtatcctcatttctctagcacgtttcttgttgattatttttggaaggtatgtgattttttatgtacttatttatttggaaaataaatcttccaaatgcatttccctgtcgtcatctgtgtttcctaactcttaaagctctggtccctctgaaggctcagcagtttccccacctgccatgtggattgacccagcattttttgtgactcagagggcagaaggaagcataaattctctgttttcctatagtattggggcatagacaaacagaacctcatcagatgcatgggccattccctaagcctcttaatagtctctgcttttaaaatcatgaacttttctatagtttttgtatttcaggggtttttgttgttgttgttgttgttgttgttgatttgcctcttgaatgcctggctccaatgtaatgtttctcgctgcagaaggattcctgctatggttgtggtcagaagagatgctcagaaggttagctagcataaagaggaacttaaagggggtggggggagcacttcgtttggttaaagctggttcccaatatatttaaccagttccagaattagaaagcctttctgtacattttctcttatttttcttgctacttttccttatgtaatgaaattaaaacttttggaacccacagttgacatttttcagaaaattgagttatcaaggcagtaattatttctcggggagataaaactctcatagccctaactgtcaaatagggcccttttcagattttaattacaaaataaaattagtctgctcttcctcggaatggttggcgagtggttaaacagagctttcccccaatactggtggtcgtcaaactctgctaattagcaatgctgagaaattccagttaacaagggcattctccgagactctgcaggtcccctgccgttcgccttcatttccataaggagattaggagaggaggggaacccactcaaatgcagatgcaggagcgaagcgtttttaacaagcatcataatagtaagatgcttggctagttctcgctaattactgcaacttaaacctctatttgccactaagaagaaaaaaataagtctacagtccgcacctccacaacattgtcagttggcttcagatataatactcgtcgaggagagaaaaatgtaaaagatttttaaataaaattgggttatgcttggcagttaaggcttctggcttgggccaatagcagaacaaaataaaatctgattactccaggcatatgctaatcactaatgctggtctaaaagtgtatagctttttgctgcccatgaagggaagtattacattagatgaagcacttccaattttcataaactatgccagtagcaacattttaaattctcagaggatgaagcaccctgttccaagtctctttctgctagtcaatagtgtattgttgctggtactgtagtcagctattataaccccaaaagaggcttgcctctgtcatgggctggggctgtcatagttattattatacttaggggactatgatggtgttggattgaaatcggtggccagtgatctaatttttttcaatatgttctaaaaatattctaatgagaaaataggttttgctaccgccatcttctttaatcttattttcgtcgcaaattattatgcataaacaccagccaccattagtttattgcctctgataagtacagtagacttaattaaaataaagctgcaaataaataccacaaatgataacacgactgtaatgcactcccatagtttattcatatgataaagcaattaacaagagacctagccagacccccttaccctctttaagtagattattacagagttcaggtgcaaacacacattggagaggttcagactatccccattgggggaaggaaaaaaaatctgcctcctactaaccttgaaagaaagatatcaagatttcaagagatgttcttttatcgtcatccattatcagtatttatattaataaatattcgccaccgttgtccacatcaactcgttggggttttttttcttcaaacttaatgatccataagctttttctaagttttcagaaaaaagtgctattaagcacctacagatacatacacaatcacaaagtgaatgctcggcctgcccttcgtggcgcgcggacaatcataattcattcatactttgaatctcataatttatacctattttcccctcgcttaacctcccacttatctggcggttctatgtacatttctaagttaagcaaattaaatttgattcttatgatttcgtcccacggcttatatgatatgttaacttttcttttgtttagattatgtgtaattagtttgatcttccatcctcctcggtttttttttttttaactttatttttacacaccttcttttaaaggtaaaagcactctagtaaaagcaagtccaccagcagggggcgcagcagccacatctcagaaactaggcgcgctgaaaagtcggtggccgccttccctggctcaacctttgctctggtctccagagattcgtgttgagcgtaatagtacaccccgattaaggagaaaacaatgctttaatttgaagagtcccaaatatttacgcgtttctataagtcctttccgggttcccaagaactaaagcaaccaaaacttaaggagaacctggggcagtgagaggggtggactagagaagaaattatttatttcaagtttacagaatttctttaccacaatttttctgggtctaaagtgggcatagttagctgagtgtgacaataacagccaagcctgggagaatggggattggagatgtgggggtggggaagaggcgttggtgggcagagagggaaggataaacagggcagtttgtaaggacaatgagcggagcgtggccggcagatacccttgtgaacgttttctttaggcagagttggggtagatgaggggaggaggggccgcgagagtattgcagggaaaaaaaagaaagaaagaaagaaaataagtaaccctgatggtttaagctctttatttaaaaaaaaaaaaaaaatggcatcaggactttcttccttctctcccctcttttgtacccaagtgcattttagccacaaaggttccaacaagagagtggaaggaaacttagacggggctttgtttgactccgtgtagcgacaacaagagaaacaaaactacctatttgtaacggacgtggggctgtggctctgggctttttgagcgcctgccgattgaaatctttacgtctggacaatgggagatcggctaaaattaccctctcgggtcctgggcaggcaagattcttgaacccctacccccgcccccagcccattctcccacagcctgggcttgcttggtgccggctcctcgggttcggcgggccttctctccgcctgcacctgcacctctggaccccgcgcgcttcccaggccccggcgcctctcggccgggccttcgtgactaccaccgtgcctgtcagcaggggcaatgccggctgcgctgccccatcctgagaacgctgcgtgggagggagtttgtgagcgcagcccaaatgccacctccgcgcctcgcggtgggatgccaggaagttgcgtgaccctccccccatcccctgcactcgggagcttctttccgttgatgctttcgtccccaaggtttcctctgaaactgccaccactaaaaatcctcttgtgtcagggttgggagttagaaagagcgggagcagagttccagctttgcctttgcaccctttggatggggcaggttggtggagtagggaattaggggttgaggacacgtgctgcggttccttgagccacacctgagtcggcctaggaaaaggctgggaacaaggcctggtcctagctctgctctacagtcagctacatgggcagaggactcgtgtttgggaaccgagccgatgacacggaagccaggagggcgctgaggcccgaggcttgggtctaacttctcgtctgtacggtgagaagagggggtgagtgggtgctggcgacaaggttggaagaggggctgcgacagagcgcagtgccgcggatgagcgcagaaacaatggcacaccacctccggctctgccagcttcctgaaatactagttggacagtcgccctgaaccacccatgggccttgccccaccctggccccagcttcccgcgccccatccacccttatgtatccaagagagagccaatattccgtagcatgggggaaaggagctgtcgtcttggtgctgtttacccacttccttcgaacaggcgtgcgccgtgacctgttgctgaaaacggggggcgggggggggggatacaaaggttccccagcggccggctgcgggcccgcctcccccgcgcggttcggggcacagcgctctgctgggctcggctcggcggcgcggcaggccccgccccctttcatgcaaaaccctctggcgaggctgggctcgggcgcaggagccggcgctcgctgattggccgccggaaacccatttattccctgacagcccccatcacatggatggttgtctattaacttgttcaaaaaagtatcaggagttgtcaaggcagagaagagagtgtttgcaaaaagggaaaagtactttgctgcctctttaagactagggctgggagaaagaagaggagagagaaagaaaggagagaagtttggagcccgaggcttaagcctttccaaaaactaatcacaacaatcgcggcggcccgaggaggagagcgcctgttttttcatcccaattgcacttcgcccgtctcgagctccgcttccccccaactattctccgccagatctccgcgcagggccgtgcacgccgaggcccccgcccgcggcccctgcatcccggcccccgagcgcggcccccacagtcccggccgggccgagggttggcggccgccggcgggccgcgcccgcccagcgcccgcatgtataacatgatggagacggagctgaagccgccgggcccgcagcaagcttcggggggcggcggcggaggaggcaacgccacggcggcggcgaccggcggcaaccagaagaacagcccggaccgcgtcaagaggcccatgaacgccttcatggtatggtcccgggggcagcggcgtaagatggcccaggagaaccccaagatgcacaactcggagatcagcaagcgcctgggcgcggagtggaaacttttgtccgagaccgagaagcggccgttcatcgacgaggccaagcggctgcgcgctctgcacatgaaggagcacccggattataaataccggccgcggcggaaaaccaagacgctcatgaagaaggataagtacacgcttcccggaggcttgctggcccccggcgggaacagcatggcgagcggggttggggtgggcgccggcctgggtgcgggcgtgaaccagcgcatggacagctacgcgcacatgaacggctggagcaacggcagctacagcatgatgcaggagcagctgggctacccgcagcacccgggcctcaacgctcacggcgcggcacagatgcaaccgatgcaccgctacgacgtcagcgccctgcagtacaactccatgaccagctcgcagacctacatgaacggctcgcccacctacagcatgtcctactcgcagcagggcacccccggtatggcgctgggctccatgggctctgtggtcaagtccgaggccagctccagcccccccgtggttacctcttcctcccactccagggcgccctgccaggccggggacctccgggacatgatcagcatgtacctccccggcgccgaggtgccggagcccgctgcgcccagtagactgcacatggcccagcactaccagagcggcccggtgcccggcacggccattaacggcacactgcccctgtcgcacatgtgagggctggactgcgaactggagaaggggagagattttcaaagagatacaagggaattgggaggggtgcaaaaagaggagagtaggaaaaatctgataatgctcaaaaggaaaaaaaatctccgcagcgaaacgacagctgcggaaaaaaaccaccaatcccatccaaattaacgcaaaaaccgtgatgccgactagaaaacttttatgagagatcttgggacttctttttgggggactatttttgtacagagaaaacctgagggcggcggggagggcgggggaatcggaccatgtatagatctggaggaaaaaaactacgcaaaacttttttttaaagttctagtggtacgttaggcgcttcgcagggagttcgcaaaagtctttaccagtaatatttagagctagactccgggcgatgaaaaaaaagttttaatatttgcaagcaacttttgtacagtatttatcgagataaacatggcaatcaaatgtccattgtttataagctgagaatttgccaatatttttcgaggaaagggttcttgctgggttttgattctgcagcttaaatttaggaccgttacaaacaaggaaggagtttattcggatttgaacattttagttttaaaattgtacaaaaggaaaacatgagagcaagtactggcaagaccgttttcgtggtcttgtttaaggcaaacgttctagattgtactaaatttttaacttactgttaaaggcaaaaaaaaaatgtccatgcaggttgatatcgttggtaatttataatagcttttgttcaatcctaccctttcattttgttcacataaaaaatatggaattactgtgtttgaaatattttcttatggtttgtaatatttctgtaaattgtgatattttaaggtttttccccccttttattttccgtagttgtattttaaaagattcggctctgttattggaatcaggctgccgagaatccatgtatatatttgaactaataccatccttataacagctacattttcaacttaagtttttactccattatgcacagtttgagataaataaatttttgaaatatggacactgaaattatgcctgagtctttcatttctttgtggctagcatgcttatacataacttcttggggaactggataactgttcagccaccaagatcttgatgttaccagcaatgtctgttagctttaactgcagaagaaaaaaatggccgaatgattaataacggggaactgaaatgcgttgacatttctagaatagaaactagaagcatatattgtaagttcacccccctccttccctgagcagcgtgaataagcgcgatgtgggcttaagctcgctttagcacttgttgccagaacgagtcaattctgaaaattttcgtgtagcttagcagatgagatactgcgccaaatcagaaccaggttggctgggttggttttcattttcttcacaacacaatggccctttgaaatgtggtttataggggaaaatgatgcttcttgtatcggaataattacaaagtagacgcgccgagcgttctgcggggtaggtggttgggtgactcctagctctgtctgctattgtgtgaggaaacaagtggttttctgtctttgtttcctgacttcataaactttgtcctctacgttttcctgtttggggtgagggaaaagagaagagcggcttgcaaaattcccttaattatcatggactttttatttatttattccccccccctttctcccccacccccccccccactccggattccacttcttaatttggcagcgcgggtccaagcctgtagtcccaaatcggaaaatctctgcagctggtacacgcaaaagagaagccaggcaacagacatattacagaagaaagctctcaactccgaggtagatatttcgcattgtgcgctctcatcacatttggacatgattgtgcttttgatctgttaactgttttactacagtagtagagagagggggaggagagagggtggggaaaggagattggatttgctgttttcttttgctccaggaaaagtaagaggctggcgacgtcctcggttggagcggaaaagttgggggaaccgccgtggtctttaagttcaaccagcggctctagcgtagccgaggaagtcgctggcccgctttgcttttttttttttttttttttttttttttttttttttttttaattggctcctggtttcggtcatcttctatccaaaggcaccaagaaccagaaatggggcgtccttgtgagttctgcattgcttcttatttctagagcgtccactagctgcatctctgcagaagttaggatcccggggcgctttctgcccttcagccgagtaccggccgccgccagttctctcagcctctaggcctgtgtcgcctcttttgcaagaaagtaatttctttcttaaagagctactaataatgttctttggaggattatgaaggtcctgttttctgtgtttatatttcttctcggtcttttcatttcaggtgtagagttggttgtttgattctttattttcgtttttagggtaaggtactgggaagggacatttattcagttcccagtccaagctaggcaggttcccctctaattaatgcagagactctaaaagaatttcccgggctcgggcagccattgtgatgcatataggattattcacgtggtaatgagcacagtcgacagttcttgctcacacataggaataaaagaaactttgaataaagacccaaatgacgggcgtggggggagaggggaggatattcccggaactccagccaatggacagtataaaatgtatatgtttgaaaattaatatatcttaggggtatatataaaatttacaataattgacccgactcagcctctcaacttaaaggaacaaggaaggggcttggcatatctgacccaaatcaaacactttggggagacgctcaggttcaaatattttgcaatacagaagagaacttttgatagttgaactcattttaagttattatcactgcaaaaaaaggagaagccccattcttgctcttatcccaccatatctccaaaccaaataatttaaaagaagaggccaaactattttgtttgcaaatatagatgctttgataaactgcagcgctacccatttcattaggtaaaacattctcaagatgtgcaattgcataactaggccagaattaataagcaaataattttaagaataatttcatttttttaagaaaagagataaagtcatgattctacccagagaggacttgctgatgtcgctgcctgtgacttctttccgaggaattttattctggtcagtgaggccttcattttcagtcaagaggggaatttaagtgttgctttgactttatacacagactagaaatctgtaacaggacgagcatataaccagttcttactacatcttttcttccatacccaccccctccatatcttaaagagtgttaaaatattttgctgagcgggagtagattaacaaggttcctttgccaatgccgggaagctggtatcacagaccatcccaggggaaaatggctcacattaaccactaaatgaatatttgacaagggctcattcggaggtattattactataaatgtgtccctactggacttttcaaggtcaaagagcaatgcttcaattaattatttagactgctagtagatttggatgtaatagctgtacttatttctggaaagcgacacattcttgcagtggggaaacctcccgagactctccatcagcagcatctcaaatggaaaggtgtgtgaagccctggcatgcccaaactgactttttttttttttttctttcacgaaatgttttccaaagccaagggagagaaataccctttccccccttccctatttcagcaactatttttagtttaaaaggaaaaacaatataatttatgttcgtttcatcatcatgtctagcaagatcttctagagtttgtgatgttggggaggctgggtggtatttcatataacctctgccttgtctaaatagcaaagtcggaggatttcacagccccttcttgtcaggctttgaacacaggtagagtacagtatcctgttagacaataaaagcaaaggtttgaaatggaaggcaccgggcttagagtactgagttctagtaatggcagagtaaattggggtgcaaggtggtccccccttctcctattggtctgaaggctgtaagggagggcacattcctgccatgtcgccagttcctccatgaccctaggtaaaatggtaatcgaatgattttgagagtaagattccttcacaataatataaattgaatgaataagagataagctggggggtagtaattacagcccaattcattcagctttgcagaacttttgttgtaggcgctccattgactgggtttgagctgccagctttctcacattaaaaaggagctgatcagtgcctggggggagggggcggggggggggcaaggacaactgctaaactgcatggctctggggtcttcatttagaaccattagaagagtgaaattaaatcgtgcctttgtgtgcgcgaggtttacacttttcaactgctcacagtttatagctaactgctctgaaattgaggtctgactgtggcctggtcacctgctagttggcatctcttatcggtctgtcagtctgtctgtctacctatcttgggattggaagcacttttctctcttcaaactcccccaccccaattccttgtttttgaaagttttgaaaaataggcactcatatttttcttcctggagtttttcttttggctgcaactgttttagccaagactggagctcacaatccccccccatacccccaccctactattacttcaaaataatttgcatctctgtggggggttttttgctttgtttttgtttgttttcggctgcttctcgctcttggagctaagacttcttttcaggctccacctgggcctggggttggggcttgacttcatattctacactttcttttttgacctgacttgaaagatgtctgactgcctctccctagggactctatctaggagatggatccctggaagaagggagacactccggcttctactgtgagagtctggataatatccaaaggcacacagcctctggaaacttaaaataaaaagctcaacagcgctttccaaagacagggaaaaggctcaaactgcaagattaggtcgacgtctttcataattattttctattaaaaactttcccggaaatgtgttcgtgacaccagccgggagcctcttcttttctagggatactggccagctctagtattgttattctccgcaaggatattttccttctgtggcctttagaaaataatggacgactcgactttcttgttttgactaacgaaacctctcttggagagactggagtacgcaggtaagcagggatttctctagtcagagcactctttctgtgtgcggtcccggatagattgtattttatactttggtagaacgggaatagtgctaacttcctgggcgctgctgtcagttcctctccaaaagcaagcggtaatctttgtcatttgagggatgcagagatttatttgctgcttctgggccagcgttcggactagaggcagtgtttctagttggcaggcaagtcaggtgattcaaacctcggaggggccattagttttatgaccccatctgcttgtctatagcgagtcaagtggacacggatgtataaagatttcggcgctttgaaccacttttgcttctccaggcccaggttcggcagggctgagttgagagctctccagcctcctgcaggctccctgaagggaagggactgcagggccaaagcctggagactggcaaggtaccgactggagtcggcagctaacctggactggctaggacctgacgtcactgcggccaggcccccatcccccgagactcccaaaaaagctgcagaggggttcccagtgtctctgccctccccgcaaccctgcaccaaaagaaacttgcccgagtttctggtactgtgtagctgttacagagtccttctgacttaggttacagagtcccctgcctcctgctcgggagcctgaaccctctatatgttgacctcctggcctcagagatggctgctataggcttaataccctcaagatcggaagttgttggcctgggtgttgtcttcttgacatcttaccctagtcctttgcctgtggccaagccatactgggctcttctcacccaagatttgagccagagaggactggtaaaaatgtgggaggctttgagagattattttggtaggggggtggggcaggagggaggtcgagatgaaccagcccttcacttcctaagatgtgtaagagatagctgtataagaccacctccacacacccctctacatctactggcttgattggagcctgagattaaccctctgtctaacagaaggtgagagacagggaaccagtgccaaggcagtctcaaagctgtatacaaaggtcctggcccttgttagggtgctaagcagtgatgttagtcttgggggtcactcatcttgcctctttatcaccccccttctgacttagggttagcctgggaagttactttgagactctgccatctgtgtgtgtcttcctgaaaggaagaatattggcgcttgagacgagttgccccacctccaaagggcaataaaatgctgatggtattagaaggagcagtgacttgtcccctagcactctttaccactggtggccagaccagaatggggagatgcccctacccccaacttgggatgtcagggtctgcagctactctgcgaggcctatacaggaaaggaaacaccagagagttcctggccaaaacagtaaagttgatttccatcatactagcaggcccagttttggaggaccctgaccaccccaacattcaaatggctgatctcttataagtaatcccagataagctcacacatggcctgcatacctctacagcaggactcttttccttgatgtgtgctttcagagttgagtgacctgctagctagagtttatgctaggatcagaatgagttggtcagctgtattttgttttgtcttcaggctcttatcaaattaggccagaggcctttctagaccgtggcttctctgttttcagccttcctgagtcccagcaacagcttcggacttctaaagtcttctggctctgatgtcacggaggttttgacagttgcttctggcttaccactggcataccatttccacgttctccataccttccactcttgggggtttacacagcttttagccagagccccattagacccatctcaaaataagagcaataacatatttgagtcagacactgactatagacattccacgagtgagttaaaggtgaaaaccatttggtagctggagtgtgtctaagagggacagagccactcactggtggacagacatcctttggtgttcctagaagtgcattgaccaggatttcttttcaacccttaaatccgttccattttttggattcccttctatggcgaatggtctgaaaccgaactttatattctgatatggccccagaatctcacaaaataatgactagacagaaatcagccaccgttccaatctgggctattgcgtaaggttacagtccagtcgtggcgaagcaagcttgtctctcaaggtcccctttctgcttgtttccctccactcctctactccagggaaggtgccttaaaatctcctgggagtgtgtttacttcaacttctggtaaactaggctaacactctgtcgccagctttccaaacaccctctcggtagctttgtgaaatcagtgcaaatcatttcagaattcaagatggcaaaataaagctgagcatatggaggtaaggcttggctgtcaggaaatggatttaaatgtttagctcacacctacctcaggccccaggacttcctctttcctcctcagcagcttgctcctggaatttgggtaccctacctctcttagcaagctggctccccagcataaattatgagtatgtatcaagtgggcccttctgctaagattaatcagggcctattctctcttgcatgtttccactttgatccctatagaaagttctccttaccctgtaagcaatgtcattctacaaacttactatttccatataaactatggaggtaggtttcgatagaaaacaaaaaaacaaaaacaaaacaacaaaaaaaaaacaaaacaacaaaaaaaaagcaggtaatcctcccaccccccacccagccccaggaagctttccaagttaaggacacaaaatatttcatggttagttgtgtgagcttctaaattagctgcatataaagtattttaagatttttttttttttttttggctgtcactggctggcaatactcattttgtgtgtgtgtgttggtttgaaaagcaggaagaaatgtaatgaattgagtgctgtcagagatgtcttctgtttgaacaatctgcgacgggctgaatggcagggactccctcatccactgcaggtgcagtagagctggggaagggggagggggccctctgttcagtcaaaaagcagcatttcccacaatagaccacacactggtggccagcgtgacatcggctcacactcacatactttcccccatccacagttctgaaccgacaaagtggccatacagtaggcttgcataggttcctttaatgaacattttgtggttcctatggccagcattgaaatccatgagccctgggaggaacaaatagacttttaatcgtgagttcccaactcaaatctattgctgtagatattaaaagtaagcggatctctctgctctcacccaatatcaatgctcgagaggcccagatgtgctaggatctgagaactctaagttaaaagtttttctgagactacttaggatccaagcctgggtcttgcaagtcctgtgagatcaaacaggaaaggagagaaggcatgaatttcgtgtatttgtttaaatgtaaaaggacctctagtattttattatgcggcatgagagggctaatcctacaaatgaaggcaccttaatcttgctgagcacagtcctgtccccttttgaattggttttactggggagaggggtggggaggaagagaagggggtcaggaaaggcggcaactgttttaaaactctggacagaaatgcgaccaccctttagctgcccttgctggcaaccagcagacgttagaagagttttcctctcacactggtgtgagctcaggcccgggtgcagcaagttttaaatggaattatttaagtgtgagaggctactgggaacttggcagtcaggcccttctttaaacaccctgccctccccccacgctttggccaggttttagttttgggtctgaagatttagggaaaggcaagatacttccctcagcaccaccctagcctgtgataagagggtgacaccaaggtggtccaactaatagacggttcccgtttgtgctgaggaaaattactcagtgtttacacacagttaaaacaagccaagaaaagcatcaactttccaacacccctcctcaataaaccctgtttatgattcccttaaacacttctgtgggactaagaaggacacccttgctctcctctgggtaagaggagaagccggagtgcgctgggtggttctgaaaggcattgataggaaagaccaaattctataaaatcccgaatcacaggaaaagatgtctgagagtgagacaaagctcacttgcttggggccttacggcgggtatgcctatggcgcctacttaaagtctaggcctagaagaagtgttccgattcccccatctacagagcctgcagcttaggcgctaacgtatcttccggccggtacacacccacaattaatctttcttattaaagcctccattcggtacccaaggggcaactcaaacctatttagatttccttggttggctgcacagatttaagtgggcaaagagttataaacctaataacagagggcgcgcgcgagagggatttgagtagagaagacgcaggattcacggaggtgggggggggggggaggtggaaggatgctgtgggccttgcccacgtctggagtctgcctcgggttgcagctggagctgtagggaaggcagtgagcctcccgcgcgcgcgccacgcgcagcattctcgagtgcacctgcatcccagcccctttgctcagcccgcaggtactcaaggcgcctcttccttcccaaagaggcgcaatcctcaaagcatccccaacatgggaacttgcagagaactaggaaaggtttgcactgtttgggattaattgagaataattaacactggacacggttaatcaccacttcgcagctctcttccctcctttcgggcctgtggtgtcggcctcttttgctccggctgacgatgcgggtgggtttgctggtgaaagtgaagacgtcgcagtagctgtcacccagttctgctgtactttaaagcgctcgcatattgtttgattactaattcgagttaatatgatctttatggcaacataacagtggataattggccttttttctcaacaacaatgtaaatcacaatcgctttattatttaataacgtcaaacgcttcgttggattggccccgaccgagaagaccttttctttctagacagtattatgggggaaggacaatgaagatctaattgtggaggtttcataagttggctccggtaaatgaacagcttcgatatggaagtcccagcagatgtgggcaccgctagctgtagaaactccaccccacccctctacccaccatccaaacacactgttggaggctttctggggtggctgtggtccacggagcctagcaaccacctgaagttcccagtagcaattagagcttgtatcaggctctttacattggggatttatcattaaggcatccagtcagctcaccaaattaacacgacttgcaaatagccacaaccctttgggcgcccttacggtgaatttggctgtgggacagggagagcaggggtctgcgttttgttttgctttgttttggttggttggttggtttggtcttattttgttctggtgtgattttaaaaaaaaaaaaaaaaaaaaacggaattagtattgcagggtcttggaatatacttgtctcagacagtttggcaagggacttgagccattatttctcaaatgcctgggaaaagctgagagtacccagagaccctctcacaagaaagaccactcatggaaggaaggtgtccccgctgctagaaagatagcctcatcacccttgtccccaaaggcccagttctaaaggcatccaccgctgcttctgctgtggtcacaagaccgcggacgctagggtcttctgagtggcaagtcccagcctttggaattcgggtcagaggagagagactcgcagcctgtggaggttttgtttttgtgtgtgcccgcctctccattttagtcaactaatactgcctgtcggggaaaaggaacaattcgctcccacccacccctccgcgcctttctaagataaacaggaggtgcgaaacgcttctgagcacacgcgccccggggccctcctcccactctgtgcgccaaccgagcatctgtccccgcgtccccgaaccagacctgggtgacaactgccggtatttcaaaaccgtcccactgaccgtcaaccatatttacaatcccccaccccccaaatcgagtcacttctctgcccactctctccttttctgagaacttaaaagaagtggaaaacgttgaggaattgagagtggactttcaaaaacgaatctttgcccaccgaaacacgcactcgcactttttaaaaagtagtatttcagcacaaggaggacatttggaaactttctcttaacaggagtcgggcacattgctattcttgtgtgttggtcgtctggcctccccacccgcggcggacaatacccgcattgagacgcggtggcctgcgggcagcgggaagcttgggactgcgcagcctcctccaaggggcccgcagctacgggagcactaggatgggagccggggcggggaggtcggtcgccggaaggacagccattagaagtatcatttttgcctaaagccttatactacgcctcgctttgaggacttagatacagggttgtataaagacttagagagtaggaagaccgactcaactgaggacgagtttcgcattttgtttcattttaattgtcaccccacccccccgcacgcacgattttatttagacactgaattttgcaccccaggcggtccaaccccacagacttcactcctaggcacctcgtcttttgttaatatctcaacctcgggctctgacgctaagcaggcttccgccttggtgccaatttttgtctcacccgagccctggtacactgcaatctcgcgctgggagtacggcaccgcagagggcggggggagcccaggtcagagactcgggaacattcttttctaagctcgattgttttctccctcagagcacaccagcacccagggcctttgcagaagaacctcgaggtcagcagaggccctcggaagggcgccacagtggctgaagctggcgtcttagggtttaaaacgtgcaccccgccgagtgttgggaccacgtgctgcgccttcgaaaggtgacggcggccccgctgcagtcccgggcggcgggagatggcgcagggaacgccgcagcccccggtggcggcaggggcgggtgctgtgtggcagaactggcctcggcgctgagtgcagagaattatctggagcgtgcttgatctggggctgcgtagtcagcgtagtcagcttctgctttatttgtttgtttgtaatctcatatttagcaagccaggacggtggcagcgagggagaaaggaagggatggaggagggggcttcgcgctaaccacaccccttcctaatgagttaatttccatatttgcgtctcccgcttctagcgccctctctttccgggcgcctccgtgcagttgcgtcttgcgcagctcagacactctccacttaggaatgaaacaaaaaagccccgggtaagagcagaaaattggtctattgataacattcgctccgagtgttgatcttggcattgcgggcagccggttagtctccaccccactccccaaatgggtcacacagggattgcagagggcttgcggacttactagctgactgcagacagacgttgacgtccctcccgcctccaactgtccgaccctcgcatcgtcttttctcacaacttcacatttttttgtccctcagggtaaaaacagtggaaacctagccaacgcagaaaaggaggggaaataatctcaaacaaatgaatcaaaagcgaaagtttcaaactagagtcggactggggcaggggcggggggagataaagttttgtactagaaaaggagtgctggtcgaagctggaaacaggctctagggtggacacctgtgggaatagattaaggaaagctacgaactggtattgccatccaacaaaaagttgtggcaaagacagtgaaaggagttttggagacacaggaactcaaaggcaagccacgaatcaggacttctatctcggttgtctctgcttggatgaaggctctgttcaaaaaagtccatgcaagaaacagaccttcccagttgctcaccgcccctgtccctccccaccttggtggcttcaactcctctctggctgcagtgtctaaacagctctctggtcaaaataaactgtcccaagaaactttccaaactggggagcaacttaggcagttaggcagggagctttaatcaagatttgtagctctgcgaggggcagcgacagcaaacatcccgcaggtgtacgccgtaactccaccatccggactccaatgtagattactctggccgcgtttgatcggctctttgaaagcctttaacaattgcctgtgacgaacgaccgggctcagtgttttctgaataatgccttgagcgtaagtcctcggggtctttaaagagctccagtttgagagtgctagagggtgtgtgtgtgtgtgtgtgtgtgctgttttcggttttgctttgaaggagaaagggggggaactagttcggtttagcttgtacctcgtcaacttttagctgctaacaggtatcactcaagtcagtcaaacgcttgatccctgtcacctttgcttgctgtcttccagaagctgtgtatggcatattgtctgtgtcaagaacattgcttttccttttaataatgcattgtgtatatgtgtatgtacatattgtattgtgttgtgttaatgaaatgacacagttactaattttctgtcttgtcagttacaactgcacttcctgctctgttgaggtagttagaacaaacactattattattaccactttaatactgtcctagtatcttcgctgctctttctaaactgtatctattcagtaagagttggattcgaacgtcaacgttttccaaagtaaaacccgtagtttgccacaaccccttccaacacctaggcaccaaaacccaacaccaaatttttttttaaaaggagctgcttccaaacctgtcttgtttgcctaccgtgtttacataaggggagggaggcaaacttttgtctgaaacttacactaagcagaacttccatttcttagagtgtcaacagttgcagggcttatcacaccagtgtgaggggcacacatctgaattgaaggcccactcctgccacttcagagcacgaagggctacctgtgaatgactgttaagtttgcctactggaaaagtttttttctgtactaaatcacactgaaagatgggcaacgccactgtttattatccaattctggacaagatcagacccccagtacctaggggctcctagctctggccagcaggggggatggaggggctcttcacagcagccccctagctctggccagcagggggatggggggggctcttcacagcagccccctttgttctcctgagctcctctctgatttcaagcttcactcgcctgccccccccccaagtttgtgtgttaatgacgctattaccatctggcttgccctactttccaaaagatataaatctcccagcttgactgcccacattatcatttaagtgccaccatagccagaaggaaaagatgctttcaaggctcagattcttgtgctcagactgccctggcactactcctgtgctatatgtactatagactgcacattgagggcaagactacgcctcagagagggcacatcccccaaaccaaagaagacttgttacctggtagaagagactccaaatgatttccctctaaaactattttttattttatccagatgcgccaacgtcttttttgtgcttgaacacttctctcaatgccctcctcttgggctagtaaaagtgtcagcaagacttccaggcattctgagcaatgtggccctctgtggccttccttttcaacaggagaatagattgtctttctctgtgggaatgggggcaagtgaaagagaggtgaaaagatggcttttgggagctggatagcccggtcaatctcccacttttaatggcgcctgtatgggtgtctgtgtgctcttcatgtgacttacacactcctagctgcatgcctggatcctcctctgtctttcctgggcatagtcattggtaggtttttgctttttgagcacaaaagctgaggacatataacaaaagtaactgggctggcttgtgcatggtcccaggaagcccccacttatctggcctggtctctgtgaatggaacagagtagactctgcatctaagctcatgtgggctgaaggttcaggcccctccttggtttgaaaagttcacacacacacacacacacacacacacacacacacacacacacactttccagatttccagactgtttgcttacaggcagtcatgtctgggtgcctctgtttgtgagttctcccttcttcctagaggcaggttccattcccgtcagccaaccctacaggttggaagaatcagaagtgtgaacttcccggatacctagggaagctcttcaaaatcagaattttagcatttgaggaaattagctgaagggccagcaaacacacatgcacacacagatggacgccatcacatttccatctttaagaaaaaatatttatatattatttgcttacatatccctactgccttatttaaactaagcaaaagatgcacaaaagtgactactctatagcacactgataaggctgtttttgcacgagtctctttattcccctctcagttcattttctggcctttttcttccaaactcaaaaaaaaaaaaaatcttgtttagaaatttgtatcccccttttccttctgagaacattatcgagttgatatgaagaaattgcagaggatataccatttaagtaagatgcacttttaatcactggtcattaaaatggttatgttaaatatactcaattacatgcatgacttaactctaacagtactgtctattctcccagctgctcacgtattcctaaacggtagtctgcggtggaaacttgattatgctgaatccatacatttccatggatttcatcagcctaattaatgcctcagtgtggtcctggggcctgaatgaaccttttactgtcatttgaggtttaaggcagtgttggaatgtggaagtttctctcccctccctccctctctctctctctctctctctctctctctcttgctttggggattccactaagcagggtaggtagcaaccgttaaagaacaaaactattacacatcgaggaaacccgttcaaacgtcggggaggaaaagtagcccgattcttcatttgcatattcttgatttcatagacaacctccaaatatttagtaaggcagaaataccaccatgctattgaatctcaaaactgcactggaaaagggaaagttggaaatagatttacaaccggtggctgaacccgtttcttttgctcatcaaagctgccctgctccgtcctttcttccggctccatcactcctagactgttcccctccactgcaactttcatctttcccgaggaagcactcagggcgtgttttcacaagaaactcaaatcaccccccaagtgggtgactccattctgtcttttcaggtgtaaatttacatttgaatacttctcaacctcactgacccctgctatccctggccctgcctcctccgagctgctgccaatctacaaccccaccacttgcaagggcaggcagaggtcgaatttcccaaactccacccctaacccccgagaccaacaagtgctcctacttcccaggagagatagctcaatatgtctgttcttactaacatggatatggaagaattccatatacatcttaaaaagatgtattttcttggttaccaacaagaggagagggagagagagagagagagagagagagagagagagagagagagagagagagagagagagagacgcaggcacagagatagacacagagacagagagaaagcaaaaagaggtggaaattctggagtctttaagaaatgtagtaactcaggcccgacatgctagtgcattcctttaatcccagcacctgggaggcagaaacaggtggatgtctgcgagttcgaggccagcttgatcaacaaagtaagttcaaaacagccagggatatacagagaaatctgaggggccaggacaggggagtggggggaggaaaagaatgtagcaacactggcaagtggacattgaaacttttccgtcttcttgagtccccaaggatctgggctcccaggaccagattctatgccattggcttagaacttgagtctacaggggaatgtcatacctgggtgcccatctaatgaatagaaccacaggatttcagatttataagcttggaacttcatgtaggttattgctaatgcaataatttttgtactatgagtatatttcagggttggaagttagccttttgtagggccttgcttagataagggattctagaagagacagtataccaaaattggcatatactgtgggccatttagacagatcaatgtagactcagatatgtctgtaaaacttaactaagccaaagcttaggggactgccgtagaaggcacgtgcaggtagccagacccttatgagggtctaggagggtctcttcattaagtgtaatgctttataccattggtttggaatttaggaggtgagagacagatgataaacattgaatgtttgaggccagccttggctacaaggaagacactgtattgaacttaagaggaaaggataggacagtcttggcagcatcccatcccacccagcagccccttacctctgactgggatgctatttagtcatttcctataatggcaagaaaggctaacaaactgatcaaatgtccagttagctgtctccataaacatcagagttggccgaccacatctggcatgatgttcctggtcctgacttccgctgtcccactttcactggtgacacttgtttttgaaatagtgacttggtacctgcgcgggctttgtcccttccgtccccattgctgttttcgaaaagcctgtggatcatgatcatggatgaactctgctgtttcctcagtcctccagcaaagttgccaaagacagagtctgacagagtgccgctcggacatgcgcaaagcatccctttccgtttccagcccagcataaactgggtgtatatggtgcatgtctgcaatctcagtacatgggaggcacaagttcaaagctagcctgggcctgagcctgtctcaaaagactaattggaatgtgtcaggtggcttccgagcgcttgtaaaatgaggctgattggaaagcctggccttttgcagaatccctggttgttctattttctttcagagctaagtgggtgcagcataccaaccttgactccagaaggctgagcaaattagaagtggggtgtttcattgtccaaccacagatgctaatgatggtcgacgtaggaaacacagactccgacagccgaggtgtagcaatgacaagtgtcacacattcatgctataaaatgataagctgtgtcacttggcctgttgctgtccgatctccccttggctttcttttttatttgtttgtttgtttggttggttggttttgcttttccagacttggtttctctgtgtagctctggctgtcctgaaactccctctgtagatcagactagtctcaaacgcatccacctgcctgtgctattggagggcagagattaaaggtgtgtgccaccgttgtccagctacctctagctttcttctgcatatgtttgtttactcacatggatggtttgatgcagggacagggccactgtgttatttgctgcacaggctgacagaattctcaagggtatttttacctacagtgtgtaaagaatttgtggtgtgccacttagcagtcagaaaacatgccctcttagcagagttttggggagagttaacacgttttctgtagaatgtattctagagtaggtgcatctggcaacacgtttttaaatgatttcctatgaaacaagtcactgagccgagtagaaaacaccatgtcactgataacacacttggtccagtcatgggttcctcttctcctctgagtggcatgctagccttccttccttcacgaggcaaactgcagcaaggctgcacacgtctccagcagtggggaagttgggacaaaggcgattcaaactgtgcccttgttttcggagttgcaggatttaaatgctgcagtaccctggcagtggccctgcaggctggctttggaactgttcggtgcttagtttctaaattctacttttaaatccaaatccgaatttttttcccccattggttcaggaaagaaaaagaaatacctaatttgaaatcctgttataaattctacgaaagccaacttagaagagcttagaaatagctctgagtcccacatctcaatatgctgtgctggctcctgtggttgtttctgaaagaagaaagggaacacctggtctctaaccaggaggaaagcggattccggcaccggcatctcggttgctcagtgggggcaggcctctgcactcccagcgatcaggaaatttaaagccggttggatacatctgcaaacagcacatttcccaacttgggaaatgccagttcgtgttatttctgtggctaggagttgcttaggatctgtgacagctgaggttttcctattgattttatgacaatgttgttcagagagctcacagaactgagaagagaggagagtccagtttagcaaggtgattctgaactcgagtgctgtgccttaatcaaagtgcggaaaatgaaattcgagctccagaaagctgcaaagggggaattcgattctgagcctgaacttttatacctaactcaaccctcggaggaagaggggtgggactggctgctgactttgaatacttatgattgaccatcggatgcatcagcctcaaaagaaatcatatcttatattaaggaggcagagaggtggctcagcagttaagagtacttgctgctcttgtagaggacctaaattccgttcctagcacctatgtcaagcagtttacaactacctataactcttagctctagagaatctgatgctttctgccctccgtggggcaccagtattgcacattgcacatgtgtaatgtgcgcgcaccacacacacacacacacacacacacacacacatgaaactaaagattttttttttttttttttttttttggtaagaaaccacaagtgaggtcattgtagttgattctagatttgtgagcatgcccaatgagagcagccgttagcagtgtaagatgggtggaggtcgggatgaaggcaccaaacacacattgctctgaaaaatcttcaaactcatatttagttcttaaataacttgatgcgcaagtattcttccgatgtagccacagaggaaaataccatttttcatcttgtgcattattttctccatggtaaggcaccggcaagcacactcatctcggtggaagtccagtgaatcccaaaaccccaggacttaaacaaacaaacaaaaacaccgggtcaagaaaaatttgtaggtcaaggatgcggagtccgtgtgcttggaaggcagaaacgcaggtggagcagagagcagccctgttggaactgtggaatcactaggtaacctgagcaatcggtggaggctgctagagagctggctggcaggtaccccgatggtctgtgctgatcggagcacaactgggaaactgtggcatgggtcagggtctgcagcttgcccgcctcatcatacggatctgcttgcatcactgtgtttgttgctgaaagccatccagcttgctgcagccacgtcacccgccatttgtcagcctgattcattgccggcagtaacttttcctgatgtctcactctctgacacttgtattttgggattaaaactagatgtcctaaggggctagggatgtagctcatttggtagagtgttttcctagcatgctggaaagcctggatttcctacataaaccagacatggcagcatatgcccgggactctgaagatttaacacaaggctcggaagctcaagttgaaggccagcctaggctacagagaacaaaacctgtggttgagagaagcatccttggcactgttcctcacagagacaaggcccaggctagcagaaggaggagccacttgaaccatttcatcatatctctgtataagtcgtatgagttctgatggcctggctcctctcttctccagggccgttcacagtcccatcacctctgtggttgggctatgcttgatagtgaggtatagaaagatacatgtatgtgtgtgagtatgtatgagtatgtttgtgtttctgagtgcatggttggtggggacaggtgatgtctaacttccatccacccatcacctgggtagttctaagtcctccctgagtactgttgcagaactgagtactcccaatgaaccatcttgttggcccagtaagtctgttttcagacatgaacctgaatggatactagggagagaaaaaacaaactgacaagttttccctgatgtggaatctggttttgcattactcaaaagaaaaaggaagagctatttagctggaggaagggcgccagagagggggaagggaaaggggaagagggaaggggaaggggtatgagcaacagcctatatggtgtatgtatgtgatcgatgctatcagtgcgttataataagagacatcccatctctaagagtttcccaaaggcctatgaaggatgcagggggaggcttttccaagtgtgggtgttttggaacagactggttaagttgcccataccgaacaccttcaaagatcaggaccatggatggatgcgtcaagaggaaagaagggatcatctcctaggacagggtatgggctaggtcatcagctctttcctccactggcttcacccctgatcaggaacacgcccagaagggatattcccacttcttacttccacaagccttgcccacattcttctctctgcccagctctgaaatctgcttcttgtttccatctgattttaagacaggacttcttgtagtccaggctagcctagaactcactatatagctgagaataaccttgaacttctgatcctctcgcccccacctcctgagtactgggatacaggcatgtgtcaccgtacccagtttatgcagtaaaggattgagcgggaacctgtacacgttagggaagccttccaccagctcagctacaaccccagccccactgaacgtagtggtgcacacatgtaaactcagcactgggggaaaggaggcaggagaatcagacgctaaagttcattctcaccagcatagtgagtcccaggccaggctggtgtgcaccagaccctatcaaaagaaaaagaggaggcaggaggaggaaaggaatgaggagtagtcatctttcccctcactcgtttctcctctggggtcccctggagatttttcagaattaagtcatgatctaagttagatgagagagagagagagagagagagagagagagagagagagagagagagagagaggagaaattctccccagaagtaatgagtaagaataaaatggggccgctccacagacaataaggtaagactcacatctgaaggcagccacaggtggcaggcagaggtaggaaggggaggtttagtttagcttctcttttcaaggttcttggatcttgaagacagacagcaaagctagagtcaaatggatcagcaataaagcggcaagtcatgtttggatggtcagccatcctgggtcacatagctccaggctatttgggcagtctttcctgccactggtaggggagataaactgaaggctggcaacccttctgtttgacatcagttcaaattcgtaggtcaatgttattggccataacaactcagggaaggaaattagagaaataatatgagcaccatggcctcaatgtggtttatacaacacacctcctgggagctgggaagcttcccaaggctctggagttagtttctttacatacacctgggttcatggagactccactccggttgttgcaggaagagtcagttaagcggttttgcctttggtacctgaaggactccagctgacattgctggtagatattccctgttctgtaaggaggttctgcaggtctccagggccaagctaggtctaagagtggattctagccattggggcctctggagttcaggttttgcaactataaatttatctgtagattttagtgtgtgctgcagagcacaacacacttggagatcttcagcatcagggaacattcagcttgatgggctgctaaataaaatatccgtatcattgcataaatgtttatgcacaaaatgaaaaattgaggactggggtgtagctcagttgggaaaatgcttttctagagtgcaagaagttctgggctggatcttcagtacaaaataaaccagcacttgagaggtggatgcggaggattctgaagttcaaggtcatcggaggaaaaaggaaggaacctggaaaatgggggtggggtgggggtgggactgggggtgggggtgggtaggtctgacaactgaagaagctaactggagggtcttgggaataagtttttttttttttcttttttcagatcgaacctagaaattgtactttcctcaagatccgcttaagagaatctggttgatggctttggtctgagagttcagacatctcttgtgcaactaagaaagacctcattttccatttgctggatcctcctggtttgtcatccctgagtcctgtaagaagctcatcaggaggtcccctgcgccggaaggaccatgtgagctcatcccagatgatgggtggcaccatggttttagcagctcacacagtggagaaccacatttgctctggaagagcttagcaacatgtatttgataacacaacaaggtcagcttgagctctatccttctgtggccatactgaacaaaaggagagacagacagacagacagacagacagacaggcaggcaggcaggcaagcagacagaggcagagacaggcagacagagacagagaaacagagaaatgattcctgaattatttttaaaaattaattttaaaattcagatcaattaatcagtaatacatgcctgtagtctcagccctagaacagatcaaacaggagagtctcaagactaaggtcagcctggaccactggtgactgtttcaaagaaaacaaattaccatttgggcataatggcacacgccttttaattccagtccttgggaggcagaggcaagtgggtctctgagttcgggaccagcctagtctacagagtgagttccaggtcagccagggctatacagagaaaccttatctcaaaccagccaacaaaacccacagcaaaccgaaaacaggttatcctttaaaaagacgatttagctgggcagtggtggcacatgcctttaatcccagcacttgggaggcagagggaggtgggtttctgagttcgaggccagcctggtctacaaggtgagtgccaggacagccgggactatacagagaaaccctgtctcaaaaaaaaaacaacaacaacaacaacaacaaaaaagacaatttagccagatatgatggctcatgcctttaatcccagcacttgcaaggtagacacaggcagcgagttcaaatctatccaggtctatatattgaattccaggacacccaggggtacagattagagagacttcatgtttaacaacacacacacacacacacacacacacacacacacacaccccactatgtgaatacacaggtttatgtgcatcctatcccagagagcctgtggtgattataaaacagtaaaaatagggcacagtagacagcaccttcgagatcagcttagaacacttacctgtcacttctgtgtcacttttggtgtggcagttattatatttctataattcatcttttgagggaggctcagaatcggtatgaaatgatatatgtttacctctttactctgtgaatcaggctctcatatagtctaagctggccttgaactcctggtatagcagagggtggccttgatctgggagcaaaggtgctgtcatttccagcagagaaatgatatctagaccaaagacacagtttttattatatagccaatgcttctttaaatgcctggcaaccctcccttctgcagtgcttgatggtgtgttactgaaggagttttcctaaacaccagcacaaatgaacgggcacacatcaagcatacaagacctggaggagggagggggccctgccgattcctcagatgcagtgatggatgagaaaagtaagggtggaccagagcagccacagcattgaaagtctgtggtttcatttcacagaagtagttgttcagctctgtacttggtttgccattggcagtgttgtatagggggctgaggctcaaacccaggcccttaccactagggactgtcattcttagccttccaaccttaaaaacaaacaaaacaacaacaacaaaaacttattttgattttcatttaatttcatattgcacccaggaactattttaagaaatcttgtgtcataacctgtgaccaaaagttaagtagcagttttcctaatgtgtctgcgtttgctataaagaattgaaactgagccaggcagtgttggtgcatgcctttagtctcagcacttgggaggcagtagcagatggatttctgagttcgaggccagcctggtctacagagtgaggacaggacagccagggctatacagagaaaccctatctccaaagccggaacaaaaaaaggtttgaaactgtgtgagtattttcattgtctggcactttataacaggtcttatttggtattgacattggtatttggaatgagcatttgaaggttttaaaagcttcagtatttattttgttctaaaataaagtaccttttccctctgtgtattctttcttatgtgtaaagaatttctagatttttttttattttaatttttatgtctaggtcttttgtctacacacatgactgtgtaccatgtgcacgcctggtgttcatggaagtcagaagagggcatgggattccctgggacttcagttacagacaggtttgagctgctatgtggttattgggaatttgaacctgggtcctctgaaagagcagccaatggtcctgattggttgagccacctcttcagccctgggtgttgtctttaatgtacatattatttttgtgaagtcatttgttacaaaatgaagtatgtaataacaagtcttttggggttttcccccctaattttattatttcaaggaaggtacaatgaagagtcttcactcaaggggaaaaactaccctgagcctgtttttgaagtaaaaatttttgtttggcgatttcctccgataggtagagtttattctgggtcttatttcaaagccgattattctgagaagagaagggcaatattacaaagacaatcacattgtgtaaaaagatttgcttgtgcctcattcatatgttgtcaacaatatgacctaaaaaataggaagaaagaggtgaaaaaagacacgaaacaaacataaaaacagtatctgcttcaaacatcaaacttttccgtttggaagggcatcttttaggtctttatcaacatccaaagtataaacaaatcaaaggtgtctttcttgttcttttaaaaaacattaactgtgatacacatctctgtgaggtaggttttaacatattttttcctattttttttcccctgctccattcagtaagaaggataagcctttagagtatccagtcaccgtggtaactgccaaaaaaattctcctgaagtttgaagaggtcaggtcttggggtcgacaactctgccctctccctgagcccaagcaatggcggtcctgcggttggagtgtcaggccagatctgaccgtgggaggtgccccactctggcacggagagaaattttttgagtcagttcatggcctagactctccaggtggcctccaaaatcaattctgacctcctgaccctgtctcacagaggcatagcatgcaccctaagtaaggatttagccagagacgacagcatttgctgagtgttatttgggacagtataaacacttgaacaggcaagtgaggggttgtcagccccagaaatcattaaagctcacagcaaaacaaggaactctgctttcaaaagttacaagtgcccatgtgtctgattcagagtccctaccggaataaaaatcagtttcatgtaaataataaaaccaacagttactcttttatatcttttgctacaaatatgcaaataagatagaaagatcttcaaggaactagacaaagcacgagtatcatgtgctagagaaggaagctaattattaaaattcattaataagcaaagaacttgtagcattgttaaagtggtaaagttcatgccggttttgaaagattttaaaggaaaaattttgacagtgctgccttgtctggacaaagaaatctaagcagtggggatgaggatggaattgtctgcctcactcccttgctactttgtaaagcaaatgacttatagcctccatttggatacaaagtagagaaactttgtaaataaggaaaatcccatcactcacagctaaagaagaagaaaagagagaaaagacaaaatgtaacagtgtctcccggcagagttacaagttgtcaacagtttaagctatctaaagtctggggaacaacaccaagatgtatatatacacttgtgattctctgtgtgcaagctgtgcagagcatgcacgctcatatacccttgtgattctatttgtgtgtgctcatgtgtgtatgtgcacacacacacacacacacacacactttcttttttcagaatgcatcatcactcaagtatcacttttcctgagagagcagcggtccaggccactccctgaaagaggcccagaagggctctgccttgacccccgccgagctcccccctcatccctatttgctttccctctttgccagctctgcaaatggcaagttccttccccataggaaacagctgccatgcctttccatctgattcttttgtgaaaattctaagtgaggctgaatatcctttggggtacagactgggaggggagtgctctacacacactttctgctccaaggcctgggccttactaggcttctcactccattaaatccctattataaaacttatctccacaaagcctattatagtgttctgagaacaaactggaccatgaataacttagttggaagtgtagattattttctactggagaaaagttagacatgacaacagcttagccgagagaacagtgattcatcttaaatggatggattcagagtgcaataaagagcatctctctgtttcctcttcaccctcatgacacacttctttgtcttaagcatgtcctgatgatgccattgttccccagcaaagcacagatctcacagggataatgtccttctagcagtggacctgtagacagatagataggtcaaggggctcctgtactcagatgtgggatgaaataatagggataggatcttacataaatcaattttccaattaaatacaattattatttccttttgtttccccatggagtccaggcatgatggcatggtggaatattccttgaatcatagcactcctgaggtggagggcagagagatctctatgagtttaaggcaagtcctgtctatgcagtgagttcgaggacagcgcagttgcacagtagaatcgaagaagaagaagaagaagaagaagaagaagaagaag

SEQ ID NO: 312 - DNA, 48370 bp, Mus musculus
ttaatttttcaatcttcatttatcagtcatgatatgtacaagacaaacaaaaaacaaaaacaaaaacaaacaaaaaaacaaaaaaaaacatatacacaaactgctttaaagtacttcattaaaacaaaggtgaaccaaaccattcagaatgatgtaaaatcatgaacaaaaataagaactaacataaattatcaatacttacacatcaaagtagtcagttagcaaaacaaagctagcacctggtcacccagaaaggccaagggacccctccccaaccgttacttcactccatctctctctgcctcaagcttccctcctttcacactggggtaccagtgcaggaggctcctggacgtggctaaccgtgccgcagctcccaagacagctgtggctgtacttcgagggatgtagagcttctgagaaatctggtgctggggggacaaaatgaaagagagctggtctatggctccctgactcttgtccttggccgtggcttcagcacggctattagaaacatcttctttctttaggctccctggagagctttccactagaaaagagaaaaaaacaagagtcctttcaagaagttctccaactcactgcctgcctctcccagtttagttcttaccaacatgcgctatggccttttctgactcaaggcgatcaccagtcagaggggatgctactcagaaaacagccagggatagcaaagactcgaacttggggatcccacattagtgtgaaaatgaacacttagaggctaagggccaacagaggaacacacgaatgcggaagggatgccaggaggaggaagtggatgaagttcacaccccagaggggagtccaaaaacacccttatttctttccagctcacagggaagtgatactccacaggtatcctctattgccaagtggttctaattctgagtctgtgccagggtcacagaccctgtaaagctgtaaaggaccacctgttaacaagatgttctcacggacttatgtaagaagtaaccatgggaacaaagagaaatctggagctctaacactccaggtctagcaaccatggcacggatggtagacactcttacgtggacgggctagaccagtgctagctccttcccactgaagacccttttttgcctgagaaactttgtaggaccttggtatataaaacaggcatataaattaaatgtttcctggtaattttactgttattaaagatacaatcaaatctgcatactaatatgatggatgtattttttttttttttacacaaaaggactggatctcagttgagtatttgatactacaaggacaaagaatatcttcaatgtttttcttttatcagtattttcattttattatccacactgaacactgtttcactaaagtgtattataaaatgacaagaattatgttttagatcatttcagaaattgctgaaaattctaccctaatcttaagggcaaaaattcattcaatttttaaaaaatgaaattcatcaataaacatttgaatgcaattcaatccaaagagacactaatttgatacttagatggtaataaaggacaactggaaaataggaaatttaagtcttttaaatctttgttttctataactgaaccattatgctgtattggtttttgtttgaatacagggtatcacagggtaagtactacccctggaacccattctgtagagcctctggtcctcctcccatgtctatttctgaggcaagcgctctattaactgagtgccatccagctcctagcccccacctgtttggggaaatcattatgtttctaaaggaacagaaaactttgtacaataaaagcattgagattgatgacaacctcatctaaagtatgagccaaggtgcttcagatagcatttgttggccaggttatgttgaacggcatgtcagaatacagagtgctcaggacaaaggctgaagtttagcactgtgaggcagcatgtgggagcccaccacaagtaccctggattgattaagagtttgatttgaggggctaaagagatggctcagtacttaagagcactggctgctcttccagaggccatgaattctattactagtgcccatggggcagcgtttacaaccgtagcctcatgggatccagtgtcctcttcaggtgtgcagacaaaatacccatatacatcaagtacataaatgaataaatctttaaaaggtttgaattgagttttggtggttgtgtgttcaaagcactttactactgtatatttttgcccctcacagatttaagaagctgactcctaggccagtgctgcagtaggtagcatcctactgtaagagaagaactgtcatgttctggggcagagtaaactaacttggctttattccacaaagtcctgcttcagtggggcgtactgggcatgcacctatcatctcagcacttctgagagtaaggaggttagcaacttccaggaacgtctcaaccatgtagcaaggttcagtccagcatgggtcacagagcaaggggaaaccaaaaaccaaaccaaccaacctgctttaaaagtttcaggtgaatttaaatctgggcagcagtgtagtcggtttgacatcctgacagtcaaccactgcaagcaactgatagatggacactgctatcttcaaaacagaaattcaataacttcagagaaaaataagtcaatcccttttatctttgtgtatgttaagcacataatacgtgatctattttccctgatacttgtgataagttttgtcacagaagatttgacagcgtgttctaaaaagtaatattctgaccataaaattatgagtagtgcccagttgagagaaaaagacataagtataatacaatggttacgtggctgcatagagaactgtggtgtagatcgggaatcgtgtctgctccccgtctgccttgcatggttagaaaactggacaagcatccggaacagagcgtctgctgggacctgggccgtgggagagcagctcctaaggaaatgctaaggtgtgtgaaaccaatgccgagaagtgcaactactgcctcccgtccctaaagacagacaacataagatccagtgtctgatggccaaggacgcagtgttatagggtgtggttctgatgcttccattcaatcggcatctgcgtgtccagacactcaaggtccttgtccccagctgttttttgattatcaataaagacgccagaagccaatggttgggcccagggtgggctgcttacagttgtgtgggcaggtcacagggaggaacggggggcgggggggggacataacagactcagagattcagagatcatccagaatgtaggtggaaagggaaaacagcccacagaagggcaagccagaaacatcttggtcagcacaaaccaatgggcatcacataaggtaactgggcagcaaagttaaaggtagatttggaaggtgtttagccagaagtactggagggaagggcacagtagctgcagaaggtttagaagtgccactgagccagcaaggcatgttaaagataagctagtgtgtgtctgtgtgtctttcatctgcagatcctaagagaccctgggtgggtggctggtagtgcggtccacccagagcataaagcagggtagataaaactacacacaacaaagtctgacttggaatcaggagacaatgacaaagaaatcaagacaggacacagacagtaattttcagaaagaatcacaaaaataaatacaccaagtcaggtgctgggacattatatagtcaagaggaagagagaaacaactgaaaaacaaaagactccaaacaaaactagagataaagaacagagcatctgagatcagagtacacacaggacagacaccacccacagtgagcagcactgagaataaacaactatcaagtcaatatcaggacaaagtggcccagtgcatgtgtgatcagagtctttaaaaaggaggaccaacaggtagtttaaaaagtttcgcatgcagtggacatatgccctagcaaagtcacttccaaataaatagccaacagaaacaaaactctacaatatgaagataaaggaaggtgccagacaagaaaactacctactatgtaacaggcacggcgacatgccagaggccagcatgctaatgtccggactaactgcaaaggggcacaggaaacttgtctggctaatggaaacactgacatttgccaaaactcacagaaccatgtacttgaaactttatataaatgtaaagcccctgcaaaagctgaaagaaagcggcaacattagagaaacctgagctcacaccaagacgatcttggagagaatggcagcaccagccacctttcaaggtatgttctcaaagcaatgaaggttttagcaacatgacaaacttccgacttgtcaactgagcatgcataaggacacataaacataccagagccagagtggttttctggagagtcacccactgcaggggttgaactgagtgcttttgaggctgcccgtccggcatgagtctgaatgctggcaggttcagactggctcctctctgcggactgctgagacttgatcagagagatgtagaactcttccagtttgggcagtgtggaagaatccaaaggatactgtaaatctggctgctgcaaaatgggagaaattgggtgaaggcatggaaagtgacaccttttatgcttccttacttagatttcagttaaaaagtaaaactctagaaaaagcactcttctatgttttaatgagtatcaaaattcaacctaagaggtctttattgctatttctatgaacaagtatggtactgagggctacccttcttcccgccattgaccagtgttaaatacacacacagcaggacaatgcaggacccttatcatccagtgttaagtaacaccaacattgaagcactcaaattgctggcaaaaatgcaaacagattcagccgctgtggaaaacagcctggcagtttctcaaaatgttaaacacagagttattacatatttatcagattatctgtctaagagacacagacacttcagcaaagagtaaaagggcaggacagatctctacagacagatggcctagagattgtgccacatattaggaagaaaggaagaccaggattcaaaaagtagctgggtaagacagtgtgcaccaaaattagcagctaagcacaggaaaggaaggagcccttctttctcagtaccacggatgaaagaaagcctgggtattttcttgtcaatagtttgaatctttctggaatctgcaatgcacaagtcccagaatgggatgcaaggagcctggtaggcacaggtggagcaggactgcggagctctggactgaacttttggcgccaccctaagcttactgttttctaacactctgaatcaacgtcatatatgctgtggtctctccctctattagggtgcttttccttcagtagctgtaagtataagatctctgttaatcaagctagaagacaggctactaaagcagtaagatgcgtaaagttgaacaaatcgcatatatatgttatatatacaatttgctagtagtgacctcatgacctaattacatcatacatcctagtccccagcattctagtgctgctgtgccagacaccacacccgacacatgatgctttgaaaggaaaccacatgcaatccacagcaacagagcactgttccttctgcaaacagttagtgctgatcaaactcctgcatctaattttccctcatccaccttgtccacacagtaggcaatgttttcaaagatctgttgaagagactctctattctcctaactcctattatttattttaataactatcctcccatgttagaaagaacagtcatgctattctgtttgcgtctgtaaatgacctctacgggaactctgaattacaggtctgactataaagtctgactataatcctaattatcacccactcagaaacacttcagagctgccgcatattcaggcctattttcaaattgatacaatttcttaaaaacaaatgaaagtgaagacttttcccagtatacatagttcctagcctctgggtttattaataatattgccatcactactacattgctgcgacttttataacccagtgtgtgcttactaatctgccaaacacacccttatgggacgctctaactgctgtgggggctggagtaagaaaggccccaggggctcatctacagggcaggcttgatccccaggtgatgagctgtcctggagaactaagcgtggccttgtagaaagacatgtgtcacttgtgtctctggctgcctgcagccctctctgctgcttctccagcaccatgcctacctgtgtgccgccatgctccctgccatgaagagaagtactaacactctgcaactgtaagccaggccccagtcacatgctttctcttacacgaactgactcagagcaacggaaccgtgactaagacaaatgcttggtataaacctttggcaacctaatccatgtctcgtttcttcatttgaaatggtggtaacagtacttcataagaaggattaaacagatggacagggatgtagataaaggcttacagcagtgccagtaaacagtatgtgcttaggcactgtgggcagtgttatcttttttactggtaaaagagctcacagagataagtcccaagatcgaggcttcgatatctcacgcctaactaccatggaattcacaactcctcacggagtagcaagagggaaatcaactatcattgattgaaaaggcccagaatatggttactaaaagcccaaggagactcagatatagatggtttacaaatcctggttccttgatgtgaagattcaagctataaaaatgttagtaagacttccagttctagccatggtactcttcaactttgctccattgtaagcagtggacaaattagattttacagtatttgaaggttcaggggaacaagtagtcaggaaaattttcataaaatgaagtgggttccatagtcatacctcagcatttttgcagtctccagtcaggaatggagttgagatcataactgcaaacttatgggctaaaggggagatcagacactgacaatacatccgggccctgacagacacacccagaggaagagactagagaacagtccaacatctggcacgtccaaggctgccaattcatcaagtgagcatctagaaaacctacagagaacagcagtgggcaggctgaaaggcaggcagtggagtctgagccttgcttaccaaggtgggaagcaaacgcaacaggctctcacctcagtcgaaggtcttaggagtgaaagccagagaggactggagcaagaatgaaagtgagctaagaccagactgccttgactgaaggactgctgagatcaggtgggcctatgggtatgtctgtgggtggctgccttgattaacagatgcagaagggcatacattaaccacaatttctaagaatcaaagtgataaatcatgaactggttataataattccaactgggctctacctgttgaattcgggttgtgctggtatttttttcttgagcaatgggcccttctggtgtgtgaattcctcctttcacatcattcgcaaggcctaagggctgccaggaatcatcccatatatctttagatgtagaaaaacaccagtcctataaagaaaagcgtgcaacagtaaatcacaacgcagtgccacaagatcacaaagcaaggtaaggtgacagcgagggagcagtgtgctgtaaacaacaagagggggtgtggacttccaacaggacaaggacacagtgtgttctaagcagcaagagggatgctgatttccatcagtgacatctttcctaaagtctgcagtaaacaccttcaatccttgggcctcgtgaatggacacacaccatcgcctagcgagacagttcctgagcaccttagtgcttacccacttaaaaaccaaccacagatcattttcaactatggcctgacaattccttctcaattccagcatttacaactttctagaagcctggtctaccgggtttaaatttcctttgtcagcagttgatctgctgcttgttatcataagactctaaccttttgtgccatttctccacctgtctgatattgtttcttcccaacaaggtttgaagtaaacagctgggaggcaggactccctgccttccccattttggcctgtagagggagccagttctcatcccaaacatcgtcacctatggtcactgactccaggcatggcattccagtagggacctcatcctgaaacagaccacaggacaaacaagtactgttgtttttatttccaaacataaacacatttttaaaacttaaatgcacaatttttttcctggctctgagtggatacaagtttaatacacaatttattacattttgttccccgatttgccaaagaaataaaggcaaagacatttaagggcaatgcctatgagagagactgggagaggaggcaaggccatctactccctgggtgtagaaaagcctccataactgactaaggggtcctaaccgatcccaggcccgagtgtacagtggggagagctgagaggccaccacatatacataacacgtaagcgcaggagctttcaaagagcaaaagcagaaacaaagctcttatgctaagagagcagaggtggatgggaacaggagcatgagatcaaagttggcgtagaaacaacggcatctccagcctgcctgccctgcgcccaggactcagacaaccgctctctctcatccgctagagcgacttttggaaagttcaacatgtggaataaagaggaagaaagaagggtttgtgttagtcagcttcccattactcagaccaaatttctaagagaattcaaaaggaagaaaacttcctcttgactcatggtttcagagttttagtcgaaggtcaattgctgctacagatgtggccctgagggggacaggttatcacgccagtgaagcatgtaagggaggggactgttcactcccagtggaatgaagtttagtgggaaggactggagagatggctcagaggttaagagcactgactgctcttccagaggtcctgagttcaattcccagcaaccacatggtggctcacaaccatctgtaatgagatctgatgccctcttctggtgtgtctgaagatagctaccgtgtattacatataataaacaaacaaacaaataaacaaagacagcctacctcatgaggcttctactaacttacaataataccacgtgtgagcaaccaaactgtttttggcacgtggctgttgaggggcattttagatcccaatctcctgtctatatcatgcaaaaccacatccagtctgccttcaagagtctgcaaagccttaactgttctccagctgctcaaaaatacaaaccaaaaacctcctgtgggaaccaggatccaggagggggtaagaggcagagtcaccaaccctagaacagactccggaggccagcagtgaggtgctgatctacctactgcacagcagcgagcgtgtatcatacagcctttgaaccaatgggaactgacagaagctctggagtagccaactcccccactgtcactatggggaggtgccaggctgccagcacttgaggggacttctgtaaagatggggggcaggatggggggcagccactgccctgttccgggctcattctaaggttccactagtttgctaggattctctattttgtgtcacacggtatgccagcagacatggggactcactatgaaagccacctaggggctacagcacccatatctcaaaaactctcggctttgaaccctgcaaaaaaaaaaaaaaatgaagttaaggatccagagacaggtgcatctctgtgagtcccagggcagctggaggtatatagtaagatcctgtctcaaaaagcaaaaaccaaccaaacaaaaagatatatatacactttataatagcacaggggtaaaccctctattccaaataagaaataggagaatactaagaaaggattggatcaaaacagtagcaaaaccaaccgggccgcagtaaaatctgtacgcagggaacacggtggtaagaaagagctctgctgaccccgtcccacattagtcattagggaaacatgttcgaagcattctgagatgttactatatgcttctcagaggagctcaaaacaaaaacccccagctgttactagcaagtactggaaaggacatacaacacttggaacacatactctgctggtgggacgcgaaatcgtaagctcctctggagagcagtttgcctaacactgccacataacctaccagtcctacctctggacattttctctgtataaatgaaacttaggtacacactcacgtgcacacacaccaaaacaaacaaaacaaaacaaacaaacaaaaccccaacaaaccaacaaaaacttgtgtatgaacacttatagtaactctattcctaattacttgaaactggaaacaattcaaataaaccttggttggggatggcaaactgtagtaaagctagtacaatcaaataccactcaaaacacaaaagctttcaactatcaacaacttggatatatgtgaagcactcagaggtatgaggctgcattaaaaggccactcttaaagctctcttatgtgctagtcctgaaagggacaatcagagtaacaaaactctgtcaggtgagaaactgtgaataaaaccagggaggtacagggttattccaggtgctggagctattctgcatcctgactgttgtgttgaatacattatgatatacgtgtattaaaactgacagaaaagaactccaaaatagagtcaatgttattgtagttaattaaaaaaacatcaacataaaattcatgccaacatgcataagacccaaacaaattcaaaccagacaatactcttagcacagaagagggaacatgggcacaaattccacctctaccaagaagctatctaactgagagcagtgaggcaggccccaggctcaggagcagctggccaactcaattgaattccattttctttaggggagacaaggagcacagggttgcttagatagggaggtgggaaggatctgggaggagttaggggaggagaaagattacaataaaaatgtatgttatcaaagtttcaaagaataaacacaaagattacttaaaagtatacatgaaaagcatcctagccaactatctggctaagcagaaaatagcattgatactgaatggtccgatgaagctcaatacagtgtactaaaacagacggtgggggaggggaaggaacttcagtttatgtgtgctgaagggatgaacatttttttctatgccaagaaatccaaagatacttaaacttgaaaatcaggaaaaatatattatttaatgtaataattaagagggaaatttcaaactaaaggagatgatttagaaaatggttgttttagaagacacttagagtcacaagggactctaagttatgtgcatgtaaacacttgattaaaagatgttcttccaaaaatagaaatatatttcctgatgagtttcctagtattgcttctcaagacctctatgctgccactctgactcaatctcgggatagtgacctatacatctggtcccagcagagcttttcttccctgtgattggctctgtcccattgctgtggtcttggcgactgtttttttttttttccattttttattaggtatttagctcatttacatttccggtcttggcgactgttaaggagatcatctgtaattcaatgtcatagagtagtgctcaccgacgacgaaagcagaggagcctgcagactattgatttccaggcattctcatttatgcatttgctgaactgaaagcccatctccgcctcttacctcattttcttccttcagatccttgggctgcaggatggaccaccgtgggtcctcttcacagctcttatgtgttttcaatgagctcaatttagaatcctttaataattccttgggcgcagatttaaggtaacttatacactttccatcattaatatcttgctagtagatataaaagaaaaatcaatcattttctacattaatgtttccaaaatctgcattcctataaactttggtggaaattttactctatagttcatacacgcacataggtgtttgttcgtcctccccacccccctaattttacccaccttcctaagtcttcccattcttttcaactgtatcagaaagccaccattgttgggcacacgttatctagtgtccataaggtaccctgtagctacaaaagaacccaaaggttccagacccaaagaactagaactccaggagacacacggtcgggtaaagacagtgcagccttcccagcgtggccatcagagatgtggcgtgcagatgacaggaaggaggctgtgtgagaggacacagtaaggatgctgcatgcacagttagtcaggacactcaaacacagcagcattgggcaatggccaggttcacaatgggtgtgcatgtgcgtagcacggagagcttggctggaccaaaacacaaaccaaatcaggagagttcacatgcttttttcttttgcataaaagatggtatttcatttctagaaccaaactatgattatttgtagatagcaagagatagtaagttattctaaaaaggttaaacaatgaattaaattcattattcaagaatgatgaaatacaatgcttccaatgcagtaataatgattaagaaagattgaggttatagaccaaacaaactcaattaaaaactgccacagaccctctgggtccctttgtctgcgtggaacaagtctctagggcaggtgggcaaggcatcggcaagtgacagacagaccaacacgcgagactgtgtagaatctgaatgtattctcacaaagtgaacaccagtcttatatagtacagaaaataaaaggggtaggaagtcacagcaggcaaggtacattgaagttacctgatacaaaacaaaggaatgactacaaagggacttacaggaaccaggtaaatgtttacagtaaagataaagcagtcctgcctagggtcagctcagtgacaggtaaggatttcacactctagtgttatacctttgaaccttgtgaagactagcaccagggggttctgctcttggcagaccttctcatgaataatgcaataccacaacccccctatttcctaggccttgctaaattcttatatgagtgtaacttttaagtatctggagaatctccatttgtcagaagaatttaccaacttgcttctaatatgtaatgtagcctgtactgaagatttctatctccgtgggattccctggctctattattccctagtttgggtgagaattgctactgtccttggtagactagctctgagctactggctccttcttttgtaatgcttaattagtaactgaataggctaacttccttactgcattcttactggattctaaactcacaggcttctgggaccttggaacactggggagagtttaactataacagaatttttccatacaccagactaacgcaggaatagagtatgagtatatgggtaaatgagaacgccaaagctccaggaggtgagtttccttgaaacttttcttcgtgagtgctttcagactttcagcctatcaagcagacttgaccggagggcgtggcaaaaaacaattttaggggactggagagatgatcagtggttaaaggcacttgctgctcttacagaggactcaagtttgattcccaacatctataaggtggctcacaaccattcgcagctctacttcccagggatccaatgctctctcctgccttcactgggcaccagacacactgcggtacattacttacatgtaggcaaagcattcataaataaataaatgtgtcatttaaattttttaatgatttttattttatgtgtatgaatgatttaattgtatgtgtaccacatgtgtgcattttccccatggagccagaagagagaattggatcccctgaaactaaagttacaggcagttctgagccaccaggtgggtggtgggaaccaacacaggtccttcccaaaagaagcaagtggccttaatcactgagccatttatccggtcccaagccaaactactttttgcaatgcagcaggagccattcatatttttgtgtgtctgagacaaagtcttgctatgtagctaggcaggtctcacacttgtgatcttgcttagggctcctgcatgcaggccttagaggcgggtgctggcttagaggtatgtgctgtcacccattttttatgacaaattaaaagcatagttaaaatggccttgccttttaatcttttttaataatcagtaaatactttttaaaaagactttttttaccatctccaaaatacaatgatatacctaactaatgaaacatgcaacgaaaataaaacaccttgtatcagcaaacaaaacacttttgagtcttaaatttaaaacaccaaaggctcttagcccagcatccactgccgcgcgtggaatgtcaggctcaggataggccttgctttgctcaagaagcactgctctggggttcactttctctttgtgctctgaggactaagtaacctatgggagtactcatgatgtgcctgggatataaaactagttcaagaactgtttctctttgggggtggagtaataacatgttaatggaaaattattataatactgtcactactctgttgggaaaagctaagaacactcaataacctgagtggtacaacaagcagtaaatgtttagtgggcaaaagtacttgtcactgagtctgtcagcccgagcttgacacactgaacaacccatggtagaaaaaaaaccaactcccacaagttttcctatggcctccaaatgtgcattgaggcatgcacatgcctacacacatacacacaactcgtaaatgcaatcaaaatattaaaagactagtgtcggcatcaccagtgtaggggaatcacagccacacaaagagagcaagagaatctggtgcataagagaggtgttcgggaggaaacagaaccaacacacaggagtaaatggcagagacaaagccactgttacaagcactgtgcaagattcccagcttctctgtctggaaagccgcatctcactgacctacaaaatgaggacataaccatagcaaataagagtgactatacgaaggagcttttcctgggctgtgcagggcactcacctgggcttgctgcagtatctcctggtcttcatttaaatagtgctgctgagcaggatgccccaggtctgtcaggaccatgtcgcccgctgagctggcgttagtgtacagagctggtgggttgaaatccctgaagccctaggatgaagcgtcttgttatataacaagctagaaaagaacaagctggcagcttcgactgtcactgaagggcactttctaacattggtaaggtgaacatttccatacggatgcttctttagttacaaaaatagcagcaagacgagaaattcatgtactatcactaatttcaaaataagagaatgtttttcttctctaggaaaacattagataactaaatacttcagagctagaggaacaaggtcatttgttttaaacagaagtttttgccagaggatgaagaaccattagaaaaatatggagttgtttgctattggtggtggcaatggccttgtttcagcggtcacgtggaaatgaagagggcgtctgcactaagaatccaggaacctaacaaactttcctaagactgaataaatcagtaactgctcatactaaactgttttatatcctaaggtgtggcatttaatcaaagtatgttgaacaaaatatgcactctaccttggatggggcattttctcggcatacaatagcatggccttctgtcctcaagacatgatgaaaatacacatcttcatttgaggacgtatcacaaagaaaaatattaaggattccgtctatatactcatccaccacccccaccaatggcttcaaaccacacagcttctggaagtgcaaaatagctctggctgtccagtgttcctaagatacaatagagatgtttatatgatgagatttagacacgagttacagtagtcatatataaaatgaactgttagtgaactagagttttaagtgaaacaaccaaaattcccaaaatccagaataacacataaatcatgtatcattttagggcgagagacatcaaaagaaaaatatggttaaataaaatgactacgaaaaatcatctgataaaaagctaatttttttgaaatatattatttatttttaataagtaaaaaggccaatcatcaaggaaaaatcaaaagcactcaagagattccccctcaactctgtaaacacagctatcacaggaaatccacaacaaatgctggagaaggcacaggaaaaggagcctggggaaccactgggttctattagtccagttaccatggaaaccagtgtgtcgattcctcaaaaggtgaaaataataactgcacacgagctaactgcactgcttctaggtatacattcagaaccgaggtctgtttaccacagggcagctgctcacatggtcactgtggcacggttacagcacagaggttatggtctcagtggtggtgcctagggtagatgaaaggtgaagggataaaggagacgtgtgtgcatgcacaatagagttttactcagcattaaccacaattaaattacgtcctttgcaggaaaatgaatacgtagaaattgtcacattaagtgaatcagaacttgcacaagttcaagtgggccattttccctctaagagtaaaagccgtagcagaggtgatagagaaggtaaaaggaaaatctcatataaaaaagtaatggggcagatatgatcaatatatattacatgtatgcatgagaatgtaataaatgaaactatatactacatgctaattttaaaagaaaaataataaaaaggtttagaaaaaaataattatccattaagcaactctcatttagaaagaaaggaagaaagaaagagaaagaaaggaagaaagtaagttagttaaagccaggcagtggtggcacatgccttggatcctagcacttgggaagcagactcagaatttctgagtttgaggctagccagccttgcctacaaagtgagtgctaggacagtcagggccatacagggaaaccttgtcttgaaaaaacaaaagtcagttaaagattattaggctaacctcagagggaaaacatttttaattctaggtaaattattttaatatatcacaaaagaccaaagaacttaaagctaatgtcaaattatgatgccaaaatgaaggagagtggggtctacttctgtctccagagagcctgtttatctgctcaagtctcagccacagttttgattgtcctagcaggtcaaagggacagatatcaaagccagggcctacagtggttgggcattaaaaggggaggcaaatatacaaagcttccatggatttgtagctccattttcacacctctagcgtcagctcccaatcttcaagttgttaatttacatcagcacaacacacggcggcaggagttctaggcattgggtgaaagtaaagtggatgactgtggcgtggcgtcatccactcatcctgacacacagtctcatagcagcagccgtacagaggcaaaggcagagacacagggagggcgactgagaccgtccacaggtcagagcagctgcctgaaaggctgacaaactgagcccgatgctgaggaccagagaatgaaggagagacccaaggatggaaggatgtcctctagcatccatgtatgcatgtgtgcacgcattcatgcacgcacacgcgtgcacacacacacactttctctcatttaaaaatggatacaactggactaaatttcagaaagtaaaaatacaatttaaaaaaactaaaaccttcacaggttaattcagtagcagattagacaggattaagagtgaatttagaaaacagttgctcaccaggtaaagacacagacataaaaatacagaagacagctagaagatctggaagaaaaacttacctttaatacttttaatttttgttccagagagagagaggcaggagcagagagaataaaaatatgaatatggggcacgggcaataatcaaagaataacttcaaattcacaaggtttaatgaaaactaataacccatagattttaaaatgtccagtaaacaaagcaggttaaatactaaattcacacacgcaagtaaacacatcacactgtacataaacatatcctgaactggatgtaagggacaaacagagtctctaaaacagctaacgaccaagaggacaaagcaatggtcaaggattttcaagggacaagccagtgttccctgaggggaaggagaccagagctagcctagcgacagcctcagtgcactgagccaaccccagcctacaccaggcaaagcacagcgggcggggctgtaagtgggcaggcagtctgtgctctgcaagcctgaggccctacactccacccagccaaggtatagagtagtgcagaggaacggtgggtccacataacactactaaatgagccaccacatgacccacaagacagaatcctaaataacgcagctcaaggaaaggaagtgtccccagcagtgggatacgtgacacactgagaaatatgtcattcgatccaaatagacactatgatagtttttgtaacccatttcttattttttggttaaaaacaatttttctgaaaaagaataaaaattataaaaaaacaaaataaatatcctcaaattaatgtttcattttcttgcattccttcaagaacactgtttactgtgactgtgtattatatattagatcatatagactagatattctttgaatattcccatttaccattgtgttaattttcattatactgtataggataaactgtactttgtgtaagagcaacatatatgattttatcatgttatatgcattaaattgcttgaaaattgcagtttttatatttttaaggtattatgtaaggcatttacacaaatattttgataaaaatataacatactactgaatgtgagacactataaaataactgttataaagttgttaaaagcttgacatatgagggcgtggcaggaacagaagggttgcagacactaagggggcggggcgtctcacagtccttatgctccgttccattacatgtaaagatcacttaaggtaacacaagaggaatgagaaccccggcagctcccaaatgttaacacttgcatatgtacagcttaatcaatttaaacaaaatgccagaaaatgatatagcttaaacatatgaacattagcttttcatgactctacagtcttagaattctaactcaaggtttgcaaagtttcatttcctagtgagacagccttcctttttgccacggattcacacaaggagtgaaagaaagaagagacagagggaagagagagggaaagggatcaagccagctacagccaacatcaccctagctggaacaacactcaaagcaataccattgatatcaggaaggagacagggctgggcaccacccatccttttcagcatagttcttaacatccatcccagatagagaaataaacacgggaagaaaattcaaggagcacaaatagtcaaagtcggatatgaagataatatgaatttatacacagaaggccccaaaattccactagaaaacttctagagctgatcaccattaacaaaatggaaagatacaaaatcaacttacataattcagtagtcactttatgtaataataacagacatgctaagaaagagttcatggaaacacatccactcagtgtagcatcgaaaatgtgtgggaaaaaaacagaaccaggaatgtgaatgggctataaaacaaaattttttaatttcttaagaaagtgacaaagggccaagcgcacgcctttaatgccagcacttgggaggcagaggcaggtggatttctgagtttaaggccagcctggtctacagagtgagttccaggacagccagggctacacagagaaaccctgtctcaaaaaaaaaaaaaaaaagaaaaaagaaagaaagtgacagaaggaagacactaaacatggagaggtcttctgagctcacgggtagtggaattaatattgtgaatatggccatcctaacaaaagcaatgtatagattcagtgccatcccaagcaaaatcccttatcattcttcatagaaacagaaagaaaatatcctaaaatccacacagaagcacacagggcattagcccaggcagcccagagtacatgtaagtagtactgtaccagacttcaactgaacctcagagctgtagcaatataaccatgacactggcacaaaagcaggcatgtagggccattaaagaagccagaagggagtgtatataactactccaagtggtcaacagcattgccctattttagacagtaagaaacttataccacagcactcccatacgacaataatgggcctcaaaaattcttactgcttagtgacactgtgtgtcgccatagcacaacaccctgctcacatttgtggtggtgttggtacaaataaacggtgctgtgagtcatttgaaagcacaccaagggcaagtatgcgcagtgtgtggcagttagtgactgcttctggtttacagattagtttacgcaccccagcctatcctatactccatgccaacgagagcaacttacactgtctcaatgtctgtgccactctcctgcctgcgacgtcttctttttgcgcttgtgtgaggaggccttcttgattagtctgaacaaaactaggcacacttccttttgcttctctcatacaccagagcaagtgagagcaactaaaggccattgctccacctcaattcttttaattggcattaaaagcatttcagcgtcatgtttctagaagtggggagacacattcccacctgctttaattttaaataagatctttgcaaattcagtgcccggagtaaccaaaacggacagagacatcgctctcattaggacacaatgcccctgctgcccactcgtctgtctcatacaacacacaatcgtttcacgtgtcacctgtgtgtcctgagaactcagaaccattattgatactaaggacgcgcctgcatctttgctgactaatgagaaacaagcaaacctacctctgcgggcctcacccacgccaaagagcaagggatagcctgagctggaagctttgtgtagcagcatctgcaggaagccaaatatgtgactgtttaatcacggatgcacactgctttttattgactctctgatctatttcttcttttgctattcaggccatttcaattaatttgtgaaactttaaattaatgctttgtactttaaaaataattaaaaataaattacaaactatagtacgtttttcaagagaaccatgtagataaaagctccagaaggaaccattcaagcccccagcttgtaactgtccctttcagcatgaattttattctcctggcccactcaaactaataatcaagtgaaagaagacaagagaggcaacggctcatccttgtgagccagtgaagagggcggggcgggggtgagggagcctcgtgattactttgctgttgcagagttctcttcccagctcccccagcaggcagctcccagggaatcctgcagctttggcccctgtgtgcacccgattacatatgcacacacacagtttataaaagtaactattctaaaaagataggaaaaagtaaatattctaaaaagataggaaatgatcatttgtcttacgataggggatgtaaagaggaataaatgggagatggcaagagaccaagatcccagccccagagttccatgactcagagtctcccttttctggcattcctgttaaattcaactcacttgaggaacctcagcgaggacttctgcacagttccgatatttccgaaatctgggtagaacacttccacttcctttttcccaaggatccgatggataataacccggtaccaccacttgtcctcagagatctttacacaacagagatgtcctggttgtataaaatattctggcataatgtaccggtcagagaccagctggttggagtagcagcgtctgtagattccacaatacagaaaaccatggggtaagagaaaaaaaaaagatcattttactgctgtatcaagagcaagaaagtcttggccaaaagtaaagaaaaactgtaattttctgatttgttaatgcctattaacgtcaattttgttatccaaattcttttcatcaaccaactccttccaaatatgaaaagtacacacttgttatcttacactctctgactataatctaacttcattccacagaagttcctaaaatgggtactctcctgcatttgtggctcacagaagatctgggaagaggggacgaaagacggtaagaggcagaataccaggaactctgctgtgagacacacagcacaaacaagaccaggacaatggcagtgccaagggacacagcaatgtggaaggggatttcagtgggatctcacgcctacacaaagaactataggccaccaataacttctagaaggagaaccggcctctctcaggaagaagccccagttctggttacccaatgcagagtggtcagccctaaaacaacaaacacagaaccaagttgtgtttatatatatttgtgatacacatacatacatgtgcatggaacaataatcaacgaaaaagaggtcatcaacttgaagggggagaagcgggttggtgggaggggctccagggaggatgggggcaagcagaggagtgatgcaattctagttcaattaaaaacattcttttcaaaaggcatcagtggctcactaatccccaaatgtaagtctctccatctcttgctcttggatactccatctccacaattccctcctattccctccttatcaataagcttttaatagctcggtgttgccttaaaaatctgaggttttttggagtgtttaaaccagaaacctaggttcaaatcctgactcccttgcttacaaggtcggtgcttcagaagtcctccactcctctctctctctctctctgacatctcccctgctttcatctcgtttcactacgggtgactctcctaggaagaccccgcatcccaagcttcaaagcctgtacttgcaactgtctggaagccgttctcaatgtcctctcctcctcctccccatcctctgctcctttcctcttggtaagaagatacccacatcttatctagtcatagagacttactgggatctatctatttgaataaaaagttctagttaataggatctaagaaaaagaatatacaaagtatacagaaatatataaattactgtatactttatcacaatttttaaaaaatgaaaatttcaagttgtgtctttcaaagcaatgaatgatgtggttcacaacctctacctttcctttctccttctcattggctaagaggggacctaggagatggtggcaagctacatccaaagaggcaacacattgtctggaacaaaggacaggaaccaccagtgtccttaccatcaccgagcgtcaacgtttgcaccaatgtctcggccggaactacttcaggaagagataaaccctatcttctccatgtgaccatgcaacacataatcctcatgccaactttccaatgctcacctcagaggcagtgagtggaaatgtctagtttctctcaccccagaaacctagcttctcacacctatgcagtctctgagccaacattcttcatgcagagaatacctcatgttctcaccccaattctttctactccctttcttatcaacataaaggtttgcttttctaatttcactctagtctgttcctttctgtcccatctccccctccctccttccctttctttccctcgccctccatcccccctcagacttctcattgagtgactttcttttcttcgcctcattcattttccacactatgaatcaagttttcctagatctcctgtctattatcagtttttcaccactgtgaccaaatacccagcaggaacaactgaggacagtttcagggacctcagcccatgattatgtctccactgtggtgaacagaacatgggagggaacgtgtgatgaaccagagctgttattatctcctggcagtcagtaggcagagaacagaagggacagggacatgctatggcttccaaggacacattcccagtgacatacttcctctagctaaatctcattccctattttaaaccacttcccaataatgcctctaaattatggtgccatcaatgaactgatccactgatcatgagccaggtgccttacgatctcaagagtgcactgagaaccaagcctttaacacatgagcctttggggacactttctatctagggtttaagaaggtcctccccaaatcgttaagaaacaggtttcagtggcttctgtctgaaaggcgccttcctgcagtgctcacgattcagcttttacatcttccaaacgacaactcctgccaacgtcactagtgctaactccaatatgttcttagttgttttcaaggcacattgtccaatccttcactaacgtttgacattaatgccagtataaatttattctcatcacaacaggcaaaaccttgctcttgccaccttgctcaaatatcaactatgaagcagctttcccagacagctgtttcaactgccccctccatagcttgtttatcaccctggttatctcccctgctttagtgtgttcacccaggcaaagaccatgtcttacatatgtgtccttgtcccgggaccggagcaaacagtctgtgaacagctacagtatagcggcagcaccaggctggggaggcggctgggttggtaaggtgcttgcttgtacaagcaggaaggcccgagtctgatcttcagaacccacagcagcaagcacagcacagcagcaagtggctctactgaggatgtggagacccgagtgtggggctcaccagccagccagcctaacctcgttaacaaaccacagcctagtgagagcctgggtcaaagaactctttcttatgttttccaatttcatatgcatgcatgaacagttcctaagaaatggcaacccaaggttggcctctggtctccatatgcacacacgtgtgtatgtacacacataaatatacatatgtacacaaacagcagccaacactgaactagattctaatgctttactttctacagctctgtagtagccactagattactccaatctggagatcaggttagaccaaaagaagctgaataatgtacagatctcagagaagataagaatactttaaaacacgtactgagtcttacatagtatagaatagaatttttctaatgtgtatgtgagtgtctgtatgtgtgtgtgcacgcacacacacacacacacacacaaactaatgtaacaaggaggccagaaagacaaccttaggtaccactcactgtcaagaatgcctcctttgagacgaggtctgtgattggtctaaagctcatcaactacattagattagctgagcagtgcgtgctcagacaataggtgtttgccaccatgtctggaatttttactgagttttagagataaaagtcaggtctctgtgttcacatagcagacactttacaaagctatcaatcaagccagaatagtacttctttctaaggtattactgtttaacttatgccaggtaccttggtatcataaatatataatatgataaaataagaaaaatacgggatgcttttgtaaataaaaaaactattattttatgtgacacaacatagtcagaaattgtttacaaatgaatttataatgactgaatctattcacatcttatatagtgtttattaacacaggaacgagttttttcagtagactaaaaaccaagtacagttcataaacccttggggtcttgatagccttcttctaagtgcacacaattcaagcattttcataatatgactaaaatcctgctccttgacattgcactggtactataaaagcaacagtaggtaaaatgccaggtgccttagttgagtcaaggcagtgtcaaaactgttgtcacttgtcaacacattttagttaaacaaacaaacaaacaactaacagggactggagagatggctcagtggttaagagcactgactgcttttccagaggtcctgagttcaattcccagcaaccacatggtggctcacaaccgtctgtaatgagatctgatgccctcttttggtgtgtctgaagacagcgacagtgtactcacatatataaaataaataattcttaaaaaaaaaaaaggaaaaaagaaaaacaaccaacaaaccagtatcacttaaatcagtatcacttaagaatgcccttgaaggagctgagatgaaagaatggaccatctagagactgccatatccggggatccatcccataatcagcttccaaacgctgacaccattgtatacactagcaagattttgctgaaaggacccagatatagctgtctcttgtgagactatgccggggcctagcaaacacagaagtggatgctcacagtcagctattggatgggtcacacggcccccaatggaggagctagagaaagtacccaaggaactaaagggatctgcaaccctataggtggaacaacattatgaactaaccagtaccccggagctcttgactctagctgcatatgtatcaaaagatggcctagtaggccatcactggaaagagaggcccattggacttgcatactttatatgccccagtacaggggaacactagggccaagaagtgggggtgagtgggtgggggagtgggtgggggagcatgtgggggacttttgggatagcattggaaatgtaaatgaaataaatacctaattaaaaaagaaaaagagggctggtgatgtggctcagtgggtaagagcacccgactgctcttccaaaggtccagagttcaaatctcagcaaccacatggtggctcacaaccatctgtaacgagatctaataccctcttctggtgcgtctgaagacagctacagtgtacttacatgtaataaataaatctttaaaaaaaaaaaaagaaaagaaaagaaaaaaaaaaaaaaagaaaagaaaaagaatgcccttgaagccaaagccaggattggtgacccacaccttgagttccaagatagttagggctatacagagaaaccctgtcttaaaaaaaaaaaaaatcaaatccttgataaggcagtacaagtcaattattatctattgacaaaaaacaaaaaacaaaaaacctgaagtacatacacagtattttccaagaatcccaaggaaaagcactttgtatttgaattatgacctaaactagcctttggtggggacccaaatgtcgcttgcaggaactggaatgattgcttagtggttaaagggcatgtactatttcttttgcagaggacccaagttctgttcccagcacccacatcaggcagctcccaagcactgtagctacagctccgggggatctgggatcttctgacttccatgggcacgtgtagtcacacgcacacactcccacacagacacataacagaatcatcttttaaaaataacaaccaagggggctggtgagatggctcagtgtgtaagagcacccgactgctcttctgaaggtccagagttcaaatcccagcaaccacatggtggctcacaaccatctgtaacaagatctgacgctctcttctggagtgtctgaagacagctacagtctacttacatataataaataaataaatctttaaaaaaaaaataacaaccaagccaagcagggcagcacacaccttaaatgccagtactttggggggtagaggtaagagggtatctgtgagcttgaggccagcctggtctacatggtgagaccctgtctccaaaaacaaaacaacaacaataaaaaaaagtagttgattttctttcttttgtttttttgttttttttgtttttcgaggcagggtttctctgtgtagctctgggtgtcctggaactcactctgtagaccaggctaacctcgaactcagaaatccacctgcctctgcatcccaagtgctgggattaaaggcgtgccaccacccggcagtagttgattttcaatgtaataccatttgcattaaaactactaatgtgatgataaagattacactttactttaaagtttaaaattcctatgcttaaaaaaaactacaaaacaaacaacgtgcctctaacctataaattctacttgcccaaggacagacaacttccagactgccaggggttattcttgtaattgcctgctcttgtattttaaagataacaagtgttttcgcttctctagacaagcttgcttgcccctggctgcacataggaagggtctgtgtctgactgcacatgggctgaatgtgtgccgattccaggtaggcaggaggtaggtacaccactatgtgctcttgcccttgattacacaaaggcaggaagtcacatagatacatacagatacatagagagtttggtacaactcatagtttgagtatctacaaagggatttggaatatacttggtatatcgatatgaaggactattgcacatgcttggattagaaaaatatagctatttttcatgaaaatgttatttatcatacctcacatggatttttaaaacaggtattttaatttttgcagtttaagtttctgtctgataagcatcagtaagcaaaagctttttgttagtttaggagtcccaagaccaactcatctgagaactcctgattaaagctaagctggaacagtgagggcaggaggcgcctaccgcatttcaatcatcatgtcttcaagtagttctgaggaatctctgctgtagatccggatgtagaactgactaggggagattatatactccacgaagacccccacaagggtgctggtatctaatggaggaagtctgcacaatttcttggcacgcacagcgtctggtgggatatcgtggtttgccactgacaggctgagctgcggtttgtttgtttctacctgctacagggaaggcagggagagaaagaaaccgtagaaagacattaaagggacatttcaaatccctcaaactctttcacgaatcagccttattgcagtccctgggctcaaggcagattcatgactgagaatgctttagaatgctaaaataccatttacagccaccacttaaagacatccttcaagtactccattatggaaatattggccaaaaagttaagagtgttaggcaagtgtccccaagaaaaaggggagacattcaggtggagtacggcaggtcctcctacctaaccctacccttagtcaagggtaactttagtagatggatcttagggacttttccatcaaaaggttttgcagcactttcatcctaacacttgctctttcctctaggccttcttcctattgtcctgaagaaaaaaacagcaggctcttaaactgctcatcccagtgaagagcctgttagagtgaggaacaaaaaagtcacaagcagagacgcaaacacagaaagaaccgtgggaggctgtcatgaaggagaagagttaagtaaacaacagaggaacagggaacagggccagggccgaggctgggccaaagcaggctctgcaccctctaaagccccaggctttccagcctcgaccttaaggctcactaatagagacatttacagtgctgtcagggaacttacatttcaggcacccaaaaaactttaacaccacgagtgtgggaaatgaaaaaacagaaaaatgccacaaaaaagaactggtcttttccaaggacaggtgtccctagatttatttttttttctagcgagcacctggtttaaagaggcattcactcggttactgagcctcctacacaatgtaacgcaatgtaacacaatgtaacacactacccactcaccagctgcagaggcttgaccaccagattaggcttcttgtatatcttctgttctggctccttctggttcttcaaagggcaatcccacgtggtcttcttaactgctacagtggatagtgaatttctggagagactggaagtccaagggttagcttctgttttcttgtctggttgaactaaacacgaatttctgactgatgaaagcggtccacctgaaacagtcagagtggttacagtgtgggaccactgcccctgagtgggccgtgtgccaggcaccaggaagggacactggcaaggggaacttgtccctggaaaccttgcagatggagagacaccagggatgacgcactaaaagaggaacaaactgtaaaattctcacactggggaaacaggagccgaaataatttctcaaactctggtgagtgactgtctcaacacctgatctccaatttcttcttctaactaaccaacagacagttatttaacacacatactctttaatattcaataatatgatgccttaactcttagagaattcctcaatcaacctcatattttattgaaatttatccatctaggagtacctgagcctggcacattatggactgctcaaatctacagctaaccacagtggctcctaaagaaacaagctcacaagcacattaagatgtaggcacaaaaatattaatcctatttgcctagaatgaatgaaggctgaagtttcatcccttaaacagcaagataaataaaaaagttaaaaatactaatcacattgcttattatggtaaaaatggaaacaatctaaatgtctaccaacagaacactggttaaatgaaataaatatataagaattgcacaaaggtaaacatgaaaaaatactaatatggaaaacaaaacattaaacataagaagcaaagacatatttatataataatgctttgcataagaagattatgttataattaagtatataatttgtaagagattgtgaaatatactcattaaagctacaagtattaactacctctgtgttgtctgaatggcttaaagagcttttgtggttaaaagaagttctatgacgtcagataggatcttgctcagatcttctaagtcctgtattcaaagtatgtggggtcttgagcattagggacttgtcgtggagctctgtgaggcagccaaactgtattgctttgggtcatctctttgcccaccctaaccaacaacgtgaaggagtctcaggcctggtactggggttttaagctgtcaaggcacagaaacaacagtcctaccaagctgtgacacctgagccacaacaatgaccagcacgtggcacccttaaaggtgcaatagtggcactcatatcttggccataaatcaatgatggaatgtgggaaggtaggtgtccaacacaaccactcttcaaaacgtatagaacagactggggagggaaacagctcactggtgaaccgagtcctgcctcacaaacagaaggatcttggtttgacccttcataatccacatttataaaaaaaacccaaaaaccaaaaaacaaagccaggcctggggtttgtgtgcttgtaaacccagtgctggagatacaggaccagcaggattcctgggtcttcctgggcaactaataatcctgtttcaaaaataagtaagtaaagaagatgggcagcgcctgaggacaccgccagaggctaatactctggtttccctgcacacatgcacacacacacacacgaacctcccctatacacattttataaaataaaagcaccatattgttcatgcctttgcaaatgttaccactgaggggactgagcaaagggcgcgtgggaatctgtctgcatgatcataaaaagttatctccaaaagaaaacgactctaagagaaaaccaaactgggctaaaagcataatgccctagatccaatgtggtttcctaaagtaaatacagaaacaggcagtggtggcgcacacctttaattccagcagttgggaggcagaggaaggtcagtctacaagttcgaggcctgcttggtctatagagcaagttccaggacagcctgagctacagagagaaaccctgtcttgaaaaaccaaaagggggaggggaggagaacacttggagtttatttattgtaaaaacataaatgtatattcctcctatgtatgtcatatactctgacttccacatatctgtaagaagcttttgccgcatagcctatcatacctatcaaacgaccaattcagaaattattcctcagaacttctaataactggacaataaagaaagtaacaggctggagagatgatgctcagtggctagagcattggctgcccttccagaagactggggcttgactcccagcaccacaactgtctgtgactccagtccctggagctctggccctcttctggcctctgcaggcactgctcatgcatggtgcacacaggcacacatgcagacaaaacacccatgaacataaaatttaaaaaaacagtcaaaagtagctcacgactataatctccgtactcaggaggtagagacaagggagttccgtgagtttaagatctgctgggttatacagtgaattctaggccagcctgggctacataataaaaacctgtctcaataaataaacaaataaataagttaaattgtgaaaacttaaaaatttaaactgataatataggttaactttactacaattatcactaaaaaggccattattcaaatattttgtagctaatatgggaggtgtttgggtgattctactggtgactctttctttaatgcttgcttcgatagaaaatgaggaccgtattatgccattaacttaccagacggcagaggcttcaggtcagcatcaaacacgagcaagtcttgcctttcttcactgaactcaactcggagaatgtcactaagagcgccaacaagttctgtcacgtttaagaaccctaattgttttggtgaaagttgctctttaaaagttagctgtcatttaaaaaaaagaaagaaaagataagaaaaaggaaaggcatgaaaactctggatgtatgtttggcaaggctttaatttggattttgtcaacctatatacttcaggctctgaactcaagtgtaaaaagcctatttcaccatcaaccaatctagcctaaccactgaaccggcagtcccagagaccctttctcaagaaacaaggtggacagctgccaaggaacaacactgaaagccaacctctaggtgccacatacacgtgtacacgcacaaacacatgcctacagttcttctctcctgcctaggctttaaggatgtgaagacttgcttctgaactaaacgccttcagcgctgtaaaggactggctcctcacagagtactacagctgttatacagactgtgtcatgtgatgctctgataccacactcaattccttatgacttctcccacagaacacttgtacaaatgggggtccaggatcaggcagaccatcattcagaaggtcgtatttacagtcgcctatcagcacaccaaaggaaacagttggcagagggcagggcagggtgggaggaaattagaattagtactactaattactaattagtctactccctcagacggtacatattagagcctcttctctttgcatgtttatcagtcgctaatagtttctcagataattgtggtgtattaactgtggaaactgtttaactgaacataaagctaggataagcaggtttaaaatacaaaggagttactcttttgtttttttggtttttttttggaatgcatcaaagcccccaaatgtatttgccaggcccgaggtttaaatgcacaagcaaaaggggaagtgcctttcagcaggaaggatggggcagtagaattgcacaaggaaacggggaagtacagatacttatcagcgggagggatggggcaatacaagcaaaaggagaagtatttatcagtggggggcggggacaatagaattgcacattcttaggcagttacacggggaagcaggaacttggcggtatcagggtatcttgaggtcaggactgacttagggctagaacaatctgtggttgttctcagagcggtgtgtcggtggcccgcttttgaccctcttttcttcttggggggagaggcccaattcagagatcaggacaatagcgttgctttaatagctcccaacatctccctcgttttaatatttttataaggacatattgtataataaatttgtagccacgtttttatggactgccaaaacgtctgtttgctcaccgggtgattttctaaaaccacgaaggacacaaggacaagtcatctatgaggcttcaatcaacggttccagtctgttgggtattactaaacagtcatcccaggctagacacatcataaaattggaacttgaggccatcgcccatgagagttgtaagactaagtactgcacagagattagtctgaaagctgttagacagtctctgagaggcatgtctgattgcataaaggttgagtgccccagggtccttcccccaggaaaaacggcacgggagcaggtcggggttactctgggaaaagatctgtgggcctgagagtcaatcccgtacatggcccctaacattacacactggggatcggacctctacctctacccacggagcttgcttcgttcctaaatcccttggctagcccaggttatactcttttgtttttttaggttttttaaaattgtgtctacaagcaggtatgtacacaagtgtgggtcccctgagaagtcagaggtgttggatcctctagagctggaggtccaggccacccgaagccaccagacgtgggtgctggaaactgagatctggtcctctgagccatctctccagactcccaatcagtcacttttaatagtatattctgaagatccaaataaatattcagcaaaagcaagtctcaggagggagaggatgataaatagggtgattgaggttctcaaagtcatatatatatacacacacacatatgtaatcgtgaaagaaaaaagcaattgtaaaaaacaaactatggtgaaaactctcacacagtaaaacttcattcattaaaaaaaaaaaaaaaatcaagtttctgctcacctcaaatgtcacctaatatgagccgcctagcgatcaccttcctagaaataactattattaacaatttttgagtaactttgcagaaattgtcaaaacttaagtgggcttctataaaagagtatacaagctatacatcttgctttttcagttactataaaagtaatcccacatcattactatatgaaacacagctcaggtttatctatgattaaatggtgtgctttctgctctaccggcccccacagtcaggaggctggcacggttctattcccacagcctgcctgcctgcccacccgcccttccttcctttcagagccccactaactcatttttatacggactgaagagtttagaatctgcatccctaccgcatcattgtttatttttgccaacctcctacattttcctgatgataaactggtcctgcagacaagacttcttgccagttggcaaaggaatcaagcccacacctgtctgctctgacaaggccacaatgagtctgtgtgctctactatgggcacacagtagctgtttcttttaaagtgttaactgtgttgtttgtcactgttggttactggaccacagggctcatttaggcacatcaggtcaatggctgactagttgtctgggctgggactgaactgggacttgcacatgctgtctaagtgttctgcccctcagctcatctccagccctgataccaacctttagttgccattcttcaaagatgaaccgatctctacagtcttccaagttgtctaagtaacttttgtaactgtgcactgatgggcttccagcccttacaattaaagcctgaaactcatcagtgcatttgtaagtcctttaaatgtgagcctagtgctcagccttgccttacttatctgttgacatgttccaggttcaactcacacaattagaatagatattcttgtatgtataattatctcacaactactccccagtgtcatgccacactatataacaataatttcagattaacactagtatcatcaccaatataacaccaccaccacctctggatacattcaccctttccttacccctttgtgagtgatacttcatcagagcagacactaaccctcttcctttgaattgtcatttggtttctttctgtaatgttcccttctggcaatgttaactgtctgtcttcttaggggcataggccactgtggaatgtctcctgtccctgacatcagccttcctcctgagtcactgtggctccttcatgcccagcacttgcaggaacatgtatctttcccatctgtttttcagggaacagatctgccctcatgtttatttatttggggttattatgttaactacataaaaataatttgggaaaaactcttactccttccttaccttcactgtttgcaacttttctatcgtcaagttttttttttaacaactttttgagaatttaacacatgagaactgtatttatacaagcagcatacagttgggtcttgcttctcatcctatatcacaggctgtcttttatggccctggctgtcctgaaacttactttatagaccaggctagtctcaaactcacagagatctttttccctctggctcctgagagctgggattaaaggtacgtgccacctctaccaggctcacaggctctattatagcagttagtccatttatgttaatgaaagcaatatatctagatttagagctaccatgctccataggttgaccccatatatatcctgttccccttcccaccttttataagttcaggtgaccctcatccatatcttcccatccgtatcttcccacctgtatcttgcattccgtatcttgttcttctgctctctatgcccaccttcctgagtttattgcatgtatttatacaaatggttttatctgttggctttatggctatcactgcatctctaatggttgttctgggtattataatatacacccttaacttcttagtgttactctacatgtcacagaaagcataacaagatgcagtttgtacaatcaattatgctatactttttgtttttgtttgtttttcgagacaggatttctctgtgtagccctggctgtcctggaactcactttgtagaccaggctggcctcgaactcagaaatctgcctgtctctgcctctcaagtgctgggattaaaggtgtgtgccaccacacccggctctgctatactttttgtatgcactacatcagcttcatgttataaacccagctagtggccctaattttagctttaaatagtagcacgttttaactggtaaaagcgagtagtctttcagatacagctgcacattacgtcatcctctgttcttcagcccttcttgaagatccagttctaatccggcatcatttcagttagtttacactacattatttgtttacttattttttaccatgcaggtctatttatacttctctattttttgattatcttaagtatctttatagtaccttcactcttaatatcattgctgggtataaaataaaaaatgtatatgaggggttctacttttccacatctcttcttggtactatcacacttaaaaatatgttaatcattatttcaatgatgttataacggtaagtagtaaaaacactcttctattcatagcccggtatttgttacgagccatattcttaaccagcctgatcataataaagaaaaagccactaagccataaaacaaggtggtgtaagtgttaatagcacagacctatcggatccagtagtaatggcaaaattgtgcagcataagaaaaataagcaatgcgaagagtaagaaaacacctacctcaaattctccaagcagtttagaaataaacaaaccttgtggaaacttagacacgacctaatcaacagaaatgaaacaaagatgtagctgaaaggttaagagccacatgataatccttagtttaacgaatgaacacttttatttttatcaatttttttgtttatcaatgaatatatttcctctatttttggtgctgtattgtgaacaatatccttgaacaaacaactgtcagatacttgtccaagtttcagaaacagcaagagaaggctgtcccagcgtatcggtttttgctgcctgagtgtgtgggttttcacctgtctcccacccaagtcacagcacctgaggtgggagaattcagggcagaggaactatgctgacatttcctaactcagatcaggaccaaaatcctcaaggcagactacactggtccattacacaacaactgaagggtttccatctgctaataatacaaaacaataaaacaggtcaatggtacaaaagtgtaagacagtatgaagggtataaaaaaagcagctaatgtaaaattgttatcatttaaaatgtggctgggagtaaaactgtctgcacaagtgtccatttgtccaattctttcaaagggtaatgaagtatcttcaacaagccaaatgttcagtgtctctgatggcaacccacataacataagtgttcaagacacttcactgcaggactgttttttaatagccaaggtccaaagcaactcaaattttaattcctcacagatcctcctaactgaaacttggaacagtaatattttgggctacactaaccatgtgtattacattagcaggacagaaaactgaactggaaagatttttaactgtttgtcaacaatgatttgttgagcaaggaaagaaaaagagggaagagaatggaagaaccattttctaaacaatttcacaccaaaatttttagtatacatttattactttttatacaaaattagtgttcatataccaacatcttagaaacaatgagatataaacacaaaactaataatcaccgcagacaattaaattaaaccacatgtgaaaatcaattattttgcttccaagaaagagaaaatacttacaaattgtatcttgcgctttagctcaggatcaacagtccctccaggtccaatctgtgcaatcacggatttgaatgtgctctccaactatgaataaaacaaaaagtcagagctcttaaaagccaaagataaatgtaagcgagctataaaaggaaatatatttcagccaaatgtgtcaaattctgctcagtggttaagagtatttactgctcttgcagaggaccttagttcagctcccagcctttgacctctgtgttcatctgcattcacaggaatatactcacacatagacaaccaagaatatgtatatacacatagtatatgtatacacataggtaagtaattaaataatttaagtagcactgagacattttatattgtatcaaatatgcaaatgtaatttgtatgaagctagacacaggaatattccaagatacacagcattatctataataggttctacagcctccagttagttggatacctttgtccagaaaggatacttgccattcattttctaaagttacttagtattactaaatacttagtgactgcctaatgcctgaaagggaggaaggggtgtgagtcagagcgcaagtgaaatgaatggtcttttaaaagagcagtaggggaaagctcttttatgtaatataatcaaaggatgaaagacatggggggggggggccagtggcagagtcactatcagttctgtgctctgggaatttggaagcaaagtcctgtcctaaaagcataggagaggaggaggttgggcagatttttgagaacctgaatttgggaagtggagagtcagtgaggtggatacccatcatcaaccccaggtctacacacacagttcgccaagtggcatcagtagaaaaacctgcattggtggatggaagttgtgttataaaatatcctaacctccaagcaaaccaagggaaactcagttacatacatagcagagccttgtggtgagactcccagtatcagaactatattctgatgacagataattagatttgaagggtagacaatcaagagaccatgtaacactctgggtaacaacagttcatgctaatcttttctgaatttaaaaacagatttaataaacatgttcatcagcttagctacccaggttagtctctggattgtctagcagaagaaatgccaagagaaataaaaacagggctagcaagtggctctgcttgccacaaatcattccctgggattcgtgtggtgaagacatgactgactgaagaaagggagggaggaagggacgaaggatggatggaccagcactttcttttttcgagacagggtttctctgtgtagccctggctgtcctggaactcactctgtagaccaggcttggcttgaactcagaaattagcctgcctctgcctcccttgtgctgggattaaaggcgtgtgccacctcgaggctggaccagcactttcaagatttcatcaagctctatctccggaaggccttatctctaaaagagagctttaacagcagcattttgggggaatatatagcaattcaatccacagcagctactgtaactatccaagtaactttgttaaacttggcaatgaaagtttacaaggctcactgctaaacagctataatacaaaagatcagggtctctgaaggcagccagagaaaatactcaaaatgaaacacaatgggggtgggagtggggctgggggtgggtgggaggttgggtttaaaagactaacaaaacaatggaaataaaatacctgtgaaataaaacacaaactcagcaagacccttttgtaattctaggcgggaagggaaggaaaaaacaaacacccgcagacttcacctgcagacttcccgagtcctatgggagcactacacctgtgtgcagccagaagaggctcacgatgaccaaaaggaaaaagtgaccaaactgaaaggtaaagaagacgagtccacagggacatttgaagatttcaatacccctccctcggtaattcatggaaaaatcggaaaaccagggaaagccttagaaagtctgaatgatgtgagttaaattgacttagacagcacagaatactctactcaaatatagtaatgccttctttgcaattagaaaacatctaccaaaataagcatagagctatttagctaagtctcattaattttgtaagaaatgaaacctaagttttctgatcataatagaattaaagtacaacaggaatcatttctggaaaaaaaaaaccgagattgtttaaaaattaaacagcactaaacatgaaacaaaacagaaaccataacagaatcagaaaacatttcatgggggggggggcaaaaatacataaaaatttatgagatgttgttaaagcagtattagaaaaaagccacagccataaatgttttaattaggaaaggagtagaatcagttatcaagcttaagacagagccagggctggggagacactgatgaagagcacaggctgctcttgcagagtgctgggcttagctcccagcacccacatggaggctcacacagttctggggaatctgcacccccctttcctctttggattcctccccagcatcaagcatgtatgtggtgcacatatacacatgcaggcaaaacatacatacaaactaaaaattaaaaatgaaaaaagagacaaagaacccaatccaaagtaaagaggaaataacaggaagaagaaaaatcagcaaatccccaaagctggatctttttaacaagacgggtgggatgtacactcgcgcgcgcgtgcgtatgtgtgtgtgtgtgtgtgtgtattctctcgttcgcaggtgtgtgcgtgcatgcctgtgtatacgagagaatatcaccatacagacctcaaaactgactaatagacactctgaacttttttccaatatatgctgagctagaggaaaaggacaaagcccgacttacctttttaaaggaaaacagaatacctttacatctgttcaagaaatgtccactataaaaacatttccaccaagataattccagatccaatctgttgcgctaataaatttgtgaaatatttttcaaagatcaatacgctatacaaacttttataataaaaaaatagtaaagctttctcatttcttgaggcctatatgctactccagaatcaaaggcattataagaaaactatagaaccatataccatgagcataaagacaagagtctttaacaagtcagaagaggaactcagtaacatgtaaggacactacatgtaaccaagtaggagtcatctagtaaggcgtggtcacattttttaaaaatgtgacttttaaagttttggaatcgtctcaacaaatggaggggaaaacatgccaacagcattcagtcgtggaaaagttctcagaaagcagagttaagaatgaatctctccaattcagtatggaaaatccacgggtgtaagacaggcccggcaagctggtgtggcactgcgcacctttaatcccagcacttgggaggcagaggcaggcagatctctgggtcagaggccagcctggtctacagagtgagttccaggacagtcaaggttgcacagagaaaccctatgtcaaacaataacaaaaagtcaatgttatcaatttcatcagagaactgttgaaagattgaacacaaacacaccctagtggaagaacaagacagtttagagagcctagcccaggtgcaaggggagaaaaggcatagatatattaaaagaagcaagactgtgctcataaactttaagaaaacccatcacccctaagcaccagccgcagtcaaacaaagtttactaagaaccttgactcagggttctaagacacaggatgtatattaacaatgactaattttaaaaatatcatctctaatacaatacaaatatgaaaggagtaaggtataagtttaataaaatgtacgtgcgagccacacacactggaaactacagtgcactgctgagagaattaaaaggtgaaaataatgaagagacatgctattttcttgagttctgggacttaatattagaagagaatgattattttctcaaactcatctataataaccaatgcaattctaatagaaatcatgagacttagttttgataaaaagtaatcagcagatttacatatagtaaaataaatatggaaatgcaaaaatgtagaatagccaaaacaagactgcaggacttaattttataattccaagctactacaaagtgacagtgatgaaaatcccaatagggatgaggcggtccactcaactcgtaagggatgcctgtcccacagggacagccctgcagtagctgctgcccttactcagaaaacttcagttcatacctggcatattatacaaaaagtcatatgaactggtaacaggtttaactatataacctaaatctcaaaaattctagaaaaaaatagaatagaaagttttattattttgcactgagcaaagacctactaggtaaccaggaaccgtatgagaaactgagagaagtagatgaccaggatcaaggacttcaactttacagaagacaagacaaagaggcggggctggtgcagagtatctgctcttgcagaagacccatgcccatttcccagcatccacctgctggcccacaaccattcgtcaactccagttgcaggggatccaatgccctcttctagcctccaaagtcaccaggcatgcacatggtacacatctatacatatagtaaaacactcaggcacacagaataaaataaatctaaaaaaaattagcatcaaaccataaacctggaaaagatgtctgcattgtatgttcatgttaaaagatttatactcagaaggtagtgaattcttccatttcaataaaatgacaaaacccaattttgtaagaaccaaattactctgatatttcaaagacaatattcaaatggcgactatgtacataaaaagatacctaacctcttgttcccttactcctgttcctctcttgccttcttgttcctgctctgtcccctcacccctccccttttcccccaattctctcccccaacacacacaggctcatggctggcctctactcctctactctcttcctctgcctttctctgcttctactatcctcttaactccactccccatgccctgagtaaactccactgtgttcatagcagccttatttatactagccagaagctggaaagaacccagatgtccctcaacagaggaatggatacagaaaatgtggtacatttacacaatggagtactactcagttattaaaaacaatttatgaaattcttagacaaatggatggatctggagggcatcatactgagtgaggtaacccaatcacaaaagaacacacatgatatgcactcaccaataagtggatattagttcagaaacttggaatacccaagatacaattcacaaaacacatgaaactcaagaaggaagaccaaagtgtggatactttgatccttcttagaaaaggggtcaaaatacccatggaaggagttacagagacaaagtgtgaagcagagactgaaggaatgaccatccagagactgcccccacctggggatccatcccataaacaacctccaaaaccagacactattgtggatgccaacaagagcctgctgacagaaacctgatatagctgtctccagagaggctcttgccagtgcctgacaaatacagaagtggatgctcacagccatccattggactgagcacaggatccccaatgaaggagctagagaaagtacccaaggagctgaaggggtttgcagccccataggaggaacaacaatatgaacaagagttccctgggactaaaccaccaaccaaagagcacacatggtaggactcatggctccagctgcatatgtagcagagactggcctagttggtcatcaatgggaggagaggcccttggtcctgtgaaggttctatgccccagtataggggaatgccagggccagaaagcaggagtgggtgggttgagcagggggagggggaagggatagggggtttttggaggggaaacaaggaaaggggataacatttgaaatgcaaatagagaaaatatttaataataaaataaaattaaaataaagcatatttttggtatttctttatgtttgaacttgggtaccttacctgatttaatttttcagtgtggttcagccttgaagcctccacagaattaaacgtgggtgtcttcgccatgctcagtacttgtttggggggctccatatttgaaatgggttgtgaaaagtgtgccttcattactgggaatcctgtagaatatgacccctgttgtttcattctaaatggctgagtaaaaactttaccttttgttaagaaagaagaaaaaacagtgaacagcagtttctcagaggttttatagaaaaaggctactgtatactaactgccctcagtttagaaggggaaatgtatatattcaataaaacgtatatactatgtaagtgattagtcattcattaaaaaaaatattaagaaaccatgttactgaaaagactgttgctctctaaaactctatataagatcacctgagtataactgaaaagtagcaatttataggaaagaccttaaaaactgcatttcattttaaagaccaaagagtgcccaaccaagcagtttgcatagagatacacttctcatagtagatgtaaggaaacgcaagggagaaatactccaagagatgcagtcctaaaatgcatgttccatggtaccctgaaaatcaacacagtctagtgttttaaacgtccagtttactaaatataccaattacttctgagatatcggaagctatgggaaacgagccggggatgggaaacatgaccgcctgggactagaaaactcgtcacagggttcatccctggagaagactgatctttctctctgaagtcatcaactgcccgaggctgttcaccttggcgtagatggagccttctgagatgtccccaccaggctgacgtgcagggtcttgtttaggcaagcacattttcaagagtttgtgggtgcgacacaattatgaatgctgacgagcttacctgctggccatcctctctgcttgtcctctgatacactcttttttagtgtcaacagagaacctgctctggtctgctctacagaaatgacatccgaagctgcattcagcacttcaaacatagagaggaatccatactgcatatactgaaatgatcgtccaaaacgcctggcaaatgccttttcaaagtcagaaaggagaacgggagacaatgccaaaaggtctttcaactcactcttcactacagctggaagaattgggggcacccttcctcggtaaggcacccggccagagcatatgctgggtcttccctttggcatggagtttcggaccttatggctccttctctgctttgcaaccaaacttgctattcctttggtggattcgtctggaatggctaagaagatatggggacagtggagaaatcactttcaagtaaaacacatactccatttaccctttgtatctacaattacaccggcaatttttaactctccacagagctgtgtatgtaggtagagtaagacaaagctgttgggtccatcatttctgacattctgaccaataaaagcttcccaactcctctaccagctggaagatgttttactgctaatcagggtctggaagtgtcactaatttgtgcctagtgaaatttaaaatgagtgttaggaacttaggaatggggatttgggaagctgttttggctttcctttgctctcacttcccccaacaacctcaaaggtacccatgactatcaccccagttaaaatcctccgccctgggatacgggatattgtacttagtggtacatcttaactgtaaaggctcatgtagaccttccaaagtcttaaacctacctttcagtattacggtaccatccccaccggggcagacactaaccacatcgggcatatcccaacaccagttccatagtggaccgatatccaaggattcggagcgggagatggttgccaaccatcaaaaggtactccttttccaactgttgtggagtcaaaccatccttagtggaaataagaagggaccttatctctttcctcagacagtcctgtatacgctcttgttcagacatcgtgctacaggattgaagggggggaaaatgctcttgaaagtggttaaaccaggacagaacaaaacccataagcaaccaagcaaacaaacaaaccagccctggctgtcctggaactcactctgtagaccaggctggcctcgaactcagaaatccgctgcctctgcctccagagtgctgggattaaaggcgtgcgccaccacgcaaaaaccttttaacgaccagccatgttatataaaaactcagatgtgagttttacaggcgataaggcttaaagcaataccctaagtgttccaaggctcctgcagcacaagctctctggccacactcactacaaactccaaagctcagcttgtagggatgagccctcccaatcctcgcagctggctggcattaagtcccaactgggcccggctaataaggaagcttaaagggtgatctcaagttccttagagggtgtcattccccgctgctgctcagtatcagatggaatctctcagccggtctttgggaaccaagggtcgcggtgcatgagtgaccaggagaagcgtgagcggatcgcagaccgcctggtcgcctccatggactcgggaagggtgggggtcccggggtccctccctccttcagctggtcctcccgtctgccccgtgctcttcccgtgatctgagtcatgctgaggaccgcggtagcgtatccctctgcggcccgccactacctggctgcggctcgcccgcctcgctccctcgcacccgcgctgccgttgcgcgccgcaggtccgggacgctccgggagggccgcggagaagctgagccggcgagggtctcgcgcgcctgcgcactgcgggccgtccggtccggtgcgccacgttccacgcgagcgggcgcggccggtgtgacggttagcggagacctagcgtgtgggtgcgggtgaggccgaggaccggctccccctctgggacggcgctacaacccgccgcatctacctcctcccgaagccgcgggaagacgcaggtgccgctggaccaccctccacctgagccctgcggcgccgcccggccccgccccgcccc

SEQ ID NO: 313 - DNA, 53441 bp, Mus musculus
gtgtgttcatgcgtgcgcacgtgtacccgtgcgtccacactccgccagcacgtgtgctagcttgcaagttttcagtttgagtacagacaccaggccatagcccaatggcagcagtgacagggaggaccgtggcagcatgtaacaatcagaagacaacttccggattttcactctgtcctaaaaaggtaaaacgcttaagctcacttttgtagaaaagatgcggtgatttatgcctacacctgactttattacttatgtctatacatgtttgctttttactgtgaatttaatagaaaggagaaagttgaggctctgtctgggcaatagtcttttgtttcacacatgctacagggttacctagacaccaagtgttttcttgctcagtaaagataatttactttgttttcaaaaagcctccaagtagggatgtttaagcgtctgtttttctcctaaggcctactatggtgttccagtgtagtataatttgtggtataaattgtaaatgattgccatttctctggaggttatttcttatcaagaattccagcaggaggaagtgtgcagactcttctttcccactgtcatgggagtctctgggacctattagtcttttttctttctcttcatttctttctttctttccttccttccttttttccttgctttttttcccccccagagacagggtttctctgtatagccctggttgtccttgaactctctctctctgtagatcaggacggttttgaactcagtgatcctcctgcctctgcctcttgggtgctaggattataggtgtacatcactatggtccatttgtcttcttaaaggtagtgttgtgggccagtcactgtccactagccctccactcaaccttcctttcacttccgttacacttcaggatcagtccaggaacaatagagacagatactcctcctcccaccccacccaccagccggggcacctgaccactgaaggacacaaaaaacgagttcaaccagacccacacctttaaattccagcacttgggagacggaaacatttccctcccacctacagtggaaagacctattccaagagacagagactcgagaaattttacttgtcttgttcgtaaacaagcatggaatgacctatctaacttgtcatctgacaaaacaccgaagcaaattgcattaagccagactttcaaaaatactttagacatttagtcttgcatttagttacaattaatttatttagtcttgcatgacccaggtgagccttgacacgtcgaatacatggtgaaaatttgtgtcaactttgtgtgtgtgtgtgtgttttggtttagtttggtttttgaaacagggtcttatgtagcccaggctagcctcaaactcctgatcctcttatctggatcaaaattctacaatttgtaattttcacacttacaaagaaagaagaaaacttttaaatgtatttattgtgtgtgcttgtgtttgtgatgtacgcgcactcatgtgtgtgagctagtgcatgcatgaagaggctgttaccgtgtctgcctgtttgccttgttaatcctccagtctctgctagcctcagtgctggacttatagggatgcatgggcccacacttagcttattatataaaagtgttaggactcaaactgtggtgttcaggcttcctccggaaagcactttgaatcattgagccatctttccagtcctcagaattttcttaagtgaagttgtgtgatatttaggtttaatatccattatttaagtcacttatgatagttgatgttttgttttgttttttgtttttttgtttttgttttgagacaggttctcactctgtatcccagactggcctctaactgatgatgtaagcgcatgctgatgttgaagtcatagtaatcaccctgccctccctctctctctctcctgaacatgggcattacaggcacgagacaacacacctaggttcaacttttttaatttaaaaaaaaaaatgcagccgggcagtggtggcgcatgcctttaatcccagcacttgggaggcagaggcaggtggatttctgagttcgaggccagcctggtctacagagtgagttccaggacagccagggctatacagagaaaccctgtctcgaaaaaccaaaaaaaaaaaaaaaaaaaaaaaaaaaagaaaagaaaagaaagaaaagaaaaaagaaaggaagaaaaagaaactgtggcatgaaagttagaaagatgttttagtttttagtttgctttctattactgtgataaaacattctaaccaaaaatacattgggtaggaaaggatttatctggcttgtacttccacatcacagtagaaattagggcaggaaccacaaaggacagcttcctggcttgctccccatggcttgctcactttgctttttcatacctcccaggaccacctgtccatgggtggctccacccacatggtttaagtggactgcccccccccccagtcgatcgttaaccgagaaaatgtcccacagatttactcacaggccaagctgagcacagggtaccattttttttatttggctaattaactttctgattggagttgaggctcacttgctaggagaaagttcatgccttgtcaaaagcctctagctggggagaccataggctctaatggagaagctttaccactattgcctccctagctggccaccttatgactatcaaattgtcttctaaccatgtatgtttatacctgtagatttgtgctactgtcagctttggtaagactagtttctgttcgtgcagacttttagctctgagtcataagaatatgtgattggctgggcgtgcctttaatcccagcactcgggaggcagaggcaggcagatttctgagttcgaggccagcctggtctacagagtgagttccaggacagccagagctacacagagaaaccctatctcaaaaaaacaaacaaacaaacaaacaaacaaaaaagaatatgtgattgtgtgattgttgaagatcagccctaatgggatctgcatctcctcccttgcaaggttcaagaaacaccacagcaaagagggcagaaaggtaaagctggaagaagggatggggtattgtggaacatacagcagcagtcatactcataaactcacagcacctatgattaccctacccaaggcctgtgtatacaaggggacccccacattccttaggatgtgtaggaagttaacagttgctacaagaggctcacaaggcctcatccctccccgaggaggcagttaacagtgtctagacgtaagggaccaagatgcctcattcctccctgcagaaggggtattagtagttattgtttgctgagggagttgggagggggggatactttcttcggtaagaatctgccatgttcctgtaaataacccttcatccatgctatagaagaaaccagaaatcagaagtgtgtgagcagagtaaggggatcagtaaaagtgagagggagaaaaaaagagagtaatgggagtgaataggaacaaaatcttacgtgtatgtgatgttataatggcactcatattgtatagaatataccctaataaaatgtaaagggttttagctgctactgtggctcattcatgtaatcctagcacttgagaggatggttatgagtttgaggccaggctgagctacatagtgagtttcaagcagcccttaaaggatttttgctggaaattgcaccttatgcctataatcccagaactatagcaactgagggaggcagactccaaattcaaggtaagcccaggctaaagatgaggccctattaaaacagatgaacaaacaaacaaaaaaatctaggttttgtgttctggagaggcaaaatgaaaaccaataccttatcctgctctgtgtaaaatgtgacgtttggtttcccccaaggtccattggacaagagctgttctttttcaggattattttggctgttcatgggtcttcacgcatctatatgtattttatagttatttttgctacttccaaaatacaaaaagaaaacaaacaaaaacccattgggagtgcgatagatattgattgactctacagatcactttgaacagaagtagtattttaacaatattaaatgttctagtcagagcaattatctcagattattttttgttatagcaacattcctcaacctagattaagtcatgaatagtaaagataaatttaggtcacaattctggaaacagagacattcaagactgtgctggccaggattttctcagtttctggttggaagcagtgttaactcataggagagttgtggtagggaaacatctattttgtccagtataatatatgcacaagagctatcaggtagatgctaggatcattttatagcaacctcttcttaaaatccaagaactcagctaggctcttgagaaattaattaaaccctcttaaagatgccaccacatttcagcaccaagacaacatacaagttgctaggagtaaaccatatatttaaactataacaccaagtttgctgtagtggcttgcacctttaatcccaggactcaaaggcagaggcagacagatcttaaataaattggtagccagcctggtctacatagtaatttccaagccagccagggctgtatcaaacaaaaactcaggtcttcaaacttgggggcaagtgtttgtaattgctcagccatctcagtggccctcaattcacttttatatactcattttgtatcctataactttacagctgaattacctgagttgtatggtgtgtgtgtatgtgtgtgtgtgtgtgtgtgtatgtgtgtgtagactttcgtaagtcccccacataaataatcatggcatttgtgagcagagtactccagtcagttacaattcagatattaaaaaaaaaaaaagtaataaagtaaaacagggtctttagcccagggtaacgttgaattgtgatcctctagcttctacgtcctgagtatcagggtcataggcttgtaccactattgggattgcacatagggctttatgcattctagagaaaagcattctacagactgtggtacagtcccagccctggattccttttcttccccaactgttctgcacaggaccatcaattctattaggattggaatctaagagagcaaacattcttggttccttcatcttattaaagggaaagcactcaatttttcaccattgaccatgttagctgtgggctttttcaatgtggcccttatgtactcagacaatttcctcctattcctggtttaccgagagtttttaatcatgagtacactgagtttttccaagtgttttttttttaatttatttatttgttatatgtaagtacactgtagctgtcttcagatgcaccagaagaaggcatcagatctcattatggatggttgtgagccaccatgtggttgctgggatttgaactcacgaccttcagaagagcagttggtgctcttaaccgctgagccatctccccagccccgtgggtttttttgtttgtttgtttgtttgtttgtttgtttttgttttaatgctatcaagatgatcgtcattgtattgtggtgatatcgtgttcattgatttttgtatgttgaatcattcttgcattccatgagtaaatcccacctggatattttaattccatcaaactcgggttatggatattgtaatgatgatgatcatcagggatgtgggctataaatttttaactttcttttgtgtctctttctggctttgatatcaggatcactctggcatcatgaattgagttagatagcatcccttctgcttcggctcttgagagattttaagcattgactgattgtaaggtctccttttgcaaacgtgatttgagtttgttattggtgtagcttagtttcatcagcttcttaaaaaaaattttttttcaagaaaaacagcattttaaaattttgtatttacgctcgagcctttgtcatttctgttttctgccaaggttttcctgcaggtggtggtgactcagagattccttccttaggaatgcgcatctgtaactccccccaccccccaatacacacacctttgtgcggctttagcttcattcattccattaggttttaggtattatcttgtatctttatcccatttccagttgtctcctgatacattctgcttgtctggcattgtttgtctctttattggtagagggagattctccccacgcattccaggcagcctttgagcttctgatcctcctcagccttccagatttgggggattgcagagatgcaccgccaatgacaagcaaaatccctaactaaatcccttcccctcacaccccatttgttcttctggagtgtgctctgaagtgttagcttccaaatctttatgaatgctcacttcttaatgctattgattttgagcatcggttgtgttgatggtgttggtctcctattcatgcatgttgtctccgatcaatgacttctctgcccgtgaaacgagactattcaagtccgattgcattaaaggtaggcttattggggaactgctctcggggagttcactggcttcaaggattgaggagttgccatggggagaggggagaggagaaaagggaagaaggggtgcgctcgtgcagagaggagaagggtggggcgcaaaatgtctagataacattggaaagaacgtcttgtggaagggcagctaagcccctgaactggaaagttcaaggttgggaacaaggtatatcaggcagggactgaacgctgctagtagaacctggaagccaggtctgcattgatatgtaaaataagcacttctgtcccttgtccgggggtcaaaaccagtctaccgttttgttttgttttagcacttttaccatgttaatcataattagatgtaccatctaatccttgcagatgtctaccacgcctgaatttggttctgatctgtattttctagctgagatttttttgttttagtaagctttacatacagtgtttgatgtggttgaaaatgagggctataccatgtgtccactgtttgatacagccagagggatcccaggttggagaatgttccaagtgtctttatttttcctaatttgttgctttggttgctctagagacttcttgaattagttctgagttgtatgacacgttattgtatttctctgatattacaggaggccttgatggtggcagggtgttcattagctgtatctatgccactcaactgtggtcatcacagcgattcttcttgggtcttgtacagttttccttcccgtcggttaagcagaagcgtggtgggctagaattgggcttttttttccctcccttcaggtcggtttgagtcttatgaaagctaaggtggggcaatgttcgagctcaggagttgcatgtcagcctggggattaagggactcagttacttgaatttctaatgagtcacgtttgtctgaggctgaagctaggagagcagactgctatgggggtgtttcagaatgcttccttttctctttctgttccaatccctatggagatcattttcactaaaaaacatgctctagggctcctatgaagaaaagtcacaaaagtgtattgctcgctggatatagcctggattatcttattattaaatttattcaaacaaaccttccaagaaagcgtcagtttgttttcctgtgttcacactgtctgtggacaggagctgttttctcactcatcagcaagtcgctgctctctctaagagactttgtaatttggggaatgttatttccctgatagagtcgaagaaattgttcattttattcaattttttttgtgatgctaaaaatgatggctttggcctggtgtggtggtttttttaatggtgtttttgttttttaataacacactgggtcccgtttgtgccaaccaaccatatatgcatggagatggggtcatccattgcaggttgatggatctatcagagggccacaccattaactcccaatggctcctcagcggtagatcgagtacctcccctagtattggaatcacagctgctgtgagctcctgagcaccggtcctgtcactgctgcttaacccccagcccagatggcccctgtcttaagtgattttctctgaggtttgcatgtaactgtgtgatatagatgctccatttagaactgagcacccttcacactctacagatactattctctccattttgaccacatcaaagccctggtcactacacaaagaagtgtctctggggaggtctgagagctaccctaatccatgggtctagaagtattcatttaaaagatcatttatttgttcgtttctttatttacttaatgtatatgtgttctctgtcttcatggacaatgaaagaggaaattagatcccattgtagatggttgtgggccaccatgtgctttgagccaccatgtggttgctaggaattgcattcaggtgctctggaagagcaagcagccagtgctctcaaccactgagccagcctctcccgttggaggtctgtatttagagaggagttagacgatgtgtctgataagcaaaataataatggatggtccaccactatcaccccaagggtctttgagtgtccaagttgtgggttcttggtcagatttacagcacccattttttttaactgtctttttaatgtttcttttatgtcagtatttacaagtataaatttcctattacaactattactccatgctacaacttctggtctgctgctactttgagatgcttttatccatcttcatattttataatttcccttctttcattctttggatgtttaggcaaattgtatttcgatgcatttgtgaattttccctatatctttttgcttttatttctagtataattctatgtggttaagttctttttttatttttaaatttgtttttgagaatttatgagagctatattcatattgttttccctagaggtatgtgtataaagatcatttatttacttgtttatttactcaatctatatgtgttctctgtcttcatggacaatgaaagagagaatcagatgccattatagagggttgcgggctaccatgtgctatgagctagcatatggttgctgtatacatgtatatatgtatacatgtgtgtgatgtgttacaacttgctgtgtttcaattcaaccttttaatatttatcgaggacctctgacaagaagctgtgggactgttggaatgagtttccctaagagtgaaaaaagaaacatatgtaaacaaaatagaacggagctaacagcccaaaaatgtatccatgctaatccagtctgatttgaaatgcctttaattggagttacatataaactatagtatagatcactgcagaggactgcatccatctaaagtcatccaaggtactacaaatatttgtatttgtaaaaatatgaccaaccaagctcctttttatggctttaagtctgtagcacaaacctgggcttatactgccacctagtgaccaaatagcaaaacaccaaacactgaacttgtttttctggagtctagctgaatagaggctggctgaaaaatggagcagtctaggtagaattctatcattgcagaggatactgggccagcaccaggtttagcacatcccgaggaaacacttggtttttgccctaggatacagtcttccctgaagaccgagcctacaatgagaagcttgctttcctactgttatgcctttgtattgttctgtgttatacagtcagattacagtatcactcaagtcttttctttggttgactatcttctgtctggtcttctggatttccaggagacaattttgttttgttttatttttttgtttttcgagacagggtttctctgtttagccctggctgtcctggaactcactctgtagaccaggctggcctcgaactcagaaatctgcctgcctctgcctcccaagtgctgggattaaaggcgtgcgccaccacgcctggctccaggagacaattttttttttttttttttgcttattcactttacatcctgctcactgcccccaactccaggtccccccctcccatgatccttcttccttctccctcccattcttctctgagctggtgagggcccctgggtatcctcccaccctgacacatcaagtttctgtgaggatatgtgcatcctctcctactgaggcccaccaggcaactcagctaggagaacaaatcccatggacaggcaacagcttttgtgatagcccccgttccagtgttccagtagttcaggatccacatgaaggccaagctgcacatctacattatgagcaggaaggctctatttttcttatgtacaaatcttaaattcctatttgtttaccaggtcatttttggttgtcactgtgacaggttgaattttataatcttgccacttgggaaatagattgtcctttctttctcagagttttgaccccactgctcccctcctccaagaatgaacaagtttatttgtgtcacttgctacagcaccttcagccagtttctgcctgttacataattatcaccaggtctgttcccaagcaaactctcactcaacggagctagataaagatggcttccagcagcataacgaaggctcagttctgagacctatagaatgtccttgcaaggacaccctgtgtgggcttgtcccataccaaagatttctcacacgcccattgctcatttacttgaagtgtgtttgcatattggaatttgaggtgtaaatttttataaaatccgcattctttgttgtgtgtggccatgggggtctgttttctagacttgacagaatttccttaaagatgtgatacaaaggggctgaagagatggctcagtggctaagagcactggctgatcttatgaaggacttaggttctgtttccagcacccacatggcagctcacagctgtctgtaactccagccccaggggatctgactcaagcatctggcctccacattactagccatgcaggtggtacacatgctggtaattaccaaaacacataaaaaagaaacttcaaaaagaagggagacaaagctatctctccagatgggctctatgttcgttgaaacacacttttaatacccagaaggcagttttctgtttgtttgtttgtttgtttgtttttgttttgtttttttttgttttgtttttttttttttgagatgagacttctctgtatagccctgactgtcctggaactcactctgtagaccaggctggcctcgaactcagaaatccacttgtctctgcctcccaagtgctgggattaaagtccaccactgcccggcaagcaggcagttttcaatgttgtcctgtccttcaccttactgcctttgtgaacctagaagctggttacaatcagattaaggacttcaaccttttccaccccccctttctcctgaatatgacttgagtaatgggcacatagatgactttgtagttcccccagaatgcgtagaaacaaaatttcaaagctatcttcccctatcgtcacctcaaagcatcccttttgctggctttgactatgttgtcataacctagataacaacactataattaatttttaaatgtctgcctgaggaagttcatgtaagtggatcaatcattaatgccctgagttgatcttctgggaggcaacaatcagaacacagactcacagttatgtccacattttccactctactccaagtaaactccatcagcaatatgagctgctgaccttcaaatccacctccatgtacttctgtttttaaagatttatttatttattatatctaagtacactgtagctgtcttcagatcacaccagaagagggcatccgatctcattacaagtggttgtgagtcaccatgttgttgttgggatttgaactcaggaccttcagaagagcagtcagtgctttgaactgctgagccatctctccaacccctccatgtacttttgattcgtgcagctttgtaggaagttccaaaatcagcacatgtgtacacagtgccttttaaacctcttaaattctctgcagatctctctatttcttttcaagtcgttggctactttagtttattcagcagggactacctacacctacttagcagcccgctgttcccctgcagtatactttctctttccagagttttgatcactgctatccaaatgcgctcagctatttgatttctgactccagatagcgttcagataagtgtagaaagtaatgagcgtgatatccctagatctttctccttcccgaaaaaagaaactgcttcctccaacattgttacattccaccagacagagctagagcaaggaccaggaaaaatttcacaaactttccctgcggaaaagagggccttgaacttcctcttctacttaacctagcaccttgtctctatcgccatcttgtggactttttgctacattacagagctttgaatatggggattctggggccgaacatgtttgttattgaaggcttatactaaactttatatgccccagtagaggggaatgccagggccaagaagcaggagtgggtgggtaggggtggagggcggagggagggtatagggaactttcgggatagcatttgaaatgtatataaagaaaatatctaataaaaataaataaataaataaataaataaataaataaaaaagaaggcttatactgctagcacttgaatggtggaggcaggagcatgagttgaacaagatatcccaagcttcctgagattcccctccctcaaacaaacacctgattctggcaaatttttacttttgttggacatttgagtactccccacatgcacactgcctttcccctactctattgacttgtgttttaacattaacttgtaggtattttatacagggcatgatgttgttatctattgttgactggttagtcgttttgttttgttttgttttgagacagggtttccgaatgcaacagccctggctgtcctggaacttgcattgtagaccaggctggccttgaattctcagagatgcatctgcctctctctgcctctctgcttctgcctttgcctctcaagtgctgggattaaaggtgtgcatcatcaccacttggctttactttatatagttttaatgtaatgatttctcaggtatatttgaatgtactcatttctaaagtgagtatttccctttggttgctgttttatatttttcaacttcaaactcttcattttattactttttttcctgccaaaaattactccaaaaaacaaaataggaaaagcatacaataaaacatttaataaccacatcccccatatgctaagtaaggagagagctacagtcaacagtttacagactgtggatttatctctgacaccaatgattctcagcatcaagaaaactttctctgcaaagcatatacagggcaaatattgagcacaacgtttcacaagttcaatgggcctcctgaagtcgattcatgaccttcattttcaaaagcagtcccctctccccaaggaccagtgaccatggcagaagaagaaacagactttgtgatgtataggcaaagccggaccagagcaaaacaaaaccttcaggacaggacattaactgctgtacttgtgaactgtagctgcctgaataagcttgtgttaatcgccattccaagcataaggaagcactatttagagttgagagcttttgggagagggacagtcacggttttttgactccttggtaggcacaccaccccagtggatggttcacatccaggcattcacgtgcagcacaaattggacactgtgggtaatttttttttaatgaggagattaagttgagagagggtggcaggtggtggatctgcaaggggttagagaaaggaatgggggtgatatagtacacatgccaaattctcaaagaattaataaaaatattatttttaaaatttggtgatagtttctagaaatcagtatgttttctcctgtacatcctagaaatgctatcttctcacagtcaacttttgttaggtaatcaatgttatcagttaacaactacttataatactaatcactagtagcatccatctttaaaatattttattaaatattttggagtattactttctatcttctaaaggtaaaaaaagaatgcattccagtaacaacatatgcatactggtcattttcgttcatttgaagaaatatgaatgaattgggcattgatatttaaaagcaaagtatctcactgttaaagctttaaattcctagaaagctcaataatttaataattttacacacacaattgttttatggttgttttcgagacagattgttgtctctatgtagccctgactgtcctagaacttgttctgtacatcagactggtctcaaagtcagagatcctcctgcctctgcctcccaagtgcaggaattaaagggtctcatgcatcctagcctggcctcaaactcactatatcgccaaagaggataaccctgaacacctgaaacgtctctctctaccacatacacccaagtgctgcaattacagacctgtgccaagcacacggaacagtagacatactaagaacatggagctatttcagtatacttggcaaaggtaggtgattagcttgggtgcagcttcctgtggccttccatgaattttcatgaatgggcttcttgaatttctactgagaattgatggcttctggggagaagccattttccatcatttgtttcagttcaaagaactcaaggaagaacatgaaagagctccattccagcttttcctcggtactttcttttgtatgtgaaagatgctagaattcttttttgtttgtttgttttgttttgttggtttttttggtttgtttttgtttttgtttttcgagacagggtttctctatatagccctggctgtcctggaactcgctttgtagaccaggccggcctcgaactcagaaatctgcctgcctctgcctcctgagtgctgggattaaaggcgtgcgccgccaccacctggtgaaaggctctaattcttttaatatttcagacctggatggtatagagggcttttgccaaaatatcacattcttggggatttttgtattcattttacttgaagaatctgcctttttcactcagagggttttttgtttcctcccttgggctacatcctatttctttgcaaagaagttctcctcattttctacttttataaaatttgtatcacataccagcaaagctttggggactgaaaattgacattggggttaaaatgatggtacagtggctaagagcagtggctgcatttgcagaggacccaggttcgattcccaaacactcgagtaccagctcacagacgcctgtacctccagctgcagggagatctgatgctctcatccggcctctatgggctctgcacacacccacacacataaaataaaaatatttttaaaaaattctttgaaaagaaaattgggttattatgtggcaggaggattttcttttctgttccagtctaattggtgctctataagcttcttgtgtgcttataggtatctaggtgtgtttataggtatcttgtgtgtttataggtatcttgtgtgtttataggtatcttgtgtgtttataggtacctaggcagattgctcagtttgcattgatactgactgttatacattttttgaaatttggatatgtacagtttaaggaaaatttttctctaggacattaagtctcttgtcaattgaaggagaagtatatcaatccattacagtaggtttccctcaaacccagtctttgagaccgtaagagtttaagagagggggcaggaggaggcaagactggggaggaaagggttggggtgcaggcagtctgccacaaaccaaacaaatgagactgtgttggagctgagcctggcagctttggtctctgggtttccagcattccaacactcaccaagggccattcgaccaggcaagctgctacctgctggcctagctttcccagctctcaaaggcaaatgggctcaggttgcagccattcttttctgtgactcccacaaggtccatgctctgttcccctaagctctgccccctcttctctgcgcaggtggtcaagtgtgctaaccacaccctctcagcaggatcccgcgcctcaagagccttaggtcccgccccacactccctcaaaccctcagtgcagcgcttgtgtcaggcgcaatctcgcaagatccggtgaggcgctacgtcgtgctccactcggtcccaaaagtacctgcaagcgctacacacttgcgctcggcgcccttgctctgttctcactttccgagatatccacgcatcttgagtcctgcatccactcccgggaggcggctgcggcaagcgcgtgatggaagaagagcgtgatagccagctagacaggtggccagagcggagcggtgggtgagatgcgggctaaggagagggcagatgcctaaagtgcctgcgggacggtggagaggtgcccgaagtccttgttggggtggtggagaggtggctgaaattcttgcgggatagtggggcgatggctaagtgcttgcaggacagtggggcgatggctaagtgcttgcgggacaggggagaggtggctaagtgcttgcgggacagtgggacagtggcaaagtgctttcaggacagtggagcgatggctacgtgcttgcgggacagcggaagagatggttaaagtgattgccaagcagcagaaagattcctaaaatgcttgccagctatgcggagatgaaggtaaaatgcctgcgtagtcccgaaccgatagttaaaatgcctgccgcataacggaggaataactaaaatgtctgctgggtcctggagccaaaatttaaaatgtctgtcccttacaggtggttagactaccggtcagggacctggaaagatagctaacatacatgccacgttcccggactaatggctcaaatggatgcctgggactgggagactttactaaaatgcctaccaccggggacctgggctatcactaaaatgcctgccaccgggtactgggaggtcactaaaatgtctgccacggggtacttgggctatcactaaaatgcctgccaccgggtatctgggctatcactaaaatgcctgccaccggggacctgggaggtcactaaaatgcctgccaccggggacctggtaggtcactaaaatgcctgccaccggggatctgggaggtcactaaaatgcctgccgtcgaggatctgggctatcactaaaatgcctgccaccggggatctgggaggtcgctaaaatgcctgccaccgcttactgggaggtcactaaaatgtctgccacgggggacttgggctatcactaaaatgcctgccaccggggacctggtaggtcactaaaatgcctgccaccggggatctgggaggtcactaaaatgcctgccgtcgaggatctgggctatcactaaaatgcctgccaccggggatctgggaggtcgctaaaatgcctgccaccgcttactgggaggtcactaaaatgtctgccacgggggacttgggctatcactaaaatgcctgccaccagggatctgggaggtcactaaaatgcctgccaccggggatctgggctatcactaaaatgtctgccactggggatctggaagatcgctaaaatgcctgccaccggggacctgggctatcactaaaatgcctgccaccggggacctgggctatcactaaaatgtctgccactggggatctggaagatcgctaaaatgcctgccaccggggacctgggctatcactaaaatgcctgccaccggggacctgggctatcactaaaatgtctgccactggggatctggaagatcgctaaaatgcctgccaccggggacctgggctatcgctaaaatgcctgccaccggggacctgggctatcactaaaatgcctgccgccgccagggacctggggagatcgctaaaatccctgccttataaccaacccctagaggtcgactaaaatgtctgctgggcagagcagaggtgatgaaaatgtctgggatagcgtagagatggttggctaaaatgttacaggtagatatgcaaagcgttcaataagcctggcgtgggtaataaactgcagtctagagcggaaaagaaagttaagggcgtgacttgtagcagggtctagaatccacacactcacatcagggaaagcctcgtgtccgaaaaactctttggaatagtcttaatattttaatattgctcaagccaaattcagcaatactacctcaccgcacgtgtctttttcaggtaagatttttgctctttttttttttttttggtaacaattttcccgccatgtgattatgctaaaaaccaatgggattctacctccgctttagtggggttttctgattgtacgcgtttggattaaagttgatgaaagaatgtggggggggggcacagattcagaaaagtggaaaaattactggtagcgtgtgaagtaaccaagaacgagtaactaagtctgcgataactttctttgagaagccttggaagttgagacctaaaattttggtactgcgttccgtttatttccgaggtacataatgacccgatctctggtatcgttgaaattcgaaaataatctgagtgctttgaaaacccattaagtttctactatctgggacaaggagtattttcggggtgggggtggcgggcaaggcaaaacaattctcagtggttcgtatctgaaaaatcatattcttatttactataggcacggaaaatccctcccggtagtgtttattcagtgtgttcagacgagcaaacaatggcactaaggaatgaatccagtttagaaaggagggaaattaacaatcagctttggttttgatgcggatttggggtgaattttgttttttgttttttttttaatgccttatttctgagacaaggtctcagtaaataacctcaaactcgcaaagctctgcctgccactgccttcagtgggacagtgccgattttaaaggcttctgccgccatgtttggattaatgttcagttttcaattcggaagagaagaaagatttgcaaagtactgattttgtaatacctatgcaaattcttacctgtgttagtaggcagacaaacactgactccccagaatatactaatatactatattacattggaggaagaaactgaggtttctaatcaatcgaccttgagataaaaagattcccctagaaggtaaggtgttgtttcattgaaatggcagggataaaagattgacaaagactctacatccggctatagacatagaggaaggcaattactagctaagaaatttgaagctaaaaagggcagggaaatgaattctctaaaacttacagaaggaataatttcaatttaatttcaaataataatttcaatttcaactaggtgtctcacactgaacttctgacttctaaaattataaggttatagatctgtgttgctttaagccaccaagtttgttgggggcttaaacaaatacagcactgtagtgctacctgtgtctctgtatcttcgtagaggttaaggtggttatgaagacatccagaaaaggaatcatgagataggctaaggcacagagtatgtcttttatttacagtttctttgtagaacacctttacctaatgtcttaatcagctaattagcatagtaaaatacaactttgggtagttagagaacaaatagtgtgtcatagctcaagaggctagacctctctaaaatggaggttgggttctggtgttatcccttcctgtcttcctggattgtgaatggctgccttctggctgccctgcgtctggtaaagagacagacaggtttaggctccattcttaagacctcatttgatttgaaattacgtcttttatttaaaggttttatgtacatatgcagtcaaattcgaatggtttctttcttgcgcttgtgtgtgtgtgtgtgtgtgtgtgtgtgtgtgtgtgtgttcatttttgagacagcatttctctatgtaacagccctggtgtcttggaactagctctgtagaccaggctggcctcaaactcacagagatcctcctgcttctcccttcttttcttgtgctgttgaatagaaatagcctcagatctggtgaataatgagttgattactcaaaaacaaagttggaagcttgtttacatgtgctgatattggcatgcctgaagcagccagacagctttttctgtgcaatgtaagtagggtcttctactgaaatccatttggaattatatatactctataggtctactttattattattttagattttacgtgtatgagtgttctgcttgtttgcatgtttgtgaatcatgtgtatgcctgttgggcaccaatgtcagaagagggtttgctaggatccctggaactggagttatagatggttatgagccacaatgtgggtgttggaaatcaaaccaggtcctctgtgagaacagaaagtgctcacattaaaaaatagtagttatagctgggcaggtggctcacacttgttagcactttaaaggcagaggcagaaagggattgcagctagttcaagactagcttgggctacacagtcagttcctgaccaacttggctagaaaacacatgtttttgttttgttttgttttgttttgtttttaagtaaacatctgagcttactatttaaacacacacacacatgagggcatagccgcattcaattcatagcaaataataaaacttttatcaataaaaacttatcaggtccttgtataatgaaaatgaaagttgacgaataaacatgaaagcccaagaaattagaataaggctggaagtgaaagtccaaggtaaatggaattataggggaaagtgatggtttgaatgttgatggtaattgaggagactacacatagaaaacatttaaggcaggcattggcataagtgaggatttgattgggaagactaactcactttagacaaatgggtggatggtgtctttatcagagtgctatgttcaaacatacccttaaattgacttttcatcctcaagatttcttatgccaggaattccttttagtgttggattttactaccagtggtaaaaatatgaaagtagggttgttttgttttgttttgtttcgttttgtttcacacacacacacatacacacacacacacacacacacacacacacacacacaattgtttttttgttttgttttgtttttttggtttttcaagacagggtttctctgtgtagtcctggctgtcctggaactcactctgtagatcaggctggacttgaactcagaaatccgcctgcctctgcctcctgagtgctgggattaaaggcatgcgcatgcggcaccacaccctgctcacaattgtttttaaatatgtgtgtctgaggcattggccccctggagatggagtgacagaggcttgtgagctacctgacttaggtgcttgctagcaaactcaggtcctctcagcaagagcaacatgtgctgctaactgctgagctcttcttccacctttgttcttttgagacgcagtctcatgcagtacagctggctttgagtttgctccgtagccaacgctgaccttgcccttcctgcctccaccttccaagtgttgggttttccctatatttaatatttatttattccttggcaatttcatacatgcattcactcgtacttctcccccactccctacacatcccgaagctgtcttcctataaccttaatgaggtctccttttaaaataataataataatataataataataacaaccctgtgagtccagttagcagtgcttgctggaatgttggctaatcttgtcggaatcgtatgcaggtagccacagccgcagtacgcttgtgagggcggcagccagcattttcacagcttgcctccccatctttagctctcatgttctttccagccctgcttccacgatgttccatgggccttgggcagtgtgtgggttgctatagacaccttgtttggagctaagcatgcaattgttgctcagtctcaggccagctctgagtctgcattagctgctcctccttgcagaagaaacttctctggccaaggtcgaggagagtacagtattgatttgttcttgagatagagttttccagggtagccctggctggctcactatatagtatagcccaggctggtctcaaactcacagtgatcgacctgcctctgcttgccaagtgctgggattaaaagcacgtccctctctgcctggctcgacttattttttgacatggggactcactgcctggtgtccccctcctcctatagcctcaaaatggctgagcaagagtcaggtaacttgcttctctgccattcctgaagccctgtgttccatccggaacctgcataaaccaggtgaggggtgtgcttgtagtcacagcactgaggtcaaggcagaagtgtcagaaattcaaggtcatcctatctacaaagagaatttgagaccagcctgggctacaagaccctgtctcaaaacgtacaaacaagcaaacaaacaaaaaacaaattcaggagctggagagacggctcagtagttaagagcactgactgtacttctaaaggtcctgagttcaattcccagcaaccacatggtggcttacaaccgtctgtaatgggatctggtgccctcttctggtatatctgaagacagcaacagtgtactaatataaataaaataaataaacctttaaaaaaacaaaaaacaaattcaggggctccagaagagtagcaaatgttcttggtaaccactgagccatctttccagctctcctgtccttctttctttccttccttcctttctttttcttctcctctcccctcctctcctctcccctcccctcctcccctcccccctcctcctcctcctcctcctcttcttcttcctctctctctctctctctctctctctctctctctctctctcctctttctttctttttttttttgagacagagtctcatgacattgcccaggatagacccaattcttcatcttcttgctctaaatctcccaagtgccgcggttacaggcccttgcctccaacaccagctggttcctaggttctagatagctattccaagtaggtagatgcgagggatatccaattatagtttgcttcatttccctagtgggaatagagaataaggccttgtttatttacttacttttaaaggctctcatgtagcccagcccagccttgaattctgatccatggtccaccacctccaggcttgcaatgcctactggcttttttcagacctgtagtcttttgttgttcggtgtgtatgtatgtatttatttagtgcattggtgttttgcctgaatgtaagtctgtatgagggtgtcagataccctggaactggacttacagacagttgtgagctgccatgtgggtgctgggaattgaaccacaaccacggtccggtccggaagagcagccagcattcttaaccaatgagccatttctccagcccctttgtttgtttgttttttagggaccagtaaattaattttaaacctagaaagccctcccttgtctacagaattcttttagttattctttctattggaactgagcttagggtgagtgcttggttagggtagtgcttggttagggtgagtgtttggttagagtgagtgcttggttagggtgcatgcttggttagggtgagtgcttggttagggtagtgcttggttagggtgagtgtttggttagagtgagtgcttggttagggtgcatgcttggttagggtgagtgcttggttagggtgcatgcttggttagggtgagtgcttggttagggtgcatgcttagttagggtgagtgcttggttagggtgagtgcttggttagggtgagtgcttggttagggtgagtgcttggttagggtgagtgcttggttagggtgagtgcttggttacagtgtgtgcttggttagggtgagtgcttggttagggtgcatgcttggttagggtgagtgcttggttagggtgcatgcttggttagggtgagtgcttggttagggtgcatgcttggttagggtgagtgcttggttagggtgagtgtttggttagggtgagtgcttggttagggtgtatgcttggttagggtgagtgcttgattagggtgagtgctgggttagggtgagtgctcggttagggtgagtgctcggttagggtgtgtgctcggttagggtgagtgcttggttagggtgagtgcttggttagggtgagtacttggttagggtgagtacttggttagggtgagcgcttggttagggtgtgtgcttggttagggtgagtgcttggttagggtgagtgcttggttagggtgagtgcttggttagggtgagtgcttggttagggtgagtgcttggttacagtgtgtgcttggttagggtgagtgcttggttagggtgcatgcttggttagggtgagtgcttggttagggtgcgtgcttggttagggtgagtgcttggttagggtgcatgcttggttagggtgagttcttggttagggtgagtgcttggttagggtgtgtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgagtgcttggttagggtgcatgcttggttagggtgagtgcttggttagggtgagtgcttgggtttccagcagtatgccagagacttccaagccagccaggactgcaatgtgagaccctgactcaaaaatgaaagaaaaacaaaagcaaaaacaattgtctctgtgtgtgcttagtttaatcttatccactccaccttctctccctgataggagacaaattttggttcgagtaaagcacagaggaactaattaacctgagattacttgcagaatagcccttcctgacccttgaaggcgccatgttattacacgttgctgtctcttctatctacagctctatttcttcctcttctttattcttgtgccagcttcacctcactgtgccattgtgccgggagggcagttttaatggccacttgcctgccctctcctgaccttgcgcaaggacctgggttgaggggagggctttgggtgccgtgggctcctcgtgttcccaggccctgctgggcccaggtgcaacatggtggcttcccgccccggaatgggaggagtggactctgcctctgtcattctccagtcgggggaagtgctggctcaggctctgcaaccacagtgcagatgggagaggggccatgggacagaaaggcaaggaccctcagtgctagcagctgctggctttgtgacccatacccagcccagctcctgcctccctcttggatggcagggacagtctgggaacttctacctgatcctcacatctattctctctttccagaagcctcagaaggagtctccctgcccctgagtttccaaagctcctcacccagggggaataaggatgcccatgcatagcaagaacctgtcacttgcaggttgcctggaagacccgggcagctcacaactcatgccttggaccttaactgcctgtttctagttgaggaacccaggctgaggaaaccaagttatatcaccaagagcatttattctagcaaaccatgaaggggctcatgtgtgcctcttcaatacctatgaaaaatttataataaaaaatcctatttaaagccgggcgtggtggcgcacgcctttaatccccagcactccggaggcagaggcagacggatttctgagttcgaggccctggctgtccctctaccactgagccacatccttacttagcccagatcccgcctttgaagaatcgcagtgtttggcttctaaatgaccagggtgacagtcagacgagggagtccagtgctgctgacccgtgcagcgaccctagccatcagggcaaggatgctggcagccctcctcttgactctttttcgttcgttccttccttccttcttttgtgtgatgcgtattgtatatgaatgtggatggtgtgtgtacacgtttgtgggtgagggttgcacagagcataatggagtcagaggacaacttcaggtgtgcatctggccttccacgttgtttatgagagcatctctctctctctctctctctctctctttcttcctttctattttttaaaacattttgttttacataagtacactgttgctgacttcagacgcaccagaagagggcatcagatcccattacaggtggttgtgagccaccatatggttgctgggatttgaactcaggacctctggaagagcatccagtgctcttaacctgagccatcatctctccagctcagacaggtcttttgttttgtttttgttttttcgagacagggtttctctgtgtagccctggctgtcctggaactcactctgtagaccaggctggcctcgaactcagaaatccgcctgcctctgcctctggagtgctgggattaaaggcgtgcgccaccacgcccggctttaaatagggttttttattagaaatttttcataggtatatagaatgcattctgcttactcttccactttcaatttccctcccgccctggccagcaccccttattccttacaaaatgtctctgtcatatttgctagttttattttgtttagtgtttcatagttcaccccagacatagtttggaactattaaatactcatcagtggatacgtttgagtgccccgtgtcccaatcctttagttgccagtaataaatggtaaggtttcatgggcttcttggagttgggccaatgctattttccaaagatgttaagatttaccataatagattcttgtacctgcctcactcacactcgcttgcagtacctgtctatctttctcttcttgccaatcacattgtagatgaggcttttgtggttttgttggctccttgtattagcataaggtgaactgatttcaggtaaaatgttgttgcttttctggcccattcattggatggaaacgaaggcccggttttgttggagcacttctactggttagcaatggctaggcagagccatgtctaacagtacaaactctctcctgagagaatttatcttttctcctagacgcaattttgtcactttgaattttagaactatcagaggcccctttctctattcaaggacttcttgacagccatgttctttcttttcatttcatcttaccagtactcccacttttgagcctcaatattttgcttctcgtgatcttattagatttgtgttctcataatctttctcctgaacaacttaggctctaagttatgagacctcaaattacccaaggaactggctaggcctgcctggtggtgtaggcctttaatccgagcactcctgagtcagtagcagacagtgctctatggatttagggccagcctaatctacatggacttcaggctagccagatggccagggcaacataaccaatttcattacatagggaattaaaactgaggtatctggtatgataaaagggccactgagttagaaactatcatctgaaaagcaggcttagtggtacaagcctgtaattctaacacaggaggatcaggagctcagagtcattccggctacttagggacttggaggctagcctagttctggctccatgcaaaggaaaaggggaatgtggcagtggttaagataccataatagattcttgtacctgcctcactcacactcgcttgcagtacctgtctatctttctcttcttgccaatcacattgtagatgaggcttttgtggttttgttggctccttgtattagcataaggtgaactgatttaagagcactaactgctcttccaggggatctgaattacattccggctacacacaagatggcgtctgtaacttggtttccttgggatccgacaccctctgctggcctacacgggtataacacccaaacctaatgcatagacaaaactcatgcacattaaataaaatttaaggaaaatatcatatacagcacatgatgttttcaaaacaaagcattttatttaacagcaaactaccccacccactcaaccacccacccacccacccacccacccatccacccacccacacacggactcattgtgacatgttggtaagcaacagttttttttttcaagtcttcaaaacacccaagagtcaacagaagttctgtattccgcatccgttcacaaagtccaggtgttttccatgtgttttttcacagttggtgggaagatgactccagtctttcaacaacagattggtacacagttcatttatgtgatcaaagcagatgatggtaggatgtgcttaattggtagcaatattgatggcagtaactgtgaaaggaaggctttcagttattttttcctttgcaaattccagaaatgtaagcccattcctacccatacaaagggatattactgaatccagccaatttccactaattaaaagctaatattagtaacacttttgatgcccaattgagttttaatgaaaatgaaaaaaatttgtttgaactcccagacctcttcaacctggctccatcttctctgttccttttcttttgcctgaatgtcctgattgggttactaagtaaagtctagatactttgaaagtatgcgtatgctacaatgaataagcttccttacagcaaattgtgacttcagctctaaggcaacttggataaagagatcacattgacttaatctgtttcattcccatttgactcaaggcttagctgatagccatttagatgaaaatacattttcagaaacatttagcgaattaataccaattttgtggaactgcattaaagtcccaacttagattccagatagacaggctggaccctttccttcactcggcctcctgtcccaccctctgtgagtgaaagaaaaatggaaagggtcaaagcacaggcatttttaatctttttcaagttctttcaatttggtctttcgttcctccagttttctgattgttgtcaattttattattcttaaattttatgcaagaatgttaaacattaatgttattttcatccactggcattattttaccatagcaagccaccttgagtatattatagtaaggagaacatttctaaattactgtgagcattagcatgtaaaaaggtaaaaggtttaacgaacacaggcaaaattggtcaatgtatttcaaagcctgctgcagctcaaaaatggcttgtttgccccaggataatgcaaagtagcctaagattgtggaacttagatggctgtcatccctcctgaccagtagtggtcacagtcatagctaaaatggcctagaaaattgagtttcttagcgtggagggcttctgtaactttagggtcaggcttgctacaaagcccagcttcccactcattgcagtggccggagaagacatgaggatgaggactcacattgcatattacttggggactaaggactaagtcgtgccactacccagaaaagagaccccccccccccatccagcacttccctatgtctatgtttcctttttccatgtctcaggagccaagtgaaggcctaagagacatgcaaatccttgtagaacaggcgaaccaataaagcaaatgaatgaataataaccttcctgtattcaacctctgaggcaaactgtgggaaatgaggaaagtgttcttcagtctagaaaacgtttgagctaatatttctgtttaataaagagcatccctctgctttccggggcatctgtaagtcacactgagtgcccttttggaacaaatgtgttgcacttagcatccagtagcatcttctgcaatgtgtggaaccgaggaaatagagaacctcttttattatttccactctaccaagcatgcccatgaggaggggagcaactttttatttaacttgcctcctctacaccttgatgtttttcccagctaaagtgagagctgtagtctcaaggtgtgactgcagtcccctcagaaactactgaggtaaagtacactttgggttgcatcctttaaatgtctttgttcttttcagtacttagaaattttagtacttagaactgcactttcatcacacttaagttaaaagtatgagtgtgatagtatattcttcttgctcacatgacgctgagccaggcaatgaacaaatacgtttagaattatcgattcatcttgattctcctttgaaacacttcaacagtaagaaaaggaaaatgggtaatgaattaaaggacagactttaagtctgtcctggcttcaagctaggccaatgagaaaatgacttttggagcttccttagctaggaagtctccagtttatgttgaaggaatcttggccttggttgggtttcgcaaacagccattatagttaaaatatttactcagaaggctggagagatgactcagtggttaagagtctgactgctcttccgaaggtcctgagttcaaatcccaacaaccacatgggggctcacaaccatctgtaatgtgatgtggtgccctcttctggtgtgtctgaagacagcaacagcgtactcatatacataaaatatataattctttaaaaatattattcactcagtaatcagatatattcttcaggctgggcatgggttaagcacatctgtaatctcagcacttgagaagctgtgacagtcaccaattagaaccagcctgggctttatgagaccatgtctcctatgatcagtgatctacactaggtccacctcacattttagttttaggacctaggttagcatattttatatacaatgtttcattaggtgttgtgttctgcatgcttggtccctccagccagtacatctagttcgagaggttctgggccacactgagtacatgccatcagatgctctggcctcttcccgttttgttccctgatacccatgctctgggattatctcactctggccctataaaactcctttactggcaaggtgtttgtaattcatctctggcagcagcattcaacaaacatttaagaaactggatggaaaaagttcctgtcattaataaaaccttttccacctcctcagtcaagccagctgggaagtatcctagacagcatagtccactcagtgtaacatttagcacactgccttgcacaaatccattttttttttctgttttcatttcctcattgaagtgaattgaagttttggtctagatttcactcctataagtgctacataatgctagaaagcaatctatgtgttcgctcaacacatagcatggtaaaattattattaggtggtgttaggtgataagcattatgattaagtttcagccattatgaaacttagaaagtaatcactgttcactgataaagccaacagttaggtcccggctttatagaactgtagacttcacaaagctccacacagatctgttgtgcatgcctgggataaaagcaaagtcattgcacaccaggcaaatattgcatatatacacatatatatggcagtttacaaattataaattaatctcatgcataatttctttagatacacaggacaatgagaatgctctttgcatcccagtgcctagcaagggcactgttttgtaataaatgactgccattcagtatgtactcatcaagtattgaatgcttcatatattcagtggttcacagttacttatttactttattttcacagtataataaatgtggcagaattttaaaagcctggaaattgataccaagtaagaaaatgaattgttacatttatatggtacctccgagttcataaaatgccaacgtacatattattctcaagtgtggacacactgaaatgtacgtctgtgtatctctccagtacccatgaaagagaatatacacatgggagacaatatttagcctccaggtttgagattgaccttatggtcttcccaggctagcctccaatttctgggctcaagtggtcctgttgcttcagctcagagcacatgctaccacacccagcttgttaactgtactcttcccattatgggctaaaaagtacaatgaaaattttgtagagactatgcctattttataggcagctttatttctatagaaaatttgtcttgtcttatactactgaactgctttatagttaagaaagtacccacaaccataatgtgacctgggcaaatgttcttgtattaacatgcccttatcactcaagttttgactgattaaattaagcattggctcattccttatgaatagtatggaatgcaaacattcttatttcatggcagttactcatgaatatttcatgtacccaaaacaatatcggatacatcagaggtagttagtagtcattcatttgcacacatggaacaattgatagctgtataatgctttatttaatgcattcttttgtaaattctagttctgtggtaatgtccccctttgttattcccagtgctgaacatgggtattcagaaattagaaggtgatcagaatagggtaatcaatcacctgcattagtgacctagtttgtagtttaaaatcagtttccatgtgttttctcttctgctacctggtataatataacttactgagcctcaccaaagcagaagaaacacactggccttaagtatatggactgttattcattcaagccccgttatgttcatatatttgtttttacaaagcatgttattcctagagcaatctttgtgcctatagcacacagaggcgtagacttcagctactatgtaatacatactcagcactgacttggaagttacagtaggcttcatggtttacgtattcatacgtttcctggttacctggtaatatcttgttacctgggggtgaccacagtgaagcatcacagccttagtattcagcacaaaaaatatgcagggaaggaaattaatgttactcagacattccctggcattcatatcagggcttgatcaagtacaggcaatagaccagtgtgcctttttcttaccttttgaaaaggatttgcaactaaggaatatgcaactaagaccatgaacccacaaagcttcaggtacttagtctgatgccttataggaaaagctctacactttcagataataaccatgtataattgccaatgtgctatgagcatgttactttttcatcctgtgtcatttaacttccctcttacagaggaagaggaaggcacgaaaaagattaagcccgttaagtagtccttagagtctctcatcattaattttaaaggtaggtattagacccaggagttcctttggtgaaatgcaccaaattactcggccactactatgagcagggagttcagacctcattttgtccccaaaccattattagaaaaccataccctgctcacctaagcccaaagaaagaaggtgacactggctggtgcttctcagagggttggcacatctgcatattgcttgtctaattcttctcattggtctggaacaactctttatattttctctagatagcctgacattgttttccccctaacaacctgatgctttccttttcttgtcagcctagggcttctgaggtagggaggatggcagtatgcatatctgtatgcatgcttattcctagggaagtttcaatagtcaggctatatacactggctggatttagttccgtctcaagtggagcagatgtgaagagaaatggaagttgtaaaacatcaacaatttaacaaatggctaagacccagtttaaaacagacccttgcacaatactatccagctaaaaacgtattcctttatgggcaatggcaacaatgaaaaattacatctcaagtgaagacagcttaaatagaaatataagaaatggaaagggatgctggggttggggggcaggtctcatcttcgaatttcccttcttggtcttggggatagaaggatagaaatatccttccagagttctgggccataggcctttatctcttaaatattctgtccatataggattgggtccttaggtcttatgcttggacttagctcaggttttgtgtcttatgacatacgtagttccccgctcttggaagtcacaggtgtcctgtagaaacagttcctcttctttgggttgtcagcattctgtccagccagctcaagacgggccatctgtgtattttggtccttttaaatctcaagtcgcaaaacttctgtcttctacttgggcgttcacttcagagccacttgaatcctgaccggacggaatgatgtattttgtcttagattatttctcagggcagtctggtgtgaggaacggctccacgggtgacattctggacctattgggaaggggctatgaagctcctctcacacatgacacacataacacacatgcacacacgcacatgtacatacaaagaaacatccaagaaaggattactttagaatacaagagagacacagacttgtaaagagatgaaatgctcaaagtgaacagaaaggaggaaagtagaagatagaaacacaagcaaacacaaagcaacagaatgatgctgagataagaaatccaccaatagcaaagagacacaaatacaaaagaaaacagagaaagtggcccaagaaaggcagggaagaaatgtaaacaagaattcactaaggatagaagcagcagaaagaaaactgaaatggactgacaaagagaacttgaacaaagaacaagtggggtgagcacaagaaaaagagagggatgcatgcaacatgtgacccaaaggggagtcacgaaaggcaggagtgaaagaaaagctaagagaaatagcaaccagatagataaaacagagagccatagctagtgaagacaaagcagaccacacaggcaccagagaaagtgaaacaaagctcaaagctctgcaagaaagaacatgcaggagaaacatgggaataggtaagacacactgcagacagaaaagacacacaaaggaaagaaggagacatgcaaaggaaggaagaaatagatgtaacaaagaattagacacacaaggaagaagtagatacacaaaacaaggaagacatagacacacaaagcaaggaagacatagacacacaaagcaaggaagaaatagacacacaaagcaaggaagaaatagatgcaacaacgaattagacaacacaaggagacatagacacacaaagcaatgaagaaatatatataccaaagaattagacacaatgcaaggaagaaatagacacacaaaagcaaggaagaaatagatgtaacaaagaattagacacaactgcaaggaagaaatagacacacaaaagcaagaaagaaagacacacaaaagcaaggaagaaatagatgtaacaaagaattagacacaactgcaaggaagaaatagacacaaagcaaggaagacagacacacaaagcaaggaagaaatagatataacaaagaattagacacaatgcaaggaagaaatagacacacaaagcaaggaagaaatagatgtaacaaagaattagacacaactgcaaggaagaaatagacacaaagcaaggaagaaatagatataacaaagaattagacataatgcaaggaagaaatagacacacaaagcaaggaagaaatagacacacaaagcaaggaagaaatagatgtaacaaagaattagacacacagaccaaggaaaaaatagatacataaaacaagaaatagacacacccacaatacacactaatgattgatagtaagcaaagaccaccagaaagagggtaacaagaaacagggaagggcaaagaaaaaaattgccattagtacactgtaccaggctatcaacgttaaacttaaggtttccttaacataggaccataggacacacccgtcaactcttccaaatggcctagtcatgcaactccagggcatatttgccaggctctgtactcaacactttccattcatgatttcatttgaccttcacaaacagacaggtcttagcagaactaaattgccaaagggcatacatctaggggatattacatttaaacacagaatgaacatctcaacattctgttacatggattaaaagcttctgtaagcagcaaacactataagcgactgcatatttaattgtcagcttcactctcctcttctattaaaaaaaagggggggcttggtttttacatccttcacaagtctaatggctgcttcacagatggagataagaaataaactatttaaagcttttcaatgtttaagtctgtaagaatggtagggcaccaagccaaaacaaacaacaacaacaacaaaacctagaagctaaattcctcttgtgatataactggtaagcagataatagtttgagttgctgctgtgaggccatttgataacgtgaaagcctgttcatcttccatcgtgtacatggccctgcctcacattatcacattagatgctctccacccagcaccatcttccagcaaatgcaaatcctcagaagactgcaatgctagtgacttacctcattctattgcttttaagatgctgcagtcaggcatgttgatcctcgggtcatttataaagctgccttccttttgtgtgttcacattgcttgatcacgctgaagacccagttttctgtgctgctttggggaagggtaatatttggtagatggcactacaaagaacaaaagaagctgtatgaatgccaggaaagaagtactagaacatcctggctctttaaattctgcctaatgatagatacttctgtatcaattccagccaggtttccatttgtagttagaggcattcatcatcagtaatgttagtgatggctcagtggttaagagcacctattgctcttccagaggtcctgagttcaatccccagcaaccacatggtggcgcacaaccatctgtaatgagatctggtgctctcttctggtgtgtctgaggacagcaacagtgtactcgtaaatagctaggtaggtaaataagctactcacttgtgtattatatggcatgagtagggtagcagtgcatcttgaagtatgtaaacagctggcaaagctttcctagcttctggagagagaaccaaatagagcagaatggcttcctcgaaggtcagtgccactattgcagcagcttttctcctagaagaaacatttgcactgtttagttacatttcccagatgtgggaaaaagataaaatttatgtatatatctcaagtaaaaggctgactttaatggaaaacaagatcaaagttaaaattattacactgttgcagaaaacttacctactttgatgtagggtggcattctttgagcctttgtcttccttgctgggttcaggaaagcgtctcactgaaatctgggctaggcctgttgcccagtggtggtgagctattcccctggaggatcctcatgccccatctccacctagggatcgtcaaagggaataggtcgccagcactgcaaagcagcaagcccacaattctggggggagatctggaaaagaggtgaaagaaaagccaattcttgaaatcaagaatactgggaaagttgtctcattatgtagtaaccagcagttgtgttaaatcatggggaggggcttggagagtgaacccttcacatttgtagatcttagtgttaacttagagacatgagaattgctccatccaagttctttctggcttttattctgtcacctaccaatgagagatcctttagattataggttgtgttaaagtccttgtacttcaaatactctgggaataaaggggttaaattattttcttcttttaatttgtgctttaaacaataccatgccagaacactggcaaggtgaatagcattgtttggctcagtgcttatggtgcatatgtccctagaaactggtgtagcattggacctctgagtttgaggatattcagagaccagaattatgacaggcctacagaatgtgacaacagccatatctacttactctatcaagtacaaaagactagggtgtcagaaactggccttcattcctctgataacctaccttttaggcatttcagagcagaaatgttacagattggtcataacatggtggggatgatttcaaggcctcatcataaggcaaggatctcattggctaactgactatgccaggggaccaggagatggggagtgctttattgacttgccccctcattctctgatgaactggagatcagatagaaacccccaaatagcaaattctccaaagtacctttttttctccatgtggcctgtaagctttttgttcagagtagcgaggacttgaagagaagttctgctgagatgtaatgtagctgtataggctgctggcagtccttgagtctcacatagggattgtttgtccctgtgaagaaatacaaggctatcattagactacaaaaattgttgaaaattccacatgaaaataatgaggtatttacttaggaggtataacttgacacattagacctttaagggaagatactatctcagtcaaccaagtaacggaaatacctttgggctctctccagcactcttcactcctctaaatccaggcaatccttcttcttgaggcaggagcacaaaacagactccaaattcatccctggaaaacaaatgataattatactaaactctacaaatgataatttgattactagcaatacaatcttcatatgcacatgtcagcgttttcaattggtggtaagaactcagggtgaggatatgttctcatggaacccctagttcttaagagatgtgaaaacagcctttaaaattgaaagcatgtctacatttcaaaggcctttcatttcttttccctttttgtatatttgagtactctatctgcatgtatgcctgtgtgccagaagagggagtcagacgtcattacagatggttgtgagccaccatgtggttgctgggaattgtactcaggacctctggaagactaacagaaccatctctccagctctcgtcttaagtgagctttctcttttcctgttttatttaaaattaacaaaactttcttatgactacacaaatagagccatcttcccctgggatgagccagaggactaagtaaggggcaggcagaagaggttcactggactgggagagagggcacaggttggacagtggctaggttatatggcagtatgcatacaaagacctggtctggttctgccacagggctttgtaaaatcagctggcaaaatccactacttccacttcccaccacttaatgaaggtgtacattctcaaattcacttgttctacagggttctttgtttacaaactcctaagtctgggtcaagccattggacagcttggaagaaagctcattcttctttttttttcaagacagggtttctctgtgtagccctggctgtcctggaactcactctgtagaccaggctggcctcgaactcagagatccgcctgcctctgcctcccaagtgctgggattaaaggctcgagctaccactgcccggctgaaagctcattcttaatgtatacagttcaggcagcctgaagatggtgatggcgagttggtggctttccattacatgattactgacagtgagggctgggtcaggacactaatttggggaactctttgtattccatcaattatggggaccaaagatggcctccagatggttttgtgtgatggcacctcctaatggacatttcaatcacagacaagctcatgttccagatgtcctactacaaataagtgtgtattttacagtgccgtggaggtcatgtaggactaggttgccatgacagaattggccctgattaatgatctgcctgctcacacaacttgatcatttcaatagggaactgtcagtgatagtgggtttactgtgaatagcagcagtaccagcttcctccaggccactaactggagtctgagtcctaatctctatttaggtccataggaggcaggctgaaagctctaggtgcctaggcaagcctgggggggggggtcactttgcatgtactggggtgggtagccaatggtgctaaggtgagaccgaagctttagctaactgtcttagtgcaccaaacacattctttagcatctcaaaaagctttttttccttgcaaatgtttccttttgaagcagttacttgtacaacaatggtcctagtttcctaaaagactcaatagttctagatgtattatcacctagagagccagacaatgctaagcctttggagttgggggaaacctgctgcgaaggaatttacagtggacttaaaagggttaaagtactagagggtcatttgcacgtacaaaaggcaaatgcaaaaaaatgttaagtgttatggacaaggatgttttttcagctagaccattttctacacaggagtcaagtatttgttgttttaactgaaagtatctgttgaaaagtgctggcaggggtccagtgtggcacccacccttaatcccaacactctaaactggaggcagaggcgggcggatctctgcgggcggatctcttgagtttgagttccaggatagccagactacacagagaatccctgtcacaaaacaaaacagagaacaaaacaaaattaattgattaattaatgaaaaagaaaaatgagcaaggagggtacataaagtagtccatagtaaaatttgttcataaaacttatccttctttgcacttttgtaaaaaaaaaaaaaaaaaaaaaaaaaaaaaaaaaaaaaaaaaaaaaaaaagattgtaagctatgaagttctctgtctaagctgttagtgccgtccagtggtctgttctgggcagaaatgcagtaaaaatggttgaaagaaccaaattatcaaatttatattcccaattcctacacaagctcatctcttgctacccttggcgtacagctaagcataatgcatggagtctttcactcttaatattctttccatgcttccaagaggtagatagaaacagatggcattcagataaaccaaccagatggtactaatagtcgtctggaccaacaaggcaaagtaagcacacttccctctttaagaagtcaaatttcaaccccagtagacttcctaaaatacttaaacaattcacacaggcagtacatttcctaaaatgatctcaagtgtgcttatattacattaagtcttaaataacataatcatctcacggaagaaattttgtaaaatatcatcgcttctcattttagtgtaccccagcataatggcgattgggtacacaatgtgttaattctacaatttcgttggcatactatgtgttgtgtatggataagctgagaagagctagtgacttattagtcactttgacttttcagtgggtggcacagaaagaaactcgaatgagaaaaagatagcttagtagctaacaaggtagtacttactgtagtctaaacagccagagtctgatgtaacggaggagcagtagttcaagcaggatcctgcactggatgagttacttgaacatcctcctcagaaaaatagtatcatttctcagtaatgctgggagaactgctgttgtgatgattattttcatcagcaatgtcatatcaaacactcagcagcgggatggcaagatggcacgcggagggtaaaggcacttgctgccaagcctgatgatctcactttgatctccaggacccacaagatagacgaaccagctcccattgttgtctgagcaccatgtgaatgaatgactgcgcgcagcaacatgcatgtacacacacacatacatacactcatacacaatagctcccaaaaaagacctaagtactcggcggctacaaagcacccttcacactagagaaagctcttttcttactaggaaaatctctctttgaagtgtacgtttaaaggaatgattagatcctggcagacatattttaaaatgtaaagtggggaaacaggttctatcatctctaaaataaattcccactttaggaattttcaagctacttcaaattattgccagagtttaatggtggatagaatgaattaattaaatgtgatggcctatataattttcaaaggcgacttgacatgttctcaaatttaatccatccagtcaccttttaaaaataagcaaggactggtgaccaatgtcagacaaaatataatgattagaaggcttaggtcatcttccaaaaagttaatcatactaaaggccacacaaagattgactttttcgttttgttaaacttgtagtaaagaccaagcaaagatacttgtcttaaacattctgcaatagttgcactgatctttccacagactcatcaccctcagtacactgagacactgcttagtcttcagaaacatgacacaaatggctatttttacttcacaaaagctaatgatctcacagtcaatccaccttgcaatccaaatgcctttcttaaggaataaaattatcaataacttttctggcagttggtcctgtacagtagcaatatacaaaatcgggcttaaagtttcttaagcagacagttggctccttcctggaggaagaacggaaagaaaagtgctaagcttccttctcaggaagacaattttcagttcatactgtaaaggaaagccccaagtaaaaggtggcaatccaactccctgagctacttgcctgcaatattttgcacaataaagcattaataaaggtaggcaagaatggttcctggccctagaatgtgccagcagttggaattggaataatttagaagtgcaagttaaagattgaaggctcatccacctagttttggcctgcttttgctattcagtgtataaatacaccaaaatttattaatgacacatagggtgtttggggtaattaacattacccagaataatgtaagaattcgaggtgtctctgttcagtgggagcaaggagaaggcaactgagacactgtagccatatgaagtgagtaaactggtgttgttgactttaagtcaagagaagggctttgcccagtcaatactgttcaaacaaagaggcaaaagggatggcatgatggaattgagaaagggcacaaactcttccttaatgatgggtttgtgagaattagtgattcagaaaagtggtcaatggacaaactagaggccgggcaaaaggaacactataaagtgtgagattgtgactatttaggattgtatatattaaagcaatgcaaaaagggtcgaaatccgggtcattgttgggtgtacatactgctgtactttattatatcattgggaaactagcaggggatttgctcaagttggagtagaaaataaaccatccagaactgccattgtgcctattaagagtcccaaaatcagtttaaggaagagagcaggtcattcgtcagagcccctgtgctcattgacagtaccgggtagtttcgggggctcagcaacctctgcaataatgtaaaggggacaaaatattccagacattcatagttataaatacgcataacttagcaattaattctgggactcagtagccttgatggtatgcaaagagagcacacaggtccttgacatttttgcatagtaatcatccaaatgctgaggttactaatagttactaccactcagcagccccagtcaaaaggtaggcatttcagaacctttgctgccgcacaggtcatatgtgtaagggtacagattaatattgacaagagaagtgctcagaaataattaatatgcctctggtgtcaaaagagtacaaggatgtaaaatccaactccaaaggtaatgatggacaactaactgcattaatgcacttaagtccaaatgaagagcacttcgtacaaccctctttctgctttaaagcggagaagagggtacagtagttcttagagaagtgcttagacatgtgaactttccaaatgaaagtcttgagcttattatcacttcctgctgaaggtgctaaggaagtgagtgggatcctttcaagtgcacagagcaggtggcagtgcatacgcatacatttaatatatgataacagtccaaaagaatgcggccttgttgatcagcatatcctgatatagtgcaaatgaaaggcgaaggagtatggcctttgtttactggcaaagacaaaggaagattcactgtatattaatggtccactagcagggaccttgggagataaacggtatcccttgcaggagtgcaagagatacaatggtccgaaaagtaataaggttgtggataagtgtaattttacacattaactggccaagtatttttattaaaatgaatggatcatgtccctgttatatacattaatgttcaagggacatgttatcaattaaaaaccccatcctttatgcaaatattaagtctttaaagtaatagtcctggaaattaaagagtggaaaggaggggacagccttatccagtgtccaggaagatgaagaagccaaaagattagtgacccttgctgtactgcaaaagggtttgagagtaggatcgtatccaaatggaatgagatgtgtgcagtaaatgcatactaatatgcaaggtacatgtttatggccattacagttttacgctgttcaggtttccttctgtagtgaacagaaaaggcctactacaatcagtcattattattagcaagccacaaaatgggaccttataggtcaacaccacttctgtacttcaaagttaagagtaaaattgatcctactaaaattgccagtatgtacataaatagtttgaggaaggggtttcaagtgcacagcacatacataattccataaagcaaagaggatatgaatgatcagagacagaagtcttaccttgaaggaccattgaccgtattggaatcgtttcaatctatagtctcatgaaagaagctttatattagtgagcctctttgctttgctaagtacaggagtcctgatctaaaaggcacaactgtggacatgagaatatgtacaatagagttaacactgtgcacatttactatgttaaggatcttaaatactgctgcaatacaaataagtcttcaccagatgcagattactacagtgaaatgacatatgcacattcacaatatgaaagactgcatgcagggcatagtggtaggaaccagatatgccaacacttgttaaacgcaggctagatcctgagctcaaggctagcctgggttatatgctaagttccaggccagcctggaagttaaaaacaggacagatcaaaggtcttcttgattaccaacaaaatgacttgacttagtttggtttctttatccaatgcttaggaagagggacaaatgcagctgtgcacacaacaggcacaaatatgtttacattacaggtggcaatgcctgtaagtcccgcccagcccaggctacataagaggctgttctctcaaaccaccacacggtggggctgtagctctatgacagtgctttactagcgtacacaagactcaaggtttgattccccagcacagcagaaagaccagaacagagaagtggtctcattggttggcacccttgattgtcacccattagggtatgagggtatgggatcttggttactaacagaaggggacttgaacaactgcaattttgcacaattgtgtaagaggcattaagtaatcagcaccctctttacataaagcaagggtagtattaggaccttgagaaaagactcaattcctagtcaggattatccacataaaatgttccagtgcagaggtttttggctgaaataagaaagcatgtgagactagtatacaatatcatgagcaaataaatgtatctccatcagttagaaagatgtgacctggggcgatagcacccatgacagcatgccaacagtatatagtattctaccccctttaatggccaatgccttgaaaattgggactgagcactttaactgtctgataacagacctgtgtttgcccctttgctaaatgcacacagggctggactagctaaagtctaatccaatggacaaaatatttctgacagaattattcagtactcaaggtaatacatgagaaaagacgactgaacactgcttagaaacttgggactgtgactactacagcaatgacagaatggttttctttccttaaaggaaaggagacttgagagatgatacctccatggcaagtctctgatataaaactcttgtttgattggtgtatcttgattaacatgaaggacaagagttctttgtttacttgtccatggacaagtaaagtaggactgtatgcaaagtgaaattccatgactctggaagtcagtatggagggggtatggggtatagatgggctcagtcttataggctgagtgatgggcactgcattttagcaatacgattctatgcattaagtgaaattccatgactctggaactcagtatggagggggtatagatgggctatctcagtcttataggctgagttatgggcactgcattttagcaatagaaatctatacattatgtgaaattccatgactctggaagtcagtatggagggggtagagggtatagatagggatatctcagtcttataggctgagtgatgggcactgcattttagcaataggaccgtatgcaaagtgaaattctatgtctctggaagtcagtatggagggggtatggggtatacatagggatatctcagtcttataggctgagtaatggacactgcattttagcaatacgattctatgcattaagtgaaattccatgaccctagaagtcagtatggagggggtatggggtataaatgggctatctcagtcttataggctgagttatgggcactgcattttagcaataggactgcatgcattaagtgaaactccatgactctggaagtcagtatggagtgggtatagatgggctatctcagtcttataggctgagtgatgggcactgcattttagcaataggactgcatgcattaagtgaaattccatgactctggaagtcagtatggagtgggtatagatgggctatctcagtcttataggctgagtgatgggcactgcattttagcaataggactgcatgcattaagtgaaattccatgactctggaagtcagtatggagggggtatggggtatagatgggctatctcagtcttataggctgagtgatgggcactgcattttagcaataggactgcatgcattaagtgaaattccatgactctggaagtcagtatggagggggtatagatgggctatctcagtcttataggctgagtgatgggcactgcattttagcaataggaccgtatgcaaagtgaaattctatgactctggaagtcagtatggagggagtatggggtatacatagggatatctcagtcttatagactgagtgatggacactgcattttagcaataggaccgtatgcaaagtgaaattctatgactctggaagtcagtatggagggagtatggggtatacatagggatatctcagtcttatagactgagtgatggacactgcattttagcaatacgattctatgtattaagtgaaattccatgaccctagaagtcagtatggagggggtatggggtataaatgggctatctcagtcttataggctgagttatgggcactgcattttagcaataggactgcatgcattaagtgaaactccatgactctgtaagtcagtatggagggggtatagatgggctatctcagtcttataggctgagtgatgggcactgcattttagcaatacgattctatgcattaagtgaaattccatgactctagaagtcagtatggagggggtatagatgggctgtctcagtcttataggctgagtgatggacactgcattttagcactgaatcaatgaagattcgaatttctctaagtagaagtgggcttgggataggtctgaaagtatctgggcctggggctaggactgggctggggcagggctggactggattgggttggttgggtggggcaggggcaggggcaggggtaggggctggggctggggctggggcaggggctggggcaggggcaggggctggggctggggcaggggctggggctggggctggggcaggggctggggctgggcctggggctggggcagcaatagcagcagcactatttgctgagtcttgaggagaatctagatgccataaaggcaagaacacacagaaagttgaaatgtaggccttaatattactattataacagtaagtctgatagaggacacagagcattacaattcaaggctcttgctgacaagtaaaaccattagtcaatatagcatcaacaatagcaacaaaagcaaagcctgaactggtatagaacctcaaatactcctgacatccagtcataatgttcactttacattaacagtatctgtgttataagacttaaaaatttgaagagtagctcggtggatgagtttgaaagaaagtacatttaagtgccaagtaatttgagtatcatctgccaaaaaaattattgaaaactttaaggactccaaagtaacaattcactaaaggtaattaaaatgaattcaacaagtaagcaaatcgtaaatacattttgaaaacaatcacttcggttttaaattcaaacactagcaaagcacactatcagacgtgtcgttggcatccaaaatattcattgaaatcaaaatgcaaccccagcaatagtcatggggtagattttggaagaaggtaggattctacctcttcaccagtgatttgtgatccactatgactctggccaaagtcaccacttatacccagtaggcttagagaaccgcttgagatcagtgctggctaaatcagaggccaaggtgtaagtagactagccactgaacaatacaaaggaatggaacgggctgagttttagtttgcaccgccacgtatagagcactgtaagagactatgaacgcaagcggatgagtcaaatgtccttgaaatggccttagatacttttctttcttttaataggtgaggtttcaatgatttacatcgaccaagaacccgcagcctcggtctctcgaatcggatccgacatcatccaacacttcagtgttagaattgcaagcatgcgctctcccgacctgggcaggcacttcgaaaaaatgatgactaaagacacacgtgaagtaccaagcgaaactcacgtccttatgggacagtgactcatcacagtctaattccatcctggccaccaagcaataatgcacatttctaactggaagtcaagcaaacaccaacactttcacacttgtgcccatttctgacgagttacgtcaagtggcaaccaacacttccacttagccttgcctcagcttcgagtggcacaaggtaggaccaaccacaccctaccataatgcaccaagtgtaccctcgggcaaagcccgccaagtagctaaagcccgccaaaaaaaaaatcactgaaagaaaccactagagggcaggtcacatgacttccgccatcttagacacattcaagagcatgtgccacctctccaggctaactcagacatgaagctgacatgtgacacacaaagccctttgcgttataccgcaccaagaacttgagccgccatcttttcctgtacgacctaaatgtcctataatccattgctacacaccagaacaaagattgggctgtcgagcctcgggtggagcccccgagccgccattttatagacttctgagcagcccttaaagccacgggggaccgcgccaggggtccatatgcacacacaccctgcccaatccccacacccacgctgagccctatcccctagtcctctgcggcttccgcgcaacaccgcacactaatacgagcactccttggctttctacttccggctagcacaaccccgcaaatgctaccacaaatcaaggcgaatcccgcaaccccgcacatataaagaaagcctttagctagcgcagcgcaattggttgcttttatccagtccgctgtgctcctcggtgtcctaattcttggcgtaactggctcgagaatagccgtatcacgcagaagccataatggcggacgcgggctctccacgccctgaacacccactcagtttaagagcaaagtcgtttttctaagccataggttcactcacacagcaccaaacgatcagcagcaacagtacacgcaaataagaggcatagatattccaggtagtgcaataactcacaaaaccatatttccatccaccaagcgccccgttgggccgtgaaaaaaaaaatttaaagcaggtatccacagccccgatgggcaaaagaaaaagaaaaaaaaataataacagcaggtatccgaggccccgttgggcatgggaaaaaaagactaaacgcaggtatccgaggtcccgatggaccgagaaaggtttttttgtttttttttttttttttacaaaaagcaggtatccatggccccgatgggctaaggagaagaaaaaaagaataaaagcaggtatccacagcccagatgggcaagtttagaaaaaaaaataataagaaaaaaaaagaatgaaaaggcaggtaagtatccaaaaccccgttgggcatggaatggcggggaggacacacaggtatccgtggccccgatgggcaagaatatataaacaatgaaagaaaggtaagtccaccatacacacacaagtatcaaccaaaaggcacaacaaagaaatattccttaaaaatgaaaaattgactgaaaatattacaaatatcaaaaagtatggaggacatgtcaaaaaaaaaatcttaccagaacatatcaaaacgtcaaaaatctcgtggaattttgatatgttttcttaaataagccataaggcttggtggtaggggaactaaaaatgttcccccaaagctccttagatggagagaaaccacggaagaaccgcacatccacgggaaacgagcaaacatggctggagcaagccgttgcacgcctttaactgatccgcggcgctgaaggcggagagaccagaagaggagtggccacaaagattgcaattctgacatcttattggacctttaggtctaactatattataaaaaaattaaaatgaataaagatggaggtacgtaagctcagtgacatgacgcgtgaatttcattattttgcgcgataatgaaggattatcctattttacagctaaaaacgtttatgtagaacttccacataaacattaaataatgtacattaggtcacacacctgtctatgcaaaatttcaatatatcttctacttggacaaaccatgtatcgctccgcgtcttggacactagaagttcttctgcattagttggcgacctcagatgaggagaggaaagggtagaaatgcctcacaaaatggctccttggttcctaaattatcagagtattagttgtgaccgatttggtgggcttacgctcatagttttgggtcattggcatcttagtctttctctgggaacctggtgactccataccttgggacaaaaacgcactgaagtacgttactcgctagcagtaatgaaaaataattcctaaatgccaaagcaaagcctgagggaataatagctcattggtatcttactcgccccagagacactgctaacttaaaagaactgtcaaattttgttaactgtcaaactatgaatatccacatgaaagagatcagacaccctgggtattagaaaatcaaaggatattgttgtctcgttgattcacgctgacaaataattcacagtctgttctaagttccctttaggcgtcccatgaataataaaggacacaaaattggtttgcttatggacgatcaaagtgccagcaattcactaatcttactattgaggtggttcaggtagggatggaaaaatatctgctacaaaataaactgtttcaacaaaagaaaaacaaattaacaagtaaataaatgatgcacacagactgaataaaccagcaggtggcagcatgaatctttccaaggcatctgaagccaaacttggagtgcaaaaggattcctatctgaattgagaagtaaaggttactttgtctaactttagttgacagagcgatcaggatcagagtaacaagcacaccaaaagcatcaccagtgagaagtcacataggacatattagggaaaaaagacccaaggaagggctcttcacagctaagagcacctggctccacgatggatatggctttgtataaacgagaacttctaaatgagctgtacaaagagaatttagaacttgcgaggtactggtcacagattatgcaagccagtgtatcatttttgtggggatgctagagagaatcatcaaattaaagagttaaatttagtctctgtgttttacttagtcccaattcttgcaaacctcatcattctttctcacaccgtgtacatcaaggtatgtcaggtttcggggacactttttagtcttatcacaagaaagcatgaagggatatgtgctaaaactcagttcctgggctggagagatagctcagtggttaggagtgctgactgctcttccagagggcctgagttcaattctcaacaacttcgtagtggctcacagtcatctgtagtgggatccgatatctaacctcttctgatgtatctgaacagtgaccgacagtgtactcacattaaataaatatttttctaaaaaacacctcca

SEQ ID NO: 314 - DNA, 409979 bp, Mus musculus
cggcggcgcgcggcacggcaggaacatggcgcgcgggagcggtgcgcgcgcctagctggcgggaccgttagctctaggcagacgccgacgggccccgcggggatggaacagccgccgcctctggcgcccgagccggcctcggcgcggagccgcaggcggcgggagccggagtctccgccggcgccggtgagtgtgagcggggcgcgggccgggagactttctttgtgaaactctgtcggtgcgagccgggccgggcctcggcggccgacgatgacctgcaggcggaggcccctccgctcgtcagggttcgagccccgcagcgaatcattaggcagaccctgtgcatcatctgcctgcctgcctcagtttccacggctgtgtgcttggaatgcactgggcacctaatctcccgcacctcctcttcctcgaccccgccccctcggagcgggacggggctggggtgcggggcgggggcatccgagtccaccggggcggctgggaggctcgggggtccccatcccaggtgtggttgctagggagtgggcttttggtccctagaaggctacaaggttgttggtgtctcaccacaagcaggtactggagagctttaggtctacctgggcttccaagtgtttgggtgtgtctctcagagtgagggatgctgagcaaaatggactttttcctggctggagtagtgtagtctttctccctctactctgtggtgtgttttcaagccactaactagccggggtataaagtaataatctggagccacatactgcaccaagagacacacgcacaaagtggtttcccaaggcagagaaggaaaatttgaatttttagcaagttttcaaagctgtgactgggggtgggatggggggcggtgtctggcgagctgtaaagtgtcccataagcagacaactttccctgcatggtacctagtatgtagtagatgttcagtatgtatttgtaggactgaatgatcctggggttgcaatttaggagcccttgagacacttaagatgtcatttgagataaacatctgtcagtcttaacttcatatgatttttctcagcacccgggttaacttttgtcgctatttataatgtgatattcccagtgtactttagtaaaaaagaacaaggtatatgttgattagggtcagctagtatcctggcagggtataaagggtcagctctgtatatcgattaaattctgagggtcagggagatagatagacgtctcagtgggtaaaggggtctgctaccatgcctgagcacccgggttggattcctgggactcacacagtaggatagactggactctggcaagttgtcctttgacctccctgccaggtgcaaaaaagcacacacacacacacacacacacacacacacacacacacacacatacacacacaataaaataaaataaaataattaaatctgaattttaaaaatgtactatttccttatcttcatttaagaacattattattctagtattttgtttttcgaggtaaacagttacattttcccttaaaaatttaaaagtatttttatgtaaatgagtgttttgtttacatggatgtgcgtgtagcagaggtgaaaaggacatcggatcccatctggagttacatatggttatgagcctcgaaatggttgctgagagctgaaccctggccctttgcaagagcagctagtgctttgacccccgagtcatctcgtctctaatatttacatttccatcatgcaaatctggattattatttattcaagaaagttggcagttgctcttttgtatgtttttttttcccaatacaattgtttgaggttatggattttttccccttcatgttgttgaatttcatttaattgatttcacttcagtagggtctttcagtaaatagagaattcaagtataagaaaggaccgtgagcctggcagtggtggcgcacgcctttaatcccagcacttgggaggcagaggcaggcggatttctgagttcgtggccagcctggtcttggggaaaaaaaaaaaaaaagaagaagaagaaagaccatgagaggtgagattgagtctggaggagaaaaacataaggtcaagggtgtcatctccaggtgcgttgttttataacttgggatattttcttttctctttcttttttaaattgtctttaggggttgaggaaatggctcagtgggtaaagtgctttctatgcaagcagaggagctccattccgctgctcccacctgaggctgggccaggtggcggggacctgtaaccccagagctgggaatgtggaggtggaggtaggtggatccctggtgctcactggccagctggcctgtccaaaacagtgggctttgggtttagtgagaaagccgggcagtggtggcacacacctttagtcccagcattcaggaggaagaggcaggcagatctttatgagtttaaggctagtctggtctacatagagttccaagacagcaggactgttgttacacagagagatcctatctcaaaaaaataccaaccaaccaccaccaccaccaccaccaccaccaccaccaccaccaccaccaaaactcccaaaccaaccttaaaaacatataaaaaaaataaaaaagctttattccctgtgagtgtggtggtactcgcctttaatccctgtatttgggagggtgggggtaagaggatttgagggcggcctggcctacatagtgagacctgtctttaaaacaataacaacaaaacaaacagaaaagctttattcacgacctgtacgtctacagcacaagacctgcatgcagggctcagggaacattgtggagggtagggacataaagattgtaagagcccaccaggcggtggtggcacacgcctttaatcccagcacttgggaggcagaggcaggtggatttctgagttcgaggccagcctggtctacagagtgagttccaggacagccagggctatacagagaaactctgtctaaaaacaaacaaacaaacaaacaaaaaatgattgtaagagcccaaggaaaaacagtgtgtgttgtgagactctgttcccaatatggttgcagaaacatgacctgaacatgcatgacacagatggtcatacggaagaggaaaagcccaggaagcctcaatcctagacagagaattgcaggaagagcagggaatgctgggagctagggaaggagatctttgatagggacaaacactcagattggttacctaataccaaatggtcagccctgaaaacatccctgtaaggaacatagtaaggactgagcagttgtagttatgtgtttaggaaaaagaaataaatatattacatttcacatgtgcacacatgcacacatctattacattatacacacacatatatgacattacacacatatacacaattacattacacacatacacacatatattacacacatatatattacattacacgcacatacacacacatttatattacattatatacacatgcgtatatatgtatttacatacacacatacatgaatatgacaacaaatgatgaaaagaggccacggattgaaaatcagcaaggacagggatatgtgggagggttggaaggaggaagggaggtggggggggcatgctctaattattttataatgtaaaaaaattggggctggagagatggctcagaggttaagagcatggactgctcttccagaggtcctgagttcaattcccagcaaccatatggtagctcacaaccatctgtaatgggatccaatgccctcttctggtgtgtactcacataataaaataaatagatacatctttacaaaaattaaaaatatttttaaaagcttattgaaaaaataaaattttgacagcagcaccaagtacatgaactaactgttgaatagataatgttgagcactcatacacataaaaaaaataaagaaaatatttttaaaagatttatttatttattttatgtatgtaagtatactgtaagggcatcagatctcattacagatggttgtgagccaccatgctgggatttgaactcaggacctttggaagagcagtcagtgctcttacccactaagccatctcgccagcccaagaaaatactttttaaaaatctttcaaaactaaaagttcccaattgagccaggcatagcgatttatgcctacagtcccatcttttgggagactgaggcaggagaattactgtgaatttgaggccagctaggtcaaagtgaggccctgtaaaatgagaaagactgagctgaagggatggctgtgatttaagagctcttgccaatcttcggaggacttatgtttgcttcccagtactcacactgggtgctgcacaactgtgtataagtctactttcaggggggctgatactctcttttggtttccattatatctatgttgtatgcatacttacacacacacaatgaacaaatgtatttttttaaagatttatttaattattatatgtaagtacactgtagctgtcttcagacactccagaagagggcatcagatctcattacagatggttgtgagccaccatgtggttgctgggatttgaactccagacctttggaagagcagtcaggtgctcttaaccactgagccatctcaccagcccacaaatgtattttaaaaagagaaaacaaagtataaaactaatagagccttagtttattcatatgtcctcctctctagagataggtctcattgccctagactgtacttgagcttgctgtgtagctaagggtagtgcccttggacctctcgttttcttgcctctgcttcccaactgctcaggtgacaggcctgggccaccatatagagctgggatcaaaaccatggcttcattgatcaactgagttacatctttggcaccatatgatactttttttaaaaatttttttttgagacagggtttctctgtgtagccttggctgtcctggaactcactatgtagaccaggctcgcctcaaactcagaaacccgcctgcctctgccttccgagtgctgggattaaaggcgtgcaccaccactgcttggctgtatgatacttttatgtgaatttgaaaaatgacttcttttgtaccataggaataatttggtatcaggctaaaaagatgttcaagttcagttcccagcacctgaatggcagctaacagctttctgtgttttcaattctagagtatccagtgccctattctggcctcctgggcactacatacattctgcacagttgtatatacccatatacataaaataaattaaaaaaggaataacttggtatggtgaatgtgacttcatgtgatttagaaaataattgctaagaggtaaaggcaacgtgtttgtgtgtatctatagacgtgtgtatatgtacgtgtgcatgtgtgtgtatatgtatatctgtgatgtgtgtatatgtatgtgtgcatgtgttcatgtgtgtgggtgtgtttgtgtgtgtgtgtatgtgtaggttgtttgtgcctgtgtgtgtgtaggccagaggttggtgtttggtagctttcttgctttttatttttatttatttatattgagacaggttgttttagtcagtttcatggctctgaagagacaccatgaccacgccaactcttataaaagaaagcatttaattggagcttgcttacagtttcacaggtaaactaatccaataatcaattagtccattattacatggtggggagcatggtggcacataggaagacattgtgttggagaagtagctgagagttctacatctatatccaaaggtagcaggaagggagagcccacccccagggacacagcaccttcaacaaggccacacctcctaatcctttcaaatcatgccactccctgaagaccatgcattcgtatctctgagcctcacagggtctctctacatagctttggctgtaatggaactcattctttggatcaggctctactcaaactcagcagcctctgcctcctgagtgctaagataaaggcctgtgccagcatgtcagactattttctgaagcacagtcgctcactgaatgtggagctttagttttggctaggccactctccacagagctggccatccctagcttttatgtgggttttggggaccttaactctggtcctgagccatgtctccagccccatgaaaggctatttttaaacttctctttgtgttctcttagaaagtaaaccagttatgcaacttaatatatgactaccctgataaatggaggcatggatgaatgtacaaatgcagacctttaacaccagtactcaagagacagaggcaggtgggtctctagtgaatttgacaacaacctggtctatccagcacattcagaccagccagtgctatgcaatgagacccagtgtcaaaataaagtaagtatgaggctggagggagagatggcttagaggttaagagcactgactgctcttccagaggtcctgagtttaattcccagtaaccacatagtgggtcacaatcatctgtaatgggatctgatgccctcttctggtgtgtctgacgacagctacagtatatatatatatatatatatatatatatatatatatataatcttttttaaaaagtaagctatgttttatttttagaatgattttcagactttttcatatttgtaaaaaaaccaggtgcctgtatatattaaactatcagtataagtgagaagttttctttttaaaagcatttaagtatttttacttaatttatttattattaagtggattcttttttgtcccttctgtggggattctgccaacttatgtctatcccgaatttacattatgagctggggaaataagctccggatgagctcagggaccagtagacccaccgttgaaacttggttgcagacctactgttgcaacattgttgcaagcagtccgattgcctgatccccttgagcccttacctgaactggagggccactgtgttcttttctggtcttctgatctaataggctttggtaggtctggttgtttccctcatcatttaccctagtaacaagatgttggtcccttagggaaactgtaaagggggttctggtctcaggatcaccaagttagtccctggtgtggacaagtaactgaattatctgggaaagatgcagaccaagctggagagggagagataattgattatctgggaaagatgaaagaccaagctggagagagaaagagaataataccattatcccttctgaataggagggacctgaggctaaactgaggttggtttgaatattttataggacccgttcctccttcccttcctcctattggctttgtttagatacccacttctcatgtcttcctctttttcccaaaatgtcttctgaaacaagaagctggtatctcaggaagcccacttttactttgcctgtttatggccctctgactctcctttagaggagtgggagaaatgctgacagtaaaactcttcagtatttagcaaggcccttcctcaaagggacctggccttcccttctataaactggcacaagtctggaaactggttgacagtcctggattccttattactatgatctgatgcagcctttctttcacttctagttttgtgcttttctgtttatacagatcaatacaaatgtattagttttcttatctattttgttaacagaaacactgtggttggttaaccagtagtaccaaaggcccctacatgtcaggccattatacatattgcctctgctgtccattatgaattgaaccacgatagtatggctttcccggtactgctcatggaactgtgctcacatgcctttggtaattcggtgctgtctgtctggcccgttacctgtggtggtttgaataggtttggtccccatagatttatgtgtttgaatgcttggctcatagggagtggcattattaggaggtatggacttgctggatggagtaggtgaggtcttgttggaggaagtgtgccactgtgggggtggactttaagttctcttatgcttaaactctgcccagcaccactgtctgcatgcatgctgacattcttcttgccatcatgataatggactgaacctatgaaactgtaaggcagctccaatgaagtgtttgcttttataagagttaccttggtcatggtgtctcttcacagcagtaaaaacctaactaagatactaccctagggcacaaacctagggtagtatacatttaattcattcagttgagtagcagcatctctgactcttaagatctggcacagatgacagagttcttcaaacgtgctggtgttcctcagtgttttacatcttagagcattagggaagggcatgcttcctggacatactcactgtggaggattgggttttacagtgtatctgctcaacattccaattcccccgaatcttaaaatccctcatcaacacaaggtgaagggatattaggcctctctagttctttcttagtaggccatcttttgacacatacttcagctgacaaaccaaacaaacttttggctaaacttccggcactttataaaaaaaaaaaaaaacatgcaaacttcatattaaacctagagtctccactcagtgggcccctgtcgattctaccattataccctgaaaatttagctccagacttctccttgaatgaataaatgaatattattaagttctttagtgatgtagtttaagtctttttgtatcacacttcctatcccacctctaagagcctgctcagcctcacgtctgggtggacactgattcccttaggcaaagctggagagggcagtgctgctgtggctggagatggaggtgcatcctctgctaaataagcccttccgagtctcagtccaaatttctccacctgttaaggtctccgcagacatttctatcctgggtctctggcccattgctgttgcctctactaaacaaaggagcgaaccaaaactagagtgggtccctggagagattacagggcttagtgtcatcatcaagggcttaaagtggttcttagcacatttccctttaactctttcatttggcctgtgcagaagacagatggatcatgacagttgactgttgaaaacataatcaggtagtggactccagactgtagctgctgtactggacgtgcttgagcaggttagcacatctcctggtacacggcctgcagttactgatgtagcctttctgtccagatttgtcagtaaggaccacagaagccatctgctttcagctggtgaggctcaaattacacatttattgttttacatcaagggatattaattctccagccccatgttgtgacttattttgaagggatcttgaccatctgtctcttctacaaaatgtctttgtatcccattgtattgatacattgtgttgattgaatcaactgatcagggagtagtgacatagaagaaaataaagcaatagaattgacattataaaagatctgttaatagattggccttggagacattaaatcacacaaagtacaatttagctaagtgggcactgtcttccaaataccccaaagataagtagtatgcttgcattagttaggtttccattgctgtgaagaaacactatgaccaaggcaacttttataaaggacaacatttaattgggactggcttataggttcagaggttcagttcattatcatcatggcaagaagcatggcagcatttagacaggaatgacactggaggagctgagagttctacatcttgttccaaaggcaaacaggagaagactggcttccaggcagctagaaggaaggtctctcaaagcccccacagtgacacacttcgttcaatgaggccacacttcctaatatggaccaagcatattcaagccaccacaatgctaataagccctattttggataaataaatttacagtgctactaaaatttaagtgtttgttcaccaaggttgtccagccattagactcattcccaaagaccatgcctctgacatggttaagggggcagtgcagggctacagtcagtgtgaagtcctggtctgacataaagcccccagttcctttcttgggaaaaacataattctgccagaatatatgttagtaaaaattcctatctgaggccaacttacttgggcatcagttccagttgtcctgtgatttagtgaagagcttctccttccttcacctccaagtatatgaagtgacttcctcctcactgggaaatagcagccattttggacttcttggtaatgcatatgcagatcagaggtgtggttagagtactaatggccctcatagcctcacagatttgaatgcttggtcaccaggaagtgccactattaggaagtacagccttgttggaagacatatgtcattgggggtgggttttttcaaatgctcaagccaggtgtagtgtttctctctgctgccttttgatctggatgtagaactccgtctccagcaccacacctgtctgcccaaagctgccatgcttttcaccatggagaaaatggactaaacctctgaacctgcgagttccaataaaatgttttcctttataagaatggccacagttctggtgtcaggataggaaataaatgtaactaaaactcaagtgccatctgcctcagtgaaatgtgtccagtggtgtggggtgtgtagagatattccttctatggtgcaggataagctattgcaccttgtcctgcctactaccatgggaaaaaagcacaatgcttattggtgctgtttggaaatcctcacttgggatgttagccatatatcagggactcagaaagctgctagctttgaatggaacaggagaggctcttcagcaggttcaggctgccgtgtaggctgttctaccgtgtgggcccatgatccaggagacctgatggcatttgacagacatggcagtggcagataagtctgactggagtctttggcaggtccctgtatcacagtgcagtggagcaagcttggcatcgccatcaatgtcagatggctgttttcttgttgagggcagaatttcaggcagtgcatataagttgtacattctgcttgaaaggagaaatggccagatgtgtggttatttactgacttgtgggctatagccaatgatttggctatggtcagggacttggaaagaacatgattggaatttggtgaacaagacttttggagaagaattatgtatctagatctctccagatgggcaaaggatatgaaggtactcatgtcccaggtcattgaaatgtgacttcagcagaggaggagttcagtaatcaggaagataggataacatgttctgtggacaagcagcccataaacaaagtggccatggtggcagtaatgaaggttatggatgggctcaacaacacgggctctcactcaccaatgctgatatggccacagctgcttagcaccaggtctgcctgcagcagaggccagcactggcctctaatatggcaccattcctaggggttgagtagccagtaacctggtggcagattgattacattgaggcacttcctttgtggaaaggaagacgttaagttgttcttatttgcagatgtctctatatccatgactaacaaagactaaatgagttttgacctgatgaatctgttcagtcagttatcaggatacaaggttggcctacaataaacagtagcatttctgtataccaatcatgaactagctaaaacagaaaccagggaaacaattatatccacagaaccctcaaaaaagaaaagaaaaatggaaaaataataaaggaaagaaagaataacctagtctgagtctatcctagccaaagaagcaaaagggcctctagagaaaattataagcgtgaagaaagaagttgtggaagacactgtaagatcaagagtcatgactgacagagtaaatattatcaaaatggccatgtaaactgtatccgtcattttcctgtggaaaaaaaacaacaacaccatgactaaggcaacttacagaaagtttattttggctatggttccaaagaaagaagagtccatctgtcagggttggggtggcagcaggcacggggactgcagcaggatgctgaacgcttgcatcataagcacaaagcagggcaagagagaatgctcgaaatggcttgagactctgagaccgcaaaggctgcctgcagtgacatgctggactgcctaggtgttcccaagtaatgcaaccaatggaggacccagggttcacacacgtgatcctacaggggccattcccatccaagccaccacgttccactccttggtcctcacaggttcctagccaaatcatactgaaaaacgcatttagtttgaagtttccatagtttctattgtttttcatagtttcaacactggttaaattcacttctgtgtttccatgacatctcttaattgtaaccttctataaaataggagaagcacatacttccaaaatacaatagcatgcagggtgtggtggcgcacacctctcatctcagtgccctggaagtagaggcaggaagatcttccgaaagtcaagtccagtttgttctacaaagagagtttcatgccagccaagattagagagaccgtatctgaagaaaaccagccctgcttcctgcttctctatctgtcctcttactatgggaacctgcctggtcctgagtataagaccactggtggccaccatacctgccaaggtttgcacgtgggttttagagatcccaactcagtcttgatgctttcatgaccagagtgttagccactgagctgtcttctcagctgaatgtctgttgcaggtactgttggctgtttcaaggaaagcatatggtttagaaggacaagagttagcttagagaagcagcattgcttaaccccaggttcaggagaccttgcctcagtgagtaaagaggagagagatcaaggaagatgcccaacatcaactccaggcctcaggcatctgtgttggaacttacgacaatttctctgtttgtagattcctctctttggtgctaggactgttgtccagagaagccctgacgagccagcactgagcaaagctgagtttgttgagaaagttcgtcagagtaaccaggcctgtcatgatggagacttccacacagctatcgtgctgtacaatgaagccctggcagttgaccctcagaactgcattttgtatagcaacagatctgcagcctacatgaaaacccagcagtaccacaaggcgctggacgatgccatcaaagcccggctcctcaaccccaagtggccaaaggtagcatttattcactttcacagcagtgcctgtgtgattccttactttagggtagcatttcattgactcaatacagatatgcattcatagacttggtaccttggcaaaatctacagtgagtgaaactcagcagccatcttcctttttagtggggtgtaagcgtgctttctgtccacagctccttcttttccttcttgatgaggtacaggatccattcaggttttagacacctttttttttttttcatacaaaagttttagatgtaatatagtgattgtatgtatctccttaaatttaaaatgaactaatttaccaggtggtggtggcgcacaccttcaatctcagcatttgggaggcagaggcaagtggatctctgtgaggagtttgagtcatcctggtctacagagttaagttctggggcagccagggctacacaggaaaacccagtctcaaaacccccaaaacaaaactagtttatttccacaagtacctgcttattttaagaatgttctttagtcagggaagtcttatctaaaaataaatcataattaattatattcccttgagtcctgcctgttgcaaacattatatatacagattgatttagctagggtgttactctgtgagcagacaccatgaccaaggcaactcttttgttctttgtttttgttttgtttttttgagacagggtttctctgtaggcctggctgtcctggaactcactttgtagaccaggctggccttgaactcagaaatccgcctgcctctgcctccggagggctgggattaaaggcatgcgccaccacgcccaaggcaactcttataacagcatttacttggggctgacttacacgttcagaggttcagtccattatcatcaaatcgggaacatggcagcatccaggcaggcatggtgcaggagttgctgagagttctacatcttcatctgaaggctgctagaagaagactggcttccaggcagctaggatgaggggcttaaagcccacacccacagggccacacccactctaacagggccacgcctccaccaccaaggccaagcctcctccaacaagtctacacctcctaatagtgggccaagcatatagaaaccatcacacatatatgtatgtataaatcataattgaaaataacttgagtgaaggattaataagctgggaatggtagtgtacacaccacccagcatccaggaggccaaggatcataagtttaaggcaagtgctttagttaagacaaaacttaatatgcattcaaaacaggtaacctaccacacatcatagttagtctgcctttgatgtgctcaatgcattcaggctggtttagaccacacaagctgggtgtggtcctcctgcttggaactgtagcatcagaaggaagacttcaggtctgaggcgagcctggctttgatagaaagttctttaagatagcctgggctgcatggctggcccgtgttagaaacaaccagtggtgccacttctggagagatgtggcaatgccgggtgaaggctgctgagtgcagcacctggagagcatggagcctcaaggtcattgttgcacatctctttcacgaatggggcaagggacacacatatccgactgaagtcagtccctgacattcccaccaatttcattaaaagttgagctatgcagtttagaggatcaccttcttctcaggtggtttgaaatcaaagcagcaaatcagacacgaaagagaaagcatccaggaaagaggattgttcggagttgccagctggtagcccaccgaggaagaaactctggggatgtgcacatctcctcctgcctgatcctggcctcaggacgcagtgatgggaacacccatacttaggcggtgctaagagggtgcctacttttgaatctttctagatacacatttatatggaagtccttttaggagtcagttctctctttcccctggttgagataggggctcactttctgtggtgttggtgttgggtatgctaggctgcctagctcatgggcttctggtgattctcctgcctctgcctctcaacgtgctgtaggattgctgggatttcagcagggatacccagcagggatgagggcaagagggcttctctgtggctgaatagatgatgcctcctcagctttagtctcctctggagcgtgtgcgtgctcacacacacgtacacactcacacagacacacactcacatgcacactcacacacatacacacactcacacacattcatacacatacactcacacatacacacactcacacacacatgcacactcacacatacatacacacacagacacacattgacacacatatactcacacatacacacacacatacacacactcatgtacacatacacatgcacactcacacatatacacacacatacacacacatacacacgctcatacacatacacacactcatacacatacacacactcatacacatacactcacacatacacacactcatacacatacactcatacatacacacactcaaacatacacacacacatacacacatgcacacacatacactcatacatacactcaaacatacacacactcacacacatgcacactcacacacatacacacatgcacacacatacacacactcacacacacagacacactcacacaatacacacatgcacacacacacactcacatacacacacacacacacacacacacacacacacacacactcacacacacaaaaacatgcacactcactagcagatagcacaagtgattcctgtatacttttcacctgcatctcctgcttttaacattttaccatatttggctgatagttctcttcctgactatatcatttttactattattttttgaaccatttgagactaaattgaagacagattgtcttaccacttctaaacccttcagaatatattgcgaataattctgctctataaccacaatgtaaccactaaaccagaacattaatattaatgtgataatgctgtccagtccatacaccccattcacaactcactgatggctcaagtaatggcctttgtggaaataatttattttttggcccaagatctaccatttggaaagaactgtatcagattctatactataattgagtatagtctcagacctatagcacctacccacattctaagtaacttacttggcgtactagatttggttggctagttacttttctactactgcgaaggcatcctgaccaaggcaacttaaaaaagaaggcatttaattattggaactggggatctgcttacagttttagagcataagtccatgaacatctcctaatcccacctggagagaataagaacactaccatgatttttgggccaaatttgaagcaagctgtattacatactagccaggaaggtggacactggccaggtccataccccggattgctagagaatggtagcaaattacgttaggcaggcgcttttaaaggcaaaacctacaaggcttcgcacacaccctgaccttcttcctgcccaggtaccttccacctaaatgtgtacatcctgtggagtcggggaaaccaaccttgttatagaagtcaaaacacatagtttgttacctcatatgagcagctcccagcattccaggaagttatctgtccttgggcaagtgggcttacaggttagaggcctttttgttttatatagctcacttatgcatagtaattaaaacttaaaacataactttaaccctcatacatcatgtctgggagcatacaataggcaggcaggcatgactttgtgcagtagctgggaccttagatctgatccacagcaggaggcattctaatgtatgagcctttgggggacattgtcttttaagccaccacagtttctaaatttgcctaagaagttagaccaaggaggctgcacgctaattacaatctcatgcatgtgtacactcacctttctaaaacacccaaagtctcttgacttgggttttgtaaaataaatcacttgttttcttactccagaggcaagaaacagaatacaaatcaccatcaaagtagaaccaacagttcagtgttggctgctgagggcttgggaagccgcaggtctgggctctgcccttcacaggctcagactggctgtgcacagcagctgctgccaccttcggtagtcatcccatggcactgcacttacagttacagtctctactgcagtggggctgcgctgtcaccaatagcttctgctggctctccttgggaaccctaatcctgctacacagtgccaaccctcgatttttctctatgcaacatcaccaaagcctctcttggttccaagcctcagctgttctctttgacttcaaaccctggaccacctaggagactcctacacctttcaagttgaatgcaaagtattgcccctttctgttctgcggcttctgtgtgccgaccctgaggaaacacttcccagaagattatgtatgcctcagtgatctctccctcctttcccctccccctccctccctcctcttccctttcttttttttttgagacagggtttctctgtgtagccctcgttatccaggctggtttcaaacttgtagagatggcttgcctctgcctcctgagtgccctgcttgattctggccttttcttactcacagctgcttgattattcagccccagctgacaagaaccatagctactccattcgaaatatcaagtggtctcgataaaatgttttaagggattctaaactttaccattgaaacttcaaaagctaggcctccatgtcagcaccagtctgcacaatagcttctaaagctctgagcactagattgcatttctagaccaaattttcagtaccctttttaattctcccccaaactagcaatatctcatgaacctggtaccataattgagtttatagaaacatttccatttatgtgaaaatgtgcttttaaaaaaatctttcttgtggaagcaaaagtgaattagaaattgtaagtaaaatctaacttttatttacacttgatttttttcatgatgtccctttataaagtgattttgtaaatgaaaataattttgaaatgctgtacagggagaaagggaagggagctgattacatattagggtggatacagaagtaagcattgtgacggatcgctaggcaacaggctgtggggatgtagcatttctcatttgtgtcgtcatgtaaccacggtggagcctgagctgggtttcttgttaatcaagtccatctgttggtccaggaacacactttcctcagggtactgggttgcgtttccctcgttcctacagtgtcttaaactgctactgacatactccctgaagtggactgctggacacagccctgaaaccttcagaacaaagaacgtgacatgacagcattaaggtttcaagttttttttttttttttttaataaatagaactcttgtttttaatttgatgagcaggaactttccaactctaaccctctctttacaatctgtttttaatttgcaaaaaaaaaaaattagtggtgcaattttgagacataaaattgtttaatgtacacacacacacacacacacacacacatatattaggttttttcattctctagtcgtattatccccaaattcaacatattatttcagagatttcactgctttttttatttgtagctacttcattttccactttcattgcccattcatcagttagttgatgtacgttgttctagttagggttgctattgctgtgacgaaacactgtgaccaaagcaagttgtacaggagggggtttattcggcttacacttcatctcactgttcatcattgaaggaagtcaggacaggcactctgtcagggcaggaacctggaggcagcagctgatgcagaggccatggaggggtgctgcttactggcttgttccccatgacttcttagcctgctttcttatagaatccaggaccaccagcccagggttgccccatccacaatgggctgggcccgccaccatcagtcacaaattaagaaagtgcctcatttgttatagaggcatttcctaaattgatggtctctcctttcagataactctagcttgtgtctagttggcataaaacatgccagtacaggcatctaggctgtttcccaatttctgggtcaagacagaaatcaagaagggaattacattttttttttttaaaaaagaactgagtgaaaattgaaatatagttatacccaaatctatgggacacaatgaaggtaaacactgagctcatcgcacagaatgtctgaatgaaaacctggagagactttaaaaagaaaagatttatttatcttatgtatatgagtacactgtagctgtacagatggttgtgagccttcatgtggttgttgggaattgaatttttaggacctctgctcactctggtctatcctgctccctccggttggccccactcgctcaggcccaaagatttatttattattatacataagtacactgctgctgtcttcagacacactagaagagggcatcagatctcagtcccaaagatttatttattattatacataagtacactgttgctgtcttcagacacactagaagagggcatcagatctcattacgggtggttgtcagccaccatgtggttgctgggatttgaactcaggaccttcagaagagcagtcagtgctcttaccctctgagccatctcaccagctatggaaagatcttttaaataacttaatgaaatctttgaaagctatggaaaaagaaatgatacccaaatctaagagtcaatcttggggtgaaatcaatgaaatggaaacaatcaaacacgaatacaaagtatcaatgaaatgaagagtttgttcttagagaaaacaagattgaaagcctttaacaaaaccaatggaaagatacaatgaaaggattcaaactaataaagttatgatgaaaaggaagactgatttaattctgggaattatgaagacataataacataatagtatagactgagttaatttagggagtcataaggacatgttttaaaaatatatattcccacaaacttgaaaacctaaaggaagtggacaaggtattttgctttcttttgttttttaatatatgacctactgaagttaaatcaagatgaaacaaacagtttaaattaatccataacctctatagaaagagaagtggtaattaaaactctcccaaccaagagcagaggtggttcatgtttttaatcccagcacttgggaggcagaggcagatagatctctgtgagtttgaggatagcctcatctgacagccagagctacaaaacaaacaaacaaaagaacaaaaacaaaaaaaatcccaaaaccctgtctacaacaacaacaacaacaactaagcaccaccatcaccaacaaaagtctcccaaccaaaaaaagcccagagccagatgaattagtttagcacagaatctaccagaccttccaagaaatctccttaccttaaaaaaagaaaaacattcaaagacaacaaaatatagtaaaattatagactgatattctttaggaacatagatgcataaattctttttgtttgtttgtttgttttttgtttttcaagacagggtttctctgtatatccttggctgttctggaactcactttgtagaccaggctggcctcgaactcagaaatccacctgcctctgcctcccaagtgcagatgcataaattcttaacaatattcttgcaatctgaatttaatgacacataaagagattatccaccgtgatcaagttgacttcatccatgattcagggattgttcaatgtatgttgatgaataaatgtaattcaccgtataaacagacaggggtgcgtgtgtactgcaacatagtaaaggtgatttatagtagtaactcttagtcaacatcaacataaaatggacagaaacccaaaaatcatttttactttagttaggaacaagagaaggatgttcactctctgtatacctattcagtataatacttggagtcttgactagagcaatagagaattattttatctctgaaaaagaaaacacttatattactttgaaatagaaatgttgtgctttccaaacgtaaaactatctccacgtttataaagttctgtaccctgtgttagcctctccacatttataaaggtctataccctgtgttagcctctccacatttataaagttctgtaccctgtgttagcctctatatcaagtagtggataaataacatatgcatcatacaaatactcaaaccatacaaggataatctgtattgtttagaagcttaggtgtgcatgacctgttagtaagaccatgctgagtaacagacaggtgtgaaaatcatgacaaagtagatgtccatggagcgacacctattgatggataaaattattcagctttgtttattggtatcattctccttgacatttcaaaatttaataattatttgtgatgatttgttttattacatacttgtactagtgatttagattgtaccaaagcaacatgctatttttttttaattcactttactattgcatctatgactcctgatctttttcctaggctttctatctccagggttgtctccctttgtttctatacccatttttagatcctggatggttttgttcaattccttcacctgtttggttgtgttttcctgtaattctttaagggatttttgtgtttcctttttaagggcttccacctgtttaaatgtattctttaagggagttacttatgtccttaatgttctctgtcattatcatgagatgtgattttaaatcagagtcttgcttttctggtgtgttgtggtatctagggctcactgtggtgggagaactgggttctgatgatgccaagtagccttggtttctgttgcttatgtttttgctcttgcctctcaccagctggttatctctggtgttagctggtcttgctgtctctgactgtggcttgtccctcctggaagcctgtatgttgatactcctgggagaccagttcattctgggaggaatttgggtctggagagctgtggcacagggtcagctccagggtgcagacagaaacaggaaggatcctgtcccaggctgctccttgattcctgtgtcctgagggctccaggccggtcccttggagcagaagtggtggtcttacctgtgctcacaggcgtctccgcactcctgggagaccatctttctcccggaggtatttgggtatcgagcactgtggacaattcatgttactcttgagggctttttattactattattattatttcattttttttgttttttcgagacagggtttctctgtgcagtcctggctgtcctagaactcactctgtagaccaggctggccttgaactcagaaatccgcctgcctctgccttccaagtgctgggattaaaggcatgagccaccacgccccacttattattgttttgtttttgtttatttgagatggggtctcattgtatagccctggctgtcccagaactctttatgtagagcaagctggcctggaactcacagagattctcctgtatctgatctgcctcctgagtgttgggattaagggcaagtgcaaccaatcacaacaatggattttcttgatactatttatgagcaaattcctatgttatgatattctgagatatattagaaagatataaagtcattgaatattgagtaacattgattttactttattacattttttaaagatttatttattttatgtatatgagtacactgtagctgtgcagatggttgtgagccttcatgtggttgttgggaactgaatttttaggacctctgctcactctgatcagccccacttgctccagtcaactccattcgctcaggtacactgtagttgtcttcagatgcgccagaagagggcatcagatctcatggttgtgagccaccgtgtggttgctgggatttgaactcaggacttttggaagagcagtcagtactcttacccacttagccatctctccagtcccttactttattttgtataagcagttttcttatttttttcttgaggcagaaagctattgaaaagtcagacaaaaataggatgagactttttagcttaaataatgtttatttttgggctggtgagatggctcagcaggtaagagcactgactgctcttctgaaggttatgagttcaaatcccagcaaccacatggtagctcacaaccatccataatgagatctgatgcccttttctggagtgtctgaagtcagctacagtgtacttacatataataaataaataaatcaaaaaaataataatgcttattttcatttagtctctctctatatgcatatgtacatgtagtctacacatacaatcatatatccatatatacaaacatgtaccttttatagatttttgaaaagaatttggaatagaatctcatgtactccaggcgggccccgaactcactgtgtagcagaaggtccccggaacttctctggtcctcctttttgtatctctcaagcgctgtggtcctggggactgaatccaggcacactagggcagtaatttgctgacagaactacatccctagcctctgtaatatatttttaaactcctggcattttagtattttaagtcagcctttgcagcatttttggaatcagatgtaaaaattaaatctaaggagtcagttatttcttctgcaagggtgacaacatcaattatttaaaaaataactataaacttagttagaggaaagcaaatagatcgagatagaaataatataaaaatattaaatgggactcatgaccaaataaattgtctataacattaaggacatctgttgagggaactaaagaggtagcgttagatgacctggcacctagtacaacctaggggataacatgagacacagccctataataagaaaggccagagccaggcgtggtggtgcacgcctttaatcccagcactcgggaggcagaggcaggcagatttctgagttcaaggccagcctggtctacaaagtgagttccaggacagccagggctatacagagaaactctgtctcaaaaaaccaaaaaaaaaaaaagaaaggccaggctgctgagcccgcatattacctaggatctgtcagagatggagcaggaagtcagtcactgctcctaagtgaacttaatactcccctctctgttttcttatcccctgtgtatggctgactttttggcactgtacattcaaatgatctgtttgatctagatacacattttaaagaaataatataaaacacagggaaagatttctcaaaaagtatttctgttatcaattattgaaatacaatgacaaccccaaacagtgtttatattgcagtaatgagacagataagttgtctcgctgtccacacgaggagtctggctgtttgtgggaaatagagaacacctgttgcagacatgatgtccagagaggaaacaaggaggtcttcctcttcccttctcagctttaggaaaacatgtttttttctcctcctgaaattactgatttcttgtaggatttcatacccaggtattgccaacagtgatggatctgtgtctgagaagtaaccgaatgccacagcaatgtgtacaaaatggtttcagaggttatacttacgtagtgggacaatggaaacccttaagaaattcttcttagtgtttaaaaggactaaacctatcaaatatttcctttattatttataaaaaattaattatgacattttgctggtatccccaacttgtgagatcgcagctgtgtattttgtcttttttgttgtggtgtccttgttgcttagttcatgcctgctgtttagtaagcattcagtaccctgtaactagtcatctacaccatgcctgctgtttagtgagcattcagtaacctgtaactagttatctacactgtgcctgctgtttagtgagcattcagtacctgtaactagttatctacaccatgtctgctgtttagtgagtgttcagtaccctggaactagttatctagatgagtaagttgtacagtgatgtaaagtgtatattctttaggctaaacaatttgagagcaagatcataaagtcctgccccgaatgtcagatcatgtctaactttgtcattctaagtgagtactgggtggaggagaaagaagagaagcagaaactcattcagaaatacaaggaggctatgagcaacaaggcgtgcaggtattttgatgaatgacgtgggagctgcccatttggagggaactgtttttacaagcatgtgtaccctgatggccgtacagaggagccacagagacagaaagtgggaacattaagtagataccgggcccaacaaaggagtcacttctgggagctcattgaggagagagagaacaacccctgtgacaatgaggaagagcaggttgtcacctttgagctgggtgagatgtttatgcttttggctgcaggtagggatgaagacgacgacgaggagctgacagactctgaggatgagtgggacttgtttcactacgagctggaggacttttatgacttggctctatagcagggttgcgtggcgcgggcactggtctgcggagcctcagacagtagctgtcccctgcgctgtgtggcagtgtgtgtgactctcctaggcctctcaaactccaggtgctgtgatcactacccagggcctgttcctctacccttacttttccctcaagagtgttgttttctctgtttcaaatgttacaaaaataaatcttaaagttaaaaaaattccaatttcacttttcacagaaataggaaaaagtaattctaacatttatatggaactacaaaagcccagaatagccaaggcagggttgaataaaaagaacaaagctggatataatacataattctttgttcagactatatgataaagctatggtaattaaaacagcatgttactgacaagactagaaacactaagcaatgggataggaaccctagaggtaaatccatgtgtttacgagtcagttacttttggatgtaggcgccaatcagaaagacagtatcctctgtaaagggtgttgggaagtctgggtagttgtatacaggagagtaacgtgggcctttatctcttttcaagaacaaaatgtataaaaataacaaaaaagaagacgtgacatttggtggggaacattttgagggagtacttgggagagttgtagggagggggagggtatattcaaaatgctttgtatacatatgtatacattctcataggatcaatactaatattttaagatttaaaactcaaaggaattaaatacttaagacctaaaaactataaaagaaagttttttacattggaagaaagaacaatgacatttatctgagacatgattccaaaagacgaggtaacagctatatgagctgcattgtattctaagaggctctgcaatagagacttctccagcccctcacacatgcacacacacacaggcacacacacatgcacacacatagatacaggcacacacacatacacacacacacatgcacacacacacatgcatacacacagacacacccaggcacacacacaggcacacatgcatgcacatacacatgcacacacacacatagacatacagacacatacacacacatatgcatgcacacacacatgcacatacacagacacacatacacaccccagcacacacacaggcacacatgcatacacacacacacatgcacacacacgcacatgcatgtacacagacatacagatgcatacacacacatgcacatacacataggcacatatgcatacatacacatgcacacacccagacacacatacacatccagccacacacataggcacacatgcacacatacatgcacacacatgcatgcacacaggcatacagacacataaacacacatgcacgcacacagacatgcagacacacacacacacatgcacgtacacacaggcacatatgcatacacacacatgcacacacacatacacacatgcaaacacacgcacacaaacagacatacagacacatgcacctatatggtataactatccattctacaactgaaatcccactatacatttagaatgggtggcaatatcccttgggaggtattcttttagtatctcaaacataactgtctaaccactgatgctcccttaattggtgttacattatatgataaagaaattgaggaaagaaagcacaaacatctgtatacattgtttttcccctttattgaacattgattcttctctcatacaatatatcttcattagtttcccttcccaaactcctctcagttgctctacttctcctcccctccagatttaccccctttctgtctccccttagtaaacaaacaaacaaggcttctaagagataacaaccaaacataacaaaataaaatataataagataaagtaaaaattatcataattgaagttgggcatagcaatccaacaggaggaagagttcagcagcaggaggagtcagagccccacttgtgtaggaatcccattaaaaacactcagctaggagctacgttgtatatggagagggcctggtgcagacccatcaaagccctgtgcttgctgcttcagtctctgagtgccttgttttcctggtgtgttatggcaagctcatcctcgcaccagctcttacaatctttctgtcattctgcctcctctgtgggattccctgaactctgcagggaggcattgatgggaacctcccatttagactgtgtgtaatgtctgctgcaggaggaagtttctctgctaatgactgtattaggcagtgatctatgagtgtagcagaatatcactggaatcattatgttgatacttttcattttttaagaccagcagtattttgttttaccctaggtctttggctatctagtctcaggttctttgttacccagcagtgttggatatgggctccttcttgggagtgagtgggtcttaagtcaaatcagaccttggttggctacttccacaagttttgtgcagccattgccctagcatattttgcagtcagggtaaatggtatgtgaagggatttgtggctggttggtgtccatgtttctcttttggtagtttgcagccaaaaagacttgagtgcagaggtggaagcttcatccagtcaccagcttgatgtcttgttcagtgagttgtgtgggtgttgtcctcagtagtgggaccccactgtcagtttgtggagagcaaccctttgtcttagcaacagcctgagttgtttggagatgtgcgtgggaccaccattggaagtctggcctggtgacagtaggtggtcagttgagactctgtgtcccccattactaggaggcctcattaggatcaccttcctatgttccaggatgtctccagtgcactaggcttcctcactaacccccaagggccccaattccagctgtctcttcccatactcttccccgccaccgtaagtccccaacacctgatatcccctgcccttgtccccacccgccccagtcctcctgtaagatctattctattttcccctcctagagagatccatgtatcccccacctagattccccttcttatcctagtctctctgggtctccaggttgagcttgcttatcatttacttactgtctactatcaacttataagcaaatacataccattttatcattctgggtgacctcattcagggtggtttttctagttctagccatttgcctgtaaatttcatgacatttttaaaactttcttcttctttttttaaaattatatatactatttatttatcttatgtatatgtgttctgtctgcatgtatattttcatgccagaagagggcatcagatcatactatagatggttgtgagccaccaggttgttgctgagagttaagctcaggacttctgggagaatagtcagtgttctaaactgctgagccatctccccagccccatgatgtaacttttaaaaaattccatattgtaaatgtaccacattttctttatccattgtttagttgagggacatctaggttgtttctagtttctggctattacaaataaagctacaatgaacatggttaagcaagtgttctgtggtaggatggagtgtcctttgggatatgctcagtggtggtatagctgcatcttgaggtaaatcaattcccaactttctgaggaaccaccaaactgattacaaacacacttttctttgttttttaaacttaatcattttattcatttacattttgaatgatatccctcttcccagtttcccctccatacactccccatcccatccccctctcctttgcctctatgagggtgcccctccacccactcacccactcccacctctctgccctagcatcctctcatgctggggtatctagcctccacaggaccaagggcctctcctcccattgatgccagataaggccatcctctactacatatgtggctggagccatgggtccctccatgtgtactctttggttggtggtttaatccctgggagctcagggtggtctggttagttgatattgttcttcttatggggttgcaatccccttcagctctttcagtccttcccctactcttctactggggtccccaggttcagcccaatgcttggctgtgggtatctgcatctgtattagtcaagtgctggcagagcctctcagggaacagccataccaggctcctgtcagcaagtacttcttggcatcagcaatagtgttagggtctggtgtctgtagatgggatgaatccttaggtggggcagtctctggatggcttttccttcagtctctgctccacttatgttcattataatccttctttctgcagctggtcacatggccttagatgatatttataactaccttcctctgctacccattctgtatttcctccaacaaacagcatggtcaggcctatcacagtaataccccagtttcctgataccaacttctgtcttagtcactccttttttttttttttttttggtttttttttttttttttttcgagacagggtttctctgtagtcctggctgtcctgaaactcactttgtagaccaggctggcctcgaactcagaaatccacctgcctctgcctcccaagtgctgggattaaaggtgtgcgccaccatgcccggctgacactcctttattgctgagaagagacactgtgaccaaggccacctttataaaagaacttactgtgggcttgcttccagtttcagaggattagaccattatcatcacagaggggcatggtgggggcatgatgtcactcaaggcccccaaacagtatctgagacttacatcttgatcctcaggcagagagagcaacactgggccttttatgggccattgaaacctcaaagcctaccccagtgaaatacttcctccaacaaggccgcacctacaagtcctcctcaaatatatagccccttcctgaaggagaagcattcaaatatatgggcccatggaggccattcttattcaaaccaccacactgaccttagttaaggacctaagatgaataaggaaagaatcttttctttccttttagtattaaaaaaaaacaaaaacaaaaacaacaaaacttcatgctaatgtaccttagtggtaagtgaagttaccactaagattagaggggaaggtctatattggttgaaaggggagttacgatattagtattgtattctgttaaattgtgtgtacatggacatagtttatatgtgaaaactaagtaaaaataatagaggtaaaagtggaatcaggaaaacaactctttatttaatccataagacatttaaatcagcagcaagtccaatgaatcccttgaatattctaccaagtgctttttatattgaagacatgaattcagctgtgcacagatgtcagcttttgaaaagccagacaactttacttcccagaataacttgagttttatcaagaaaatgagtactaaagagattgtacttgtttggcagtcaagcctgccagtgttaatgagcttgtgatgatggctatgcagaggagtcagtcagacacccagtgtgtgctttacttttttttagtgtgttggcaaaatacttggaaaggcactttaaagaagtgggtttttttttttttttttttttctgtttgcttttttgtttttttaactctggcccaaggtttaaggagggatgctgtccgtcctggcagtgaaggatggcatggaaggagagggaccagagagtataatgccaaggtgaacatataagagaagccagtttgcagaggaacatcaaagttgtgcctcacttgggctgtgtgtaggatctgccaaggtcctgtaaagggttacctggcccagtgcttcactctgagctcttagccactcaggtcctcaggaatgtctcctttctcagaaggctgcctctagttccgttcttaggaacgcatttcctttctgcctctacttctgtttctttcattctactttctctttattgaaaaacgtaggcttgtttattttatttggtatgcatgagatttttcccttgatgtagtatgtctgtgcactgcacgtctgcctggggtcatgggaagttagacgagagagtggagtcgggagctggtgcagagcactgtgagtctccctgtggtgttagaagttcaaccagggtcatctgagagagcagtcggtgttcttaatcactgaccatcccttcctctccaccccccatggtttcattatatagccctggctggacttgaacttgctttgtagactaggctggtcttgaatcaacagagttcttcctgcctgtacctcctgagcactggggctaaaaggtgctaggcctgactttaactctgttttttgccatgtgttcctgctgaagtcctttaccctggtgttacagaacctagaatcaggcgcccattgagatgagagctaaggcctccctgctaagcatattttgtcctttccttggatactggccaaacccttcagcatgctttctggggtaccctgggcttctcagttcctcagacttgacctgacttcctccatctccctgtttcctggtaactgcagggagtttcaagttacttgtcctgatgtgttctttcaattttaataaattgtccacaagcttccttccctgtccattctttctttagtgatgctaaaactcaaagggaaacattggtttcccagcttgaagggcaataggagcgttaggtcatacactgcctgcagtcaggaattggtgagaggtggatccccatgcccagcttgctctctcccttgtaatccatctgggacgtaggctatgggacagtgctgcctcccttcaggatgggctgtcttccacagttaacctttccgaaatacatttacagaaaatctcaggtttgtttctactgtgaagtagttctaagaagaccaaactctgtatgttaaaattatgtatgattgtactttaagtgctaaatataggtatgttttgtttgttaacatatgcttattaaatatatttatgcattaaatgcattaaaatgaagttatatatttgtttactatctttaacatgaaatgttgtgtgtgttgggtctggaaagatgactcagcatttcctgttgcttagatgaccagagttcagttcctagcccccatgccagccaggaacccacacctgggcatctaatgccctctggtagtctcccagagcaccccacacagaatcacacacaaagaaattaaagaagaaatactgtgtgtcatatgtaaatgcatgtgttgagctgggtgaagactagactgcagtgcccatctcgtaggtctgtgctttgattttcattacactctggcatggagcttatagactgcaggtacttgataaccgctcacagctctcttttgtggtgtttcatagatctgaataactcgagagattgtcttatgaaattgctttgctactgtagatgagagctgtgcgttcctggatggacatggggcgtggatgctgattaccagtgatgaggtttccgaggcgcgcattgcagtcaccatcgattctgagacactgaactgtgtaggtagatgtgtaagacccttgtggctggtgaaagaattaaatggcctcatcagaaagaattgcagttcaatgctgagtttatactttgaaagggatgagggtagacttttggctctccctccctaagaacagtttaggataactactatctatttctgcaaaatgtcaatactatcatttgcccattccagaaataaagattaatccttagaaaatagaaaaatgttatctggtaaaatgttgtatctcattactaggaaaatgccttttccaagcaagtgtctgcggaggtgattatcactggtctggctgtgggctggctatgttctaggttacactacatattgtaattatattatttaaagtgcatatatttgattctgagtaaaaacaacttaaaagcgaaatatagaagcatgagtaatgtgagaacaaacaaatacggaattgtagaactttagggtatgagatagtttgcaattatgtaagtgttgaagaccatgattctacaatgattttttccaattagcaactcatgtatattttgtgtgtttttaaacatcttaacagtaagaagccttgaaccatatggctcttttttattttttgaaaagagatttgaattctgaatctctattgttatggttttaagtttaaaactgttcttgttcaatgaagtggaaaatgcttgaataatttttaggtattagcgttatagtaggcaatatgataagtaaaatgaagataaaaatagggagagcgagtcagggtcctctgtgaacatagaaggtctactagctccctctgtcttggcagagctaagctgtcgactgtcccacattgggtgtccttttctgggcagtattcttttgcctaaggatgaattagagcaattcttgcccagtggctaccttgtcacaactagagcaactctctctggaggttatgaggttcactatgtctcctggtcaaaattctaataataaatgattataaatgccatggtctgtggatttctgatgtctttgaagactttcgaaatttatataaagtatatctgaactgttaaaccttgagtactcttagacatttctatttggataatattgaaaatgctttattttaattaaatcagaatctaatgtgaccataagtactatctgatccttaacttgtattacttaatcgtcctagacagattataatagcagctatagaaggactgggtcaaagctctatattcttaagtgagttgaataagcacagcgcctatctaagagtaacaatattaatttcaaattttgtatcaatatacaaagatttataccaatgaataccttaaatctgtatcaatatctaaattctgcaccaatgtaagaaattataacttcaattttgtatcatttataaagatttctaccaatgtaaaattatggctatacaatgctttattcaagaataaacttagtaatccatctaatatttcctccctcttcaaaattatgatcgtttacaaattatcccttaaaacgacaacctatctataatttaaaaaataaccatgactagatacccagacccgggggactgggatgacgactctccacagctttttcctgctgaattggggtgacagaaatcttcaagggacggggagtgctaggaaaattagaacattgggttagactcagaggctcagggctggcgtgaggttccgactggacccccgcgaggctggatgaaccgagtgcgtcggagtcagcagctgttcctgaagctgttctggaagctgtctctgggaagagccccaggaggcaggggctggaacagaaggtcatctcagcgccccatgtgagtcctagagctgtgcactctgcaatatgtgaatcttacagcaagttttagtactattaaatattcatatggattgcacaaggttcacagatcactaaggatgaattttgctccttgtttgaacaggtgaaaggcaactatccttttatgaattaatttgatcaacaaccaatttttttttcttttttctttttttcttttgtcgagacagggtttctttgtatagtcccagctgtcctggaactcactctgtagaccaggctggcctcaaactcagaaatctgcctgcctctgcctcccaagtgcttgggattaaaggcgtgcgccaccactgcccagctcaacaaccaattttaataaattttcattcataccatgtgaaggagggcacggcgaatgttaaggattccataaccaacaagatttattgtctaattttagttgaagttttggtagggacatttttatgtctaagccaattacagggctgttcccatatggaggaagcagtaaatcaagttacctgtcctgtttgattttttttttttttcttttctgtagctaagatcttcaggggtcttcccctgtcatatctaatccatatcactctggaaggggtccaaagccttttctcctttcctgtcaacacaaatacagagtctatctctcaaaatagcatttccttggtcgattagcccaaaatcatcaaagatatagattgattcagcttggtagccttctttctcttcaggcttgctctattttgacctctctccccacaaaatgaaattaaacgaaggcaggaatgaaaaaaaaaggtgctagaagacaacttgaggagaatgtgatgcttttggtgtctgtgggcaactgtactggcacatgtgtgtacatgtgtacgaactacacatgaaaaccagaggacacttgccgtggagggaggtaggaggcatgagaataagggagaacaggacaaagaagaggaaacaaaattatgtatgtaattgtcataatcaaacctgttactgtatcataggccacgcttgcaagggaagcaggtaggctgcttcacctccccctctattcctccaagcccagcccccacagctaagtcctagcttcgcatgagaacgccatcagcagcccccctcctgcctcatctctagtggaccccacagatcatcctttcctacccaccccttcccaactagttgcttcatcccagccctcaactccagcaggccctccatggaaacccaacagccactcgtgccaggggagcagatggtccaaggataaatgtttgcccccctccatctctccaggtccaatccttagtctcatcccagcctgagtcagaattcctgctgagcctctttctctgctgtcccatctccagcagacccagtagatccctcctaatcccctttacccagaacttgctttgttcccactcccaactcaagcagctatgacctgggaacccacaagtcctacaaggaacctacaagggaagcaggttaggtgactgcagatattcaccattccctccatttctccaggtccagttccgagtgtcatcctcacctctgtatcagaacacctgtggcatcccacctcatcttcagtgggtcccacagatcttcccccaatctccctcaccctggtagttgctttatactagctcacaacttgagcagaccctccatgggaacccactggccactcctgccaggaagcaggtagactaactgtagatattcacaccaccctctgttcctccaggtcctgtccctagctgtgcagcaaaacacctttggcaacctccccgccctgcctcatctccagtgggtctcacttgtctacccctcctgacctctttccccacagtcattgttgtatctcagcccacaactctagcagacattctatggacccacaggccactcctgcaaggaaagcaggcagactaattgcagctctttgcccctccttccatacctccaagtccagtacccccccctccgcccccagtctcattcccatagtgcagcagaacacagctggagcgtctcctcctgattgcacctctctcggatcacacagaatttcctcgcccaagttcccttccagctccaaactcaagagggactgccctgggtacctcctgccacccttgcaagagaaacaagtacgctaaatgctgtctcacccatccctccatcctcccagtgtagtgcccaagtcaatccccagctctacagaacgacagacaccacatgttgcaaatcccttgcctcctctctgccccccatcttcagggaataccacagactttccctttctaaccaccattctaaaaatagttgctttatcatggcccacaactccagcaggcactcccagggaaccatcccacaggccacccctgccagggaacacataggctcattaaaggtcttcaccttttacttcttcctctgaagtcacatccccagctaaggagaaggacaccttggcagtgccccatccaacaactatagttgactctacagatactcctctcccccctccccaacctcagtacaccactcgtagctttattccagtccaaactccacagacaagacactccctggagcccaccggccagtgcttcaagacagttacatgctgctcttcacctctccctcagtttctccaaacctagtggcctacctctgcagttgggtgcctgctgcagggcctctttttccttcttccctcatctcagatggatcctgtagaagatcctatccagactcctaagtgtcctgcttccagcaattgctttgtccaaacctccagctgcggcagaccccaccccatggaaacccacaggccactgcagtgaggaagcaggtaggctgactgcagatgccgtctttccctccatccctcaagtccagcccccagctctgcagaagaacagctgtggtaacctccttgccccacctctcctctcgtggaccctgcagatctccccttccccagccttactcaccagattagttgatgagtaagcccccaactccagcagacccttcatgggaactggagagccagccctgccagtgttgcaggtaggccagctgtagctcttcacttcatcccctgctccttcaattccaacgccttacctcagatcatttgcgatagactcccgtagcctctgttcctgccccagctcacccgcagtggatccagcagatcttccccctctaacctccctcaccgcactagttgctcggtagcagcccccagctgaagccaacccttcctgggaacccaagcgtctcaggtaggcccctagagtcaaggtccctcctgcagcttgtaagcgccagtgccgcagactctgatgcatcccttctttgtatcaagtgctgttctcataaaggttagttctcagtcagagtttgcaagcaagagcaggtctttggctgcagtttgagtagtttcccttcttctctggtgctgggatgtcggggagggaaattaagctgatagactgaggcgtatagtttgagggttggagttcaagatgctctgcctgctggggctacaggttgttcctggtttttggcatgcctactctctctgtaaggtggagagagtttgctaggatgtcacctgatgtgggtttttgttgttgttgtttattttctttatttgcatttcaaatgttatccccccttccccattcccccagcttctatgagggtactccccccccagccccctgcctcagcgcgctacatcatcgagcttccacaggaccaaggggctcccctcccattgatgacagataggccatcctctgctacatatgcagctggagccatgggttcctccacatgtactcttcggttggtggtttagtccctgggagctttgagggatcttcttggttgatattgttgttcttcctgtggggttgctgactctttcagctccttcagtctttcccctaactcctccattggggtccccatgtttagttcaatggttggctatggcatctgcgtctgtattgtgacctgatgttttattagttttattagttgcaggattctgtgatttgcattggccctctcagtagtactagaggttggacatctaagttctgcatggagtcaagcatcatttaaaatgaagaatttggtttcaggctcgggcaaagaagcccccttatttattaagtaataaagatgaaaatgctgttaaaaatgttcaattttatagcacattgggcatctcttcataaatattgcaaatttaaaaagtgctttatgtaagtagatgtaaatttttattctgttatttctgtcttgcacagcacctcatttagaagctgctccctgcagagggacgtatactgaatatatagctattaaattcttaacccctcaacagttcccactcactttaaaatattaatgacttttgactatgtaagtcatacacgtaattccttatgtggtgtacatgctgggaactgagtgaaacgccagctgatcttctcatggcttcatccctttctggcacctgactctgtctctgcagatccactgccaaaggcaattctcatacctagttttgtttgtactactacggattgcttgtgcatttaaagattttacctatagccattaaattatgtgtacaagtatgcatgcttatgaagttgtatttttatatattctcctggcctgtgcctttacttccttctgtagcttaatacttttgtatctgtttcttgataaccacatattaattggccattttatattgaatatatagatgcttagaaaaatgtttatttgtatttatttattgtgtgtatatatatgtgtgtgtatgtttgtttatacaagtgtgtatgtgtgtttgtgtgtgcatatatgtatgtgtttgtctatgtgtatgtatgtgtgtatatgtgtgcatgtgtgcctgtgttcgtgtgagcaagtatgtgctctgggttccaggcacaggctcgggtcactaggcttctttacagttatttttcctcctgagccatcctgtttagatatcctgtttttcaagcttttaataatacattgttttatagtgaatatatatttccttgtaatttttatattttcttagattgttttgacttcattatgtattttttaaaaatgcaccaggcatggtggtgcatctctttattctcagtactcagaaggcaaaggcaggggaatctctatgagttcgaggccagtctggtctacagagtgagttccaggacagcaacagcgacacagagaaaccctctcaaaaaaacaaatgctgcaaagagttttaattgtatatatttttctacttttattgtataacttttggtcatacgatcacactttaaaaggccttccattaaagtgctcatttttatacttaagtgtttcatcaaattagaattttagtataagcatattcatcctcttttcttaaaagtttttttttgtatgtttgaacatttgcttgcacatgtgtaatgtgcactgtgtgtgttcctggcacctgcagaatctggaacatgtcattgggtcctatggaattggagttgcagacatttgtgacgaccatgtgggggttgggaacagcactcagggcctctgcaagaacagcaagtgctcttctccattgggctatctctagcccttccaacttcatttttactccaaaatagcaacccatatttctctactgatgctgaattttgtctttattatattataaattctcattctatttgtattatgtctgaagtttatctttattttcactgatatgtgtatttagcatcacaaccatactaataatcattatcaggtacacattttattcataataaattaagcaatataattacatactttagcatgtgagttggattaattttcctcatttccattttatcttaccaatgggattattaacccaggcctattaacttgagaatccagctagtttattttatcttaccaatgggactaaccagggctactaacttgagaatccaactagtttattttatcttaccaatgggattaaccagggctactgacttgagagtccagttgcctagtgtcatagttacttctctgttactctgatgacaccacaagcaaggcagtgtacagaagagagattgttgggggtttgcagtttcagagggtgagtccttggccatgtagcaggaagcatggtgtcatgcctataggcatgctgcgggagcagtagctgagagcttatgttttgacttataagcatgatacagatataaataatggaacatcctggtatggatttttgaaacctcaaagcccacccctatagccaggagcttttctatctgtcttctttgtttccagaataatgactctgagacttatttatttatgaattaatgcccaggccgtaggctttggcttattctctgactggctatgcctgccacatggctagttacctctcctcagtcacatttgtcagtgttgtcctagtccaggcgaaatctgctcatgactctttcccagaattccccccaccccctctgctggatgtcccaccttccaatcctgccattcagctctttgttgataggtgaatgcttctacacagtgcacaagagaatatcctgcataccccagtggtacacttcctcctaatctttcctaaacagttctacctcctagtgatcaagctctcaaacatgtgaatgtacagggcctattcttgcttaaacctagttaaaacttatcttggtattttgtattactcttatgaaaaataagtcatagataaaacattgataccttagtgtcattgaatctttctgctcaaaataggatggatatttatactcggttcaattcagtagtaataaatgatatttccacatagatcttgcatgttttttagaactatattcttaggccacttatctttgttgacttaatatttggactcattttctccttttcatcttctaaatggtcgtcatttatgtgtcaaaagttctttggcagtttaatggctttaaaaacaaaacattccactttgaaacttaatgttcacttttaaagcaattgttacttattattttgttaaaatttatttttattcatttgtgtgtgtgttgtatgtatctgtctgtctgtctgtctgtctctatatatgctcatgtgtctgggagtgccccaagagaccagaataaggtgttgggtcctttcaagctacaagtttacaggtggttgtgagtcttttagtgcggtgctgtgtgactgaacttgggtcttcttcaggagcttttaactgctgagccacctcttcagcttctcttaaagaatctttgattatcttttggactaagttgatatactcaaagttgttataagtcctgtataaaagccctgaaatacactaagaatcatatatcccataccctggcccttgtagacaccattcacaaattgcagagtgcattagccacttgcgccccagtgatatttgtttttcttgtcacttaattaacaaccatggggcatatttccattaacatgtgaattagcatcttgtttctctcatatctaagggcctaaccaggccagttacagcagtcaggtttttagagtgtctcttttttgagattatttcatgttgctagtagttcttggtccagtcagctgacagttatttaaacaggggaagttttgtacacagaattatgaagctgttatataatatgtctctgtaagcttaaatcaattctctagggtattccagagcttgggggggggggggagaaggagaggaagagggggaggaggggggagtgagaaagggcagatgtgtggaaatcttgcacatatttgtttgcctcttctgaaaagatggagaagcaatacattggatccagagacatttctggcagggtgaaaatggtttgtatttgcttgcagagtgcaaagtagctctctggaacattagttaatagagaataaattgaaatcaaggatacttgacatgcaggaggcctggagtgcacagtgtccacgtagctgtagctgtagctgtggtgctgagagtgactcaggaatctgcaaaatgagctcagcacctgtctgcaaaggaggcagagtggtccacacctgcagcttctagctcatggagggctcaggaagatgtcaccaggctcagctgcagttgagagtttctggtcactcttagtactcacttgggcaaattccagagagtgtcctcagtgttatcgcctgtctaagagctagagagctctttcatggaccagtcctccagtgccctctactgagaaagagccatatcatgctcatggtagcaaaattttagtaatgcagaagaggagctgaaggctgaattcagagctttgaggcagttaaacattaatgaatgtatctattcttctgctccccaggtctgacagagtctagcttgcttctggagtcctgagtgccctgtcctgtcataggaagtcacacatattcttacaaagtgccggtctgtccttcaagggctcggctcctttctccttgatcttagtgatggtttatacaggttttttgtttatgtcctgttccagggttatgatttcttgtcttagagtttgtatatgtttctctgccatggattttgttttttgttttgttttgtttttgttttttgaaacaaggttttcctttgtagccctggttgtcctagaactcagtatgtagacctggctggccttgaacacacagagatgcacctcctccctctgtctgccaggtgctgtgattggaggtgtgggtaccactgcctggctataggtgtattcatttctctttaaaagattctgggagagcttggctttcatctgtttgtgttagttatagaaactgaaattcttgtcagactcctctgctgtcgacttgtagcaattctttctgtgtatgggttcgttttctgtaatttttattattttcagtttactgtgatctaaaatattacatggaaattccaggatcaatgaacgtatcggttttaaactgtatactgttctgtttgtcaggtatttatttacactaggtgctctgtgtgctgtgtggtcacttggataccaggtatagacctattctctgatttctgagacagtatctgtgttcctgtcacccttcacctggcttcatgatgtcccaagtgcaggagtggcagtgctaatgatgtcactcactgcagtgccatcattgttccttgttgttattggctatattgctatcattgttttctggtgttattagttatttttgttgctttttctttcttccccgagatagggtttttctctgtagggttgactgttgtggaacatgctctgtagaccagactggtcttgaacttggagatatgcctgcctctgcctctctctgccgagattaaaagtgtgtgcctctaagcctggcactgttgtcttaatgcacctaatttataaattaatcataaggaaatgtgcgtacaactactacagtcttacatctttttgtgatcatagtattttctgagtattgcgccatcaggtggtgctgtcttacagcaaccttctggagtgtacacaagcctacatgttgtagttcatcactgcacaaagacttttgatcaagataggtggtgaatgggagatgggtgaggtggacactttacattaagctttttttatgtatagaaagtgtatgtatagtaaggtgtcaaaattacaaaaacatgggaagcagtaacaattgtttattaagattttcagcatacgtgtcatgcatcgcgtttctttcttttcttttatatgatcggaagcccagcaaccttaaatcatcgtctccacaacagttgaataatgcactgcagtgttgagatgactgttgtcaccaacggggaggatttctctgctccttcatcgatgtcggggactagcatgcttatgctgccagttgttggctttaaacaggactcacgtataagtgatacatgttcagcatttgttactgtgtgcagtttcagcatctgccgtttcaggatgtgcatcagcttagaaagtatccattgtgaattaggtggctactcaagtccttagagggtttgcactttgtactttaggtctctgtcaattttatcagattggtctagagcaagccttgttggtttgagagtcagaaagacatagtttgatgcattgaggagatagcgcagtcattaaagtcctgtgcaaccatgaacactcatgtaagaagctgaatgtggtggagatgcttgtaattcaggtgctgggaggtagatctagtagatctctgagactcactcgctcacagcagcctagctgctcccagtaagagcctgccttaaaaacaggattgatggtgcctgaggaggaaggacatctcatattgcccttggcctctatgtgaacattcgcttgtattgcactcagacccacagcaggttggaaaatctagttccgccacttaactgcagccatggtgtgatgcttgtttgtaaacctgggttcctaagacatggagtgaggtacagtgagtgttgtttccttgctgcaggtgtgtgttggtgtaagtagctgcagcaccgggctttcagttgataaaggagagttctgtgcttcagaagaacgacataatgttttggtagagaatacattgtggaatgtctaaacacacattggcatatgcactgactcatgcgctggccatcttctggtgatgagtcgtactcacatttagaagctattatattatatgtcctggtatgtggtacgtattttacatttgaaccactcttgttttctcagtcatctgtatcttatattttttgatagaatttgtttttgaaatacttaattctttaaaaactttctaaacattgtgtgtgtgggcccctgtggggtgtgtttatttgtgctgtgtgtgtgtggtgtagtatagtgtgtgtgtatatatgtgtgtggtgtgtctatctgtgttttaagttgtgtgagtgggcatttgtgtgtctttatgtgtgtgtggtgtttctgtgttgtatgttgtgtgagtgaggtgtatgtttgtgtgtcatctgtgtgtgtgatgtgtgtgtatttgtggtgtgtgtatgtggtatgtgtgtgtgtggtcagcacttatgtgggcacagcagagtatgaaggtcagaggagagcttgcaccagtcagttctctacttctgccatgtgacttcctgagattgattttagattgtcaggctggaactggagggagacacaggtggctgggagcctcctcctgtgggtgctaaagctgcagcaggtgtttttagccagctgagctccctctccagcacccgaagtgcttaatccttaggaagcgctacaatgagccagacactctcgggcttcagagattcatggtgttattattataatgtactttaaaaaggcggaataaaatcatcttttcccagattgcatcagttctcttaagttcatttgtaaatggaagtatggtagcatctattttagtttaaacgatgtgagctgggcatggcagcacacacgtgtgatctcagtacttggagatagatagggacaggataatcacaagttcaaagtcagctgtgactaacaaatttgaggctttgtgttagaaaaacttcagtagacaaaaagtataaaaattagatcttagcaggatgtagtggtgcacacctctaattcagcaatcaagatacccatacaggaagatttctttgagtttgaagcaattctggtcttcatagttccaggactgccagagcgacatagtgagacccaagtctcctcaccccacaaaatcctcaattttgtcttataatatttgacttatttttaaattgaccaaattgtgactgcttctgaattcggcatgtcctgtagtgatcagacagacgtacaccctgccttctgtgggatggctgtatgaagacgtgcattgtgagatggctgtatgaagacatgcattgtgggatggctgtatgaagactgcatgaaacttcagacaaagctccacttccagcacggctcaaacattaggttacttgacatttaccttaaaaccctgaatggtttgagctgcggagctctgctgtttgctgagttacctcagtaaacagggtgaggtgaagaagaccacatccccgcccgccctacctgccagcaatttcttcttgtttacttttctatacttgcacatgtgatgagggcttagaagttattcatgtgcgtgatgctgcttctcacttcacgccaaggattttactgattgaaaaggaattaagagccatgtgcggtggcacttgtgcagccctagcacagggaggctaagatagcagaattgccacacatttggggactgaaaaggaattaagagccatgtgcggtggcacttgtgcagccctagcacagggaggctaagatagcagaattgccacacatttggggtcagtccggagtacatggatagaccctttatcaaggaaaaaattcagagggatctttgcaaataaccatgaaggtttttttttttttttttaactatcttgaaggatcatagaatcccttatatagtcatctaaaaagtttgtaaacaggatgtgtaactttagattagaaaatcaggtcattatcaaaagctttctttgtagaaaagctgctttgatttttatttcacagtcattaatgaaactatcaattacatgaattatgattttcaattcacatagtaatttccatgtgttttcataataaaatccactctgcaatctcttcaacagagatgcagcgaacagcacctgctgtagcacacagctaccaagtgggtgttcacactcactgtaagaaacaacactgaagggttaatgaaagctggatacattataagattacaaaggttttatttatgagaggatagggagggtatagttatatggacgaagcattaataacctctccattctgcaggaactactccttccagtcccatagggactgtgagtgtgttttggtggtctgtgcaagaggttaaacttggcaagtgtagtggggaatgatgtcactgaatgcacaccatatgtatcaaaagtcagggaatgctctcacactgccatgcatagatgtatataagtgttggaatggaaaatcgtttttatgaaaatatagacaagtaaaacaagaatgttctgtactgagtctgatccagtcaccaggagctgccaagtatgatactcccggaaaagtttctctccttaatgttccagcctccagccctttgttggctctagaagcagtctgtttggaaagccttattcagtacgttctttctgttgatatgggttgaacaccaaatgagacatccattttctctgttaaagcaaagctgctagagcagtctagtgtgcatgctgccgcagatggaaatgattaattgatttagctaactcagtagattcttttctagtaaagcaggggtatagcagagcttcatactgctaattattgttctatccattaatatatcaaagactgtaattgttgcttcaatcattctgttatcattatttaaaatgttatgttttaatgctacactaatggttacatcaaatatataaaacatttgagttttagaagaaatttatggcttctgacaaaagaatacatggagataaaatatgaagtatctagttattttattattcaattttaattatcaaatcacaatgttttaaaaaatattattaatcttttttacagtctagtcgttatccttctcctggtctgccctctgactgttcctcatcccattcctcctcccctgtctccaagagatgtccccatcctcctgtcctcacctccacaccaccagacttcccctctccctgcggcctcaagtctctctagggttagttgtgccttctctcactgaggccagacaaggcagtcctctgctgtatatgtgtcaggggccttatatcagctggtgtatgctgcctggttggtggctcagtgtctgagcgatctcgggtgtgtgtgtgtgtgtgtgtgtgtgtgtgtgtgtgtgtgtgtgtgtgtgtttcaggttagttgaaactgctggtcttcctatgggatcgcccttcttcccagcttcttccagcctttccctaattcaacacaagggtctctggcttctgtccattggttgcgtgccagtatctgcatctgactctttcagctgcttgttggggctctcagagggcagccatgctagactcctgtctgtaagcacaccatagcatcattaatagtgtgaggccttgaagcctccccttgagctagatcccaatttgtgccagccactgaacttcctttccctcagtctcttctccatttttgtctctgtggttcttcttttaaagcaatcatggggggcagagggagggagggagggaaccagatgggagaggagacagggaggagggaagaggaacatgatcaggtatttctgggtcagtttttgactgtgggatggcaaccctatcccttcacttgatgctctgtctttctactggaggtggactctacaagttccctctccccactgttgggcattttatctaaggtccctccctttgagttctgagtgtctttcacctcctaggtttctggtacattctagagggtccccccttccactttccacctcctacctcccgaggttgcccatttccattctttctgcttactactcagctattaagaatgaggacatcatgagttttgcaggcaaatggatggaactagaaaatatcaccctgagtgaggtaagtcagacccaaagggacatgcatggtatgtactcactgataagcagatattagtccaaaagtacagagtacccaggacacacccacagaactcaagaaggttaacaagtcaaaggtcccaagtgaggatgcctcagtcccacttggaagggagaagaaagcaatcatggggggcagagggagggagggagggaaccagatgggagaggagacagggaggagggaagaggaacatgatcaggtattgggggagtggggagagcaggaaatcacaatgtttttaataaaaataaagtactggtttaagttggatacctaaaagtttgaatgaactattgcatatcttgtacagaaaacctcttcatctagtagcgtgattccactaaaacagtagttgtgacctaggaggccgctgaactggcagagtgcttacccagcatgcacaggatctgggctgcatccctagcacagcataaaaccaccaaggcagagagagagagagagatcctaatctcagcactgagtcagtggaggaccaacagttaaaggtaatggctacatagcatgttctcaaacttgtgtgttcctagtatataaataaggaaatgaattcagcatttgtaaagctggaagtagtggtgtgctcatggaatctcagcacttgagaggctgaggcaggtagattgctatgaatttaaggaaagcccagactacatagcatgcacttatctcttgagcagcagcagggctttggagaggacttgagtgggtaaagcttgctcagctttcgtccccaggatgcagcatgtctatagtcccagtgcattcctgaagtgaaggaagagtctgaggcagcctcagcctccgaggagggattctcaacctccctgcactgcgaccgtttaatacaggacctcatgtcacggtcatccccaacctggaaattattttcccttctacttcatagctgttaggaattgtaatgtaagtatctgatatgtgaccccatgactgccgccttagagtgttgtgggccagccttcatgatgtgtgcagtggtaaactacaaagagacaaagaccaacacctagggccctgaccactgaatacatacacacaaggccatatgtattattctcacatgtgaatgaacatgtacatatacaggcatgcacacatatcacacacataatgtacacacacacacaaaaccaaaaaagccaaagaaaatttaatatttgtcaaaaagcaatatggtaggacaatattacatttagtaaatataaatgaaattatattaatataatagagttctattaacatttggtatctttgttttatttttttctttgtggtacttaggaacatagtaagggccttgatcatgcttgattgaacttcatgttcttgcttctcagctgcatcgccagctccttgatctctctgtatctaactagtacgcctctctgtaaaccttcttcctttaatttttctttttaactttctgaattagtatctcgtgtatcccaggctaggttctgaagcctggttctcctgtttctagccttccatacatgttattactctcttcttgtagcgttggttccttttctgttgctgcgatagaatactcttaaaaacaaggtgaagaagaaaaggcttagagtttcagaggggactgcagtccacggtgggaaagaaaggtgcggccacagaagcatgaggctcttggcagtcagggagctaagatagcgtgtttcatctgcccgtaggaaccaacagttaataaacggcacctatgaagctgaaagctgctatatggccaaggacgacatcgctcagacaaagcggcaggctacagaaggagctgtgtctttaccaatgatgcatttgatagagagtcagtatttaaaacacatagagaactgaacaagaacattgaagaaaaaataacccaattaaacaaataagatataggactcagcagagttgtcaaaaactgcaacctaggaggctgagaagttctcatatgttcaacatccttagctttcagggaaatgcaaattaaaattactttgagattttattgttctcagtcacaatggccaagatcaataaaacaaatgagcatgttctggtgagaatatggggaagggggcacacttattcattgctggtgagagtgcaaattgatacaggagttttggaaatcagagtgactgttgcttaggaagctagaattgatctatctcacgatccagctatatactcttggatatatactcagagaactctacatcctactacagagatgattgctcatcagagctctgttcataataggcagaagttggaaacatccgagatatctatcagctgatgaatgaattgtgaaaatgtgatacattcacacaatagaacataattcatttgttaaaaataaaattacttcttggtagttggataaagctaaaaaagttatcctgatccaaaagagagaaatattgtaggtgtcttggctggttttctgtcaacttgacagaagctagagtcatcatagaggaggggtcctcagtcgagagaataccttcataagattgaggtgtaggcaagctctgcatatgttggggcattttcttaattagtgatttgtgggtgaaggcttagcccactgcttgttttagttctataagcaagcaggctgagcaagctgtggggagcaagccagtaagcagcacccttccatggcctctgcatcagctcctgcctccaggttcctgcctgtgtgagttcctgccctgttttcctttagtgatgggatacagtgtggaggtgtaagccaaatagatcctttcttcctcaacttgctttctgggcacagggtgtcattacagcaatggaatctgtaggacagtatgttttcctctcttatgtagatgctatctgtggtggcttgtatattcttgggccagggagtggcaccatttggaggtgtggccttgttcaaataggtgtgacctggttggaataggtgtgtcactgggggtgtgggcttaagaccctcaccctagttgcctggaagtcagtattccactagcagcctttggatgaagacgtagaactctcagctttgcctgtgccatgacagtctggatgctgccatgctcccaccttgatgataatggactgaacctctgaacctgtaagctagccccaagtaaatgtttggtttttataaaacttgccttggtcatggtgtctgttcacagcagtaaaaccctaactaggacagaagttggtaccaggagtggggtattgctgtcatatgccttaccatgcttttgtttgaaagaatgtggattttgggactttggatttggaacacagtgaaatgctttaaatgtggcttaatgggtcatcctagtaggaatattcaagaatttgttgctgggagtaatttgaactgtgttgacctggtccaagagatttcaaaggagaagaatttcagtatgtggcacaaagaatgtttttgtggtattttggtgaagaatatggctactttttgcccttgtttgaaaagtctgcctgaggctaaggtgaaaagacttggattaaagacataccaggaagtgaaatggagcaaaatcctgtgttctatgaagggagtgggaccttgggacaagatcctacccagctaaatttagatccaggcatggtggtaacacacctttaattccatgagacagacatgctgatctctgcattcaaggtcaatctacagagcaagaatcaggatagccaagcttagcagtggaggatttagaaaacataaagccagtgataatgtaatagttcaagggggtcatattctagttcctgtaagtagcagaactaggcagcttcagccatgtggctctggctctagagttaagaatggaaggaactacttcgacaattgatgctggttagctggagctaagaaattagcaatgattaagaagagaccagcatcactgagttgaaatctgggaattgttttctgggagcacaaagaagctgtgttctggagatagccaaggttgtaccttgtgctgtgactggatttggtaatgtgtaagagttacccaggtggtactggttttgaaggcatgaaggtgtcatgaagaacaactgaggcttggcactgtgagaggtcatggaaggccattggagaaggtgtagcctcagctgtagttgatggcccaggactgaaggggtcatgcagaggatttgagccttggcaccatgaagagagcatatgagaggctattggtgaagcctagttggaatggtacacccttgtgtattggaggtatcagtaccatgggataatcaccaagaacagaagctgtagtggagtggatcaacctgagcttagagtgctacagagggcagagctggagaagtgatgccagcccttaggaggagctcaaaagatcaagtggaatctcagacattgaaacaagaagctgtaacattgaaattgccttggagactcaaagatgttaaagatgccagagacatgggatacagcgctgacagggagctaacagggaaagctgctaacagggagcggaaccagcccaggagaaagcagtttgttgcattcaacagagatgaaaaaggagtagagatctgaagactgctttgacatcagccatggagatgcagagtttggagtttgcccagctggtctcctgtctttctttgaggattacaggtgattggatggatctcagaagagaacttgaactttggacttttaacattgttgtgaccgctatagactatgaggactataaaaggacgtggaacaaggttgctcttgttttcagtctgcttgtcctcactctcactggcacgttcatctgtcctgtggaatcagtgtctactatatgctgcgacttcttccacagcagggctcgtgggtccaggaatcccgggctggaaatggagctggtcccactcactgccaccctttgcagcctactggggagactttgcttcctattcccaagaccttaattaagttctgctgccctagaggttttgattctggacaggggaaaagacatcagaagatggaaagacctcccatgctcatagcaaggtagaattcacacatgaaaatggccagcgtaccaaaagtaattacagattcagtgcagatcccataaaaattttgacacaatttataggaatggaaaaaacaagctttatgtgggagcctcctttttgatttttaattcttttttttttttctacaattttcaagacagggtttttctgtgtatcctttgctgtcctggaactctctgtgtagctcaggctggcctctgcttcctgagtgttgggattaaagacatgcaccaccactgcccagctctgactcttaattctttgatttccatattggttgagataatgtaccttatataaagaaggtagttgtattttgtgtctcattttttgttttccaactaggagtgctttccttagaatgaagatggatgactccagaacctgacttttagggtgaattagttaggtggctctgtgtgagggattaggcttttccaaacatgcactgagtaatggatttaagagctattggccatgttgtgtgagagatttctttctcggcagggatacaggcaaaccctatataactacacagtggagtgcttactagattttaacatatatatgtagttatatacagagatgagtatatatatatatatatatatatatatatatatatatatatacacacacacacatgagtatgtatgcaggtgggcatacacatgcctatagactatcatagaaatgcctaggaagactatggactccagagagtaaatttgcttatgagtaattattatacatttatatatctgccttttggcagtttgcattaaatcttttattacttttatttttttagaatccagttgttactccctcctagtttgccctgctgaccatctcacggtgacgtctcccctgccatgtcacagtgacccccccccccccccgctgatcatgtcacagtcgcttcccccctgctgactctctcacagtgacctccccccgctgaccctctcacagtgacctccccctgctgactgtgtcacagtggcctccctctgctgaccgtgtcacagtggcttccccttgctgactctctcacagtggcctccctctgctgaccatatcacagagaccaccctgctactgacccttgcatagtgagctcccccctcttaccctcccacagtggcctccaccctgctgaccatgtcacagtgacctccccctgctgaccctctcacactgacctccccctctgaccgtgtcacagtggcgtcccccctgctaaccttgtcacagtggcctccccctgctgaccctctcacagtgacctccccctctgaccatcatgtcacagtggtgtcccccttgctgaccttgtcacagtggcctccccctgctgaccatctcacagtgacctccccctgctgaccatgtcacactgacctccccttgctgaccgtgtcacagtgacaccccctgctgactgtatcacagtggtgtccccttgctgactctctcacagtgacctaccccctgctgactgtgtcacactgacttctccctgctgaccgtgtcacagtgacctccccctgctgaccgtgtcacagtgacctctcccctgctgacagtgtcccagtggcctccccctgctgaccctctcacagtgacctctcccctgctgaccgtgtcatagtggcctcccccctgctgaccgtgccacagtggcctccccctgctgaccgtgtcacattgacctccccctgctgaccctctcacagtggcctccccctgctgaccctctcacagtgacctctcccctgctgaccctctcacagtggcctccccctgctgaccatgtcacagtggcctccccctgctgaccatgtcacagtggcctcccctgctgaccatgtcacactgacccccccctgctgatcgtgtcacagtggcctcccccccgctgaccctctcacagtgacctccccccctgctgaccatgtcacagtggcttcccccctgctgaccatgtcacagtggcctccccctgctgaccatgtcacactgacctctcccagctgaccgtgtcacagtggcctccccctgccgaccatgtcacagtggcctcccccctgctgaccatgttacagtggcctccccctgctgaccatgtcacagtggcctccccactgctgaccctctcacagtgacctctcccctgctgatcatgtcacagtggcctccccctgctgactgtgtcacagtggcctccccctgccgaccatatcacagtggcctccccctgctgaccatgtcacaattacctccccactgctgaccctctcacagtgacctccccctgttgaccgtgtcacagtggcctccccctgctgaccctctcatagtggcctccccctactgaccgtgtcacagtggcctccccccgctgaccctctcacagtgacctctccctgctgactgactgtctcacaggctttcgtttttctttgtatactttgtgcttttcttgatccttgctttccacggaactttgaaactaccttgtcaaaacctgtgaaaagttagctggtattttgattgagattatactgtcattgtaggtaaaattgagtagatagagttttctagtaataatgatttttttcaatccattgtttgggcctaagttaccaagaaattaaagaattttcagcaacatgatattccacacttacttcaatataacatttaatatttaaatcccaattatcgtctctactcactctgacttatttccgttcacctaatctgttttgtataagttaagtctctttcttcctcccatactccaagaaatatgactcaaactagatcataaattctctgactaggttataacccatttatcctaatctacattcttccatgtggctgattacttgtgttagcatccttctcctcacttcatgggcaattctccccatgccttcctctatcccataattcttcctgccttcccattgtcccacctcctattccccacataagccataggccatcaaatttgttattgagaggtgccacgtccatacagacataagatatattctctgcactgtttccttcagaaaacatttcatgtcagacttttggattcctaatgattttctatacatacatatatgtattgtgtcttcatatgctcagtaacaggttccagattcagacaatgggggtagaattagtaaaacttgtagtgtggctcctgaatcatagaaggtcttcataagcattgatgtcatttgattactgtcctgaacacactgattgtgaattccttgtgcacagtgactagtcacttttgtacatttagtgcttaagtgtgttctcgtgcttgggatatagtaggagctgcttggtgattattttatatgatttgttgttgttgttttttagggtttttgtttgtttgtttgttttgcaaacgctctggaaatagagagtgatgtgtatttcacaccactgagaattcttcctctgggtgccaaaattgtatcccagaagcttgccattttgccattttaaaagaaaattaaaagcaaatttaatgggtgactgattgttttccttgtagccgtggactgcagtgtccccagtgactgacctgattgtagttttttttcattttgtctcttttcttaactaaatctttatctaattctttatatccttttatgaagctcaggttatcagcaactatacagaaatttgtttctgttaataagtgaaaattgttcttggcaatgaaaattatggattattgtaataaggaattgtctcacataaatgttgaggtttctgcatattgtagactttaatgtaattacattgttctatattatgtattgtttcaaagaaaaaaacaaatctgcatatcaaggaaaaattgaacccacattctgctgctgctgctaagtgtgtgtgtgtgattattttctctctgtagtgatgtgtcctttgtaagtatactgggtaaggctgcgtgacccagggatggacacagtgagctgaaagcatcagaggttggttgaatcctaacagcaaatggtagagcagagaggttttcagacacagacaggcatggcaggtgtgcaggtcgtcatggtgactgttcttcctgggatcatcgttcacacttgcaggctctctgaaggacttaggagaagatgaacaagttttttagtgcttgctatatatattctttggagagaggtctgaatcaatgtattcaagcacatacatacacacacacacacacacacacacacacacacagagacaaaatcatagtattggacacatgaagttggtaaaatttcaaaaaataaaaaagcagacaagctgggtatggtaattttgcctataatcatcttatgatatgtggaactgaagcaagggatgactgggagtttgaggtcagtctgggttacagagtgagcccctatgtgaggaacagtacaggactgggagtcggctcagcctggagcgtgcttgcctagcgtgcacaaagcccaggttacatccccagcatggcagaaaagcaagtgtggcaattcatgcctgtgatatcagcacttgggaaatagaaccaggaggaccaggggttcagaatcatccttggtggctttgggcagtttgaggccaatatcagctgcatgaggcattaccccaaacagtaaacaaaaccaaaaataagggaccaccggctagccaagaatttatactgatttctttgaggcgccaggaaagtgctgtagagctgtctgttacagttcagacattgtgttaatttgggcaaaaggctgtttctctttcagttcatcagaattgagctctccgtgctccacttgtattttcagctcactgttctttgagaagcccgggaactgacccttctttacatgctcagatatacaggaaaaccaaaatgttatgtgtcctatgtgtcactctgtgtgatctcccccccccctctctccctctccccctcctcctctccctcttccctctccccctcccgctccccctccccctcccccttcctgcacggggagttttcatgtgcttatttttactttgctggcaagactggaagccagcaacctgcagtgattgtcctgtgtctgcccctccttggtgccggggctgcaggtgtgcatagaatgtctggctcatcacatgggtgctgggatatgagccaggcttagtatgtacctgctattgtagtgctcaactaactgttgaaagctttaggtttgtttgatccttatgaagtacagcagaagaaaaagaagcagacaaacaaagctataccattcagctacatgtggtggcgcacaatttgtactctgagtatttgggagatatggacaggaggatccgggcttcagaatgagccaacacagtgagatctaatctaacctgagctacatgaggctctgactcaaaacagacaccactcctcttccccaaatctcaaaccaacccaaaccctaaacctacacaaacaaaactcaaacaaagggcgtttccccccttttaaatggtacttaatagatctagttgtatagtaaagggaaaacttacttttccaacataaacaaaagtcttagaaaaaggggaccctattttaaaaacagaaaaataaaattatatggagtggcaccatatacttcacatccctggtcatgatctgtcttccagtggcaatgaagatgtgctgttccctaaataagcggacttcccagggtcttcttgtcttgttagatttaatccatagctataagtatgaaaacagaagaaacaaaggcagacatctttattagtgaagcatcatttctataaacaaataattggcttccgaaaacatggtcagaatggctactgtggtactgatgttcaccatgcgttcttagcttgtcacacacagtttcatgctctcaggcagtgacactggctacacccagcgtggacagtgggttgagatggcctcgtgcagcccaggccggccttgagctcctcctgtacctgctgagttctggggttatagtttatgcacattagacctcttttatagacattaatcattccttttattataaactgaatatgtatttatacaaagagttctaggatgtatgtttgtatacttatataaaaatcttcactaattttatctctgttggtaagctttagcataattaagtaattttcttcccttttaaaaaatttgaaacatgatctttggtagctttaggaatgatgttaaaccttgaactactgactcctccccctctcctaagttctggggttacaggcatataccacatactcctcttaacattttaaaattacatttctgtaatacccaacttttaaaaacaaagattatttattaatttttctaacattcataaaacattttattttggaagaaaatccagtgtaccataaaacttagtctttgatgaaaatgtttaccccctctggaggagtatattttaggatttaacttagaaccttgggcatagtagctaaaaatgttgtagcattgagctacatcccttgcccacatttatctgctaatgggtctaagtgaagatacaatcccagtgtttacagtgaatcttcacagtaagttttagttctgtcataggaacagtaaactttgaggactgtgcccacacagctgagacaagcgaacgctgagggggagccatggcttgctgagtctcactgtacacagtttattacttaccaaagaatcccagccatttaagaaattgccatggggctggagagacggctcagaggttaagagcactgactgctcttccagaggtcctgagttcaattcccaacaaccacatggtggctcacgaccaaatgtagtgggatccgatgccctcttctggagtgcctgaagacagctatagtgtacttatgtgtaataaataaagaaaaagaaattgcctgatttatgatctttatcagcggaaatcgtatgtattgaggatagaggtggatccctgacatgtgtgaccttaatactgctctggttccaaaccacacagtgccctgtttattactgtgtgagcttagttgtgtgcctaagtgagaactgtggtctgagccaaatcagtgaggcaaacgtattgaccttaggcttgggtgagtaaaaacaaaacaaaacaaaacaatataaaacaagaaacccataagccagttttgagttgatttgaaaggattccctctggcttttcgagagcatgcccctaccccccagtgagttggcccttcctgcttttattctttgtctatacccactttatatttgaaaaaagaaaattattataaaatgcacacgaaagcagtgattagttgtaattctcatcagagtaggggatcccctcccccactgtggcagtctgcaaatggttaaacttgatgaaatactaatgaagaattacagagttatttgtttgactttgccacttgggacacttgcaaatgagacaattcatctcagtgtgagccggtcttatttcttaaagaaaattaattaatgcagtttgtcttcttcccatatctctgattatagtccttttattataccttcactttcctgcttttctctttccccctgaaaataagtgtttctcaaggcttccttgcctctttcaacctgataagtaaaaagcaattttccttggtgcgaatgagtagttgtaattttagtacactttagacaagacatctgtatagtatcccatgggggagaattctacactgaagaatttcactgcaccaaagtctcttaaggtgttgtaatcaatttactcttagagttgtctttattcgtctttgttttcctgttgtgaactgggttagcacggagtgtgtctcacagaagctggtgcgtagactcatcaatgctgagtctgttttactgcctctgctttctgtataacgatccctgagatttcacggttatacctgagtgggttctgaaggacagagggttgttttctataattttagtagttacaaccataaatgtaatttcttttcacgaaatgactagagaattttgttattgaatctcttaaaaaatatatgtatatatgtatgcatgtgtaggtatatctcccatggtgtggacttctcattttaaaggtagaataactatatacttgttttatttctctttttatactcatctgaaaaaaaaataggacttcagaaaatctaacttttaaatcacttgtaatgttttttccaccccacagacccagcaagaaatcagttggagaagaataagattattatcagtcatctcccatgccaacattgtataaaaaattgtaatcatgcttgcgaggacatgaagaattggcaagaatacatttaaagccaactgaatgggaaaaggtctgagaaatacagggtgggagggattgaggttagttaggaactaagcaaatagcacatgttaagacagcagtttgtatattcatatctaaattgaataaaggttgagtaaaatcattttcatagatgattgtggcttttagattattttagattaatacaagaatattaacagtgtaacaaagaattaactgtttttttagttgtgtgaattatagcaattgaagcattttagcttttctaagaaatttcatctcttaatttttttttatcagattaggttttagtattgccaagatcattattctactaacctttcaatacattgagtctttgcagattacaaaaatactctttatcgtttgccccagtagtgatatttgacagctgaagggttggtaacctttaaagtgaaataacctcatcataatatcatggctgaaaactgacaagatactaaaaatacactggactttaagggccattctgtggagctggttgcagatgtttttgctagagagatttacagacagtgtgctgttaggtatctgcaccgtcaagctgaggagacacatcagacatacaaatcatgagtcctgagaggctggtgtgagggtctgagggtattgcttgcatgctctactggcctatgcctcttgtgctgtcattgaagtgccccaggtgagtctgctttgtcgttctaggttcttggggaaatttccctttatggccgtgttatgaatttaatttctttatcagttactttcctcactgctcccacaaagtagaaacagaagcggcttgtggaaggagcgagcgctgattgcttctctggtgcagcaaagacaccatgactaaggcagcttacaaaagaacttaactaggctcatggtccagatggttagcgctgttgatggtggaggttgatcagcggcacggcaggcaggaacagctcagactatacctcttggtccaaaagtaggagggggggagagagagagagagagagagagagagagagagagagagagagagagagagagagagagagagagagagagaaagaacaactggaaaccccagtgtcacacctcctcccaaagccctgtctcctaacctaatccttttcctatgcttgcacagctgggaccaagtgtccagacataggaacctatgggagctcttctctttccaacactacgggttcatttgggcacatagttcaagaatagagcccaccattgcaggaaggtgtggagagaaaggctcgggtgagctggccaacgtgtacccagtcaggaagcacagggtgatgaatgctgttgccccgcttggggatccatttaaagcaggtcttcccacttcagttagcctgggaaaccccttctccggtgtaagctgaggctaacctcctgcctgatgctaggtctcaccaagctgatgatattaacctcgcagtgtccccggggagagccttgatacaggacctgggaagtatgaagaatggtaacacaggatggaattgaaagtctctgagacttgcagggatgtttcagagaagtattaagaatgaagaaatgagccggacgtggtggtgcacgcctttaatcccagcacttgggaggcagaggcaggtgaatttctgagttcgaggtcagcctggtctacagagtgagttccaggacagccagggctatacaaagaaaccctgtctcgaaaaacaaaaaacaaaacaacccccccccccaaaacaaaaacaaaaaaaggaatgaagaaatgccatgtcacgggctgtgatggagtaataaagctttcagtgacatgtgggactgattgggtattagcagagatttcatagggcaaggaagaaaggtcttgtctctgtgtggtgtatgtgtttggtacatgtggtatatgtttgtgtatgtggtatgcgtgttcatgtgtgttgtatgtttttgtatgtgtacatgtgtggtgctggtggtgtgtgtgtttatgtttgtatgtgtggtaatgatggtggtggtgtgtgtgtatgtgtgtttcagagattggcattcattgtctttctctactgcttttcatcttattttattgagacagggtctctcactgaaggtgaagcctgtcatttctgctatacttcctgagcagcaaaccgcagggagctgtctccccatcctttcccttttgctgggctatagatctatgtcctttaaatgggttttcagtgggtgctggggatctcaccacccatggaagcctgacttgtatgtccacaggagattgatgtcacaacccacttactgtactcaaggcttcatgtgttcaagtcccttctgtaatatggaatggtgtttgcatgtaactcacacatcccttcacattgatggtgtgtgtacctgtgtgtacatgtgtgatctctgatgatttcttcacctttctcatgtgtgaaaggaatttttcatgtgtgatatggcaatgtttaatcattgcatatttagattgtctgtgttttatatacatgtgtgtatttgtgtatacatgtatatatgtatacatacgtgtatttgcatgtacatgtacagctgtgtgtatccatgtgtatttgtttgtatatgtacagttgtatgtatactcatgtgtatttgtgcacacatgtacagttgtgtgtatccatgtgtatctgtgtatacatgtattactgtatgatcactcgtttcaatttatctttctacatgttaatttttcatgtttaaaacaggactatttactcataagttatgtagttccatgtgtgtcatgtgcatggtacagatataattcacattgtatctggctgcaccaggcatgtaccagagcaccgggatcatgtcataacagcctgtcgggaacttgccttttttgttcccgtacggatccccttgaagagttgttgtgttcggtcctgtgatctcctttcacttccaggtgctttcagtggggccatcaacagctacctcttccccaagctgagctagctgacttacagacctgcaagtcactgtggatgcatgctgcttgggctctaactgaaatccaattagaaatgtaagtctttgccccagggaggactggcgcccaagaagtccacgagatgacttttattttaggttgaacaaagtaaataccaagaatctctgtacggaggtgctaatccaaatcagcagagaaaattataaaggaaacaccactcatatttgaaagatgaaagggttttgaaaaatgtcatgtaagaaataagattttacagctgggtatggtgcacatctttaattccagtaccaggaggcagaggcatgtggatctttgtgtattcaaggtcagccttagtctacacagtgagttccaggagaaccagggctaatgtagagccagcctgtctcaaaaacaaaacaaaacaaaacaaccccccccccccaatgaacagtgtgaacagtgcttcatcaccgtcctccccaggctcctcaggtgctctcttgttcacacctcttatttttcagggaagcagcagccccctcgagcccgttatgtatattttcgtacacttactaccatctgactcgacatggctttcctacatacggttaaatccataatttaggatttccttcttgtcatttcttacagaaatataaacctcgctaaaacagggattttatctgaaatggttgtttggagggtggggagatggctgagtgggcaaatgcttcctgtacaaacaggacgatgtcagtttgcacccccaggaacccacatgaaaaagccaggagtggtggcttggatctaaaactccagtgctgggaggtacagagccagcagagatgaacagatccacggacttcattggttaagccatctagccaatttgtaaggactaagttggaacaagttcacacctcatgatcacgtgtgtgtattgatgcatgtgtcttcacagcacagtcatgtctccccatcccgtatagattgttgtgtgactgtagaaaacagtgcatggttatttctcagaaaccaaccatattatctccagttgacatctacatgtatgcctagaagaaatgaaaccaggaacttgaaacacacgtggacagtaatagcagcaccattcacaatagctgatacgcaagccagctcggatgtctgtgatggattgtgatatgtactttcaatggggaattgtattcaagtataaaaaggagcggggttttggtatttgctacaacagagatgagtctcaaaaacattatgctaagtaaaagaatctaggcacaaagggccatgagttgtatgattctaacttttgaattgtccaaagtacatttatctatggagaggggaccatgaaatgacggattctgggagcgaaggggagcagggagaaagtatagaatgagtgtgggctctgcctttagaataataaccgcgtctcagaagtagattggttataccacgttgtgaatatgccaactctcacagaattattcagttttaaatgattaattttatgtcgtatgaattttgccacagtctgtttgaacagttgaagaatagatgaccgcacatggtcatttgtttggatagcctgctgtgagttagttattgtgtataaaatttccaatttctagctattttctgagaacaatgagagggtgggagcaagcagtgattacaagaaagcatctgtagttctctctgatcctcgactgacatggacccacttattaatagaagtcattctgaaagtctggtgcagtgtgagggacagcggagaaaggttgctggtgcattgagtgctgtgtgcaggcagtacagctcatcaagtgcagatatgctaattctccgttctctccttcccaggggactgcttgcctatgtgacagagctcatttcatctactcttccttactttgacctattgtagagccgacatcatggttgaaacccttcaggttgagggtgcaggagacacattgtggctccaaaccaacctttaattggatagagctagcactgttgaatgacacaagctttaattggctagagctagcactgttgaatgacacaagcttgctgcctagggcacaggggagagggcacccctgagcaccagctcaggttcagtgtcatggtctgaggactccatgcagtgctttcccctcaggcaggtttcctgtgccgcagatttcatcccacagcggtcctgacttgccagtgattggcatctacagactgtctgctggttgctcaccggagtgcagacacacttgggttattacaaatcacagctttgtccaagtaggctcagccttttatgcacattttcccgagtctcttttcagtgtgtcgtcacatgtgtttaattattagcagtatcttactgttgcaggcaaatctgaaacaatcgagggagtggaagctgcagaggaacagagtcagtgacagggacatctgtgctatgtcacttgtcatgttggtgacaggaacaagagttacaaagaaccctttttaaatgtgccatcttcacacagttctggctttacgtgaagcaaattgtataatgagatgcagtgtctaatgatggacagaacggattgtagcacagtgggcgaggaatagggtctgaacttgcagatccatctttccagcaggacaaattgccttggaaaataaattttcctcagggttgctcaatccagcatttagaaagtgaggatgagggggctggtgagatggctcagtgggtaagagcacccgactgctcttccgaaggtccggagttcaaatcccagcaaccacatggtggctcacaaccatccgtaatgagatctggcgccctcttctggagtgtctgaagacagctacagtgtacttacatataataaataaataaatcttaaaaaaaaaaaagaaagaaagaaagtgaggatgatcaacatgttctctagccagtgaactcttaaaagagtaaggcctactgcctgcatagtgagctcagagctgcattctggcgtggagtcagaggctgacatccttttaagtcagtggtttgaagagaagtgagaaaggttgccacagtacttcttgtgtgcagctgggagcagcagactgctcttcccttcagcatgcccctctgggttctcactgctgtctacagttagcctgagtgaaaactcttcccagagcctctggaaccccagcccatgacttacttagctcttctgtgtatgcaaatgaagtgctgtagagatgtaaataaaacattgacttagcagtcatcagactgcaatgtgctagagcaacgtgccagactgcttttgacaagcagcaagaaagttgttttttttccttcagcatgccaaatactaattaattttcagaacgtttcaagtttccaactgcatttttctgtctttgtgccttgagaatgctgccagaaagttgatggtgaaaatctttacttttttttttaagattcatttatttattttatgtgtatgagtgttctatctgcatgtacacctgctttccagaagagggaatcagatctcattgtagatggttctaagccactgttctctggaaattgaactcaggatcaggacttcttatccactgagccatctccagccaccagaaaattttacctttatggtgggataggatctatggcttaggtattgtgtagctcagttatagcggggctcagttataacatagctcagttatagcagggctcagttataacatagctcagttataaaggggcccagttatagcaggacccagttatagagggggctcagtcatagtggggctcagttatacaagaaactggtatctggaagtgtgagagttgactatgcacagtgcttgtttccaatgctcattaagcaacaagttcctcaggttgctgtggtattcatagtgattgacagccatatctgaggctgtggaagtctgcgtgttggtagcccttgtttggcttccctctgtcttctgtggtgcgaatttgctgcttgtctttttctctccttcaagaagaagatgcccagtctcatgggtgacgatgcatttttttattgcttcacttatcatttcttatgttactcagttagcatcttaaagttatgaatgagttctatttaagcagccttgaggaggagggggaggaaaggatttgatatgacggatgtggagaagagagactggaggagagtctgtgctgacatctatgatggtttctctgtgagaaaccgagaaaccatcctgcttgtaattagcggtgtataccaagggaactcttgtccattgtttgtgaggggtttggttggtcagcctgcactctggttgggtgcatcataattgtatgaagcataacagaagggtgttcatcttccatgcctgtccatacatgatggtgctttaacttgtgctgtttcttgtggcttattattaaccctttagtatgccacagggccaggaatatgatgtggggaagtcagaagcagcacagtggtctgtgccctgcttctcgtgcagtgacagcgaggtgaatggatacacaaacaaacaggtgtgtttcatgagacacagtggctcatgcttataattccaagacttgggaactgaagtaaaaagatttcccatgggtttgaggctaggctgtctgggtactgaacttctacttcagtttaagactgtctcaacaaggggtgaaggcaggggagcccaagaagacaggaagttaggatgatagatatagcatgacctgagaagaatgtttagttgggttcatcagaggtccttgagaaagtaagatattaagcctccctagtgaactgtggccgaaggagctgtaacagctgcagtctctcagagattagataacacctgtctcttttttttaattatggagaaaaatgaaatatatatatatatatatatatatatatatatatatatatccccagaggttgtgtcttcaaattttgagagtaacactgtaacaacaaaactagaaacatccaggggtccactgggagagtaaagagaaagttaaacattccagggaagtgactaagctcaagtttgtaaacaagcacaagtaaacaatacactgttcagaataatacgatgaaatgatgtaacaaatgcatgggaattgataaatacaccattagggataaaagttcctgaggtaggcagcaggtagatggggcagtatcatcatataccagatactagtaactttctgctctagtatttctagacttcagtattctacttaagagaccttacttgccaactatatgattttggcactcacaaggctaaggcaggaaggaggattgctagtttaaagcagtgatagtttggactacatagatatccaggcctgcctgacctatgtaataggactctatctcaaaaaagccaaataaatttatgaaaacataaataatgaaaatttaaaaggctcttaaaaatttttaactattctggctaatatttcttctgctttgttttctcttttgcgatgctaaaaattaaacctagggccccgtagctttaggcatggtaggtaagcactctactattgagtgagattgccagccctgttttgaaacagggtctttctgtgtagcccaagctggcagagaactcaaaaccttcagtcttttgtctcctgggctaggagcacaggctcttaccaccatgcttggcacgtggtgggttctgtgcagaatcgtctaggtaaaagaggactgagttcatcccaagcaggacttattgtaacttgtagaaaacaaaacaaaacaaaacaaaacaaaatcctaggctaggcctttcccttgaaaaagaattctgttttctagataatgtggtacatacctgtaatattagcacctagggcctgaggcaggaggattaccatccttcaagtccatacaggatacaaagtaagaccctgtttcacgacaatttttttgtcaatgatactcagatctggcagtctgtcctgagtgctagggcttctgattgctgactttgtggcccttcattccccatacccgtaagcctgcccacaggagcagcgtttacctcacagctgaggctcccctccgtcccctggcagtctcttctcttgctttgcagtttctattatccatgactccttcatgagattgatcgcttttccttggataccacttccttgtctttctgggcttttccttcggtgggcatgcccttcccattctcaggaattctcttcctccttctccttttattttcaatgtattttaaaaaatatttttatttttgagattgtgtcttaatcagtgttctgctgctgtgaaaagacaccatgacctctacaactctaaaggaaagcatttaattaattaggactggcttacattttcagaggtttagttcattatcatcatggtgggaagccttgcgcttgagaaggaatccagagttctacatctggattagcaggaagcaggaagtgaattgtgagcctgggctgaagcatctgagagctcaaagcccacctccacattgatgcacttcctccaacaaggccacacccaccccaacaaggccacacctcttaatagtgccactccctatggaccatgtattcaaatacaagagtctgtagggtccattcctaatcaaaccaccacaagttgtattttattttattatatttctctttcctttcctccctctaaatcttcccatataccccttctcactctcttaaattcatggcctctgttttcctcactattattgcatgtatgtatatgtatgcacatatacattgccaaataagacctgtttggtgtgtataatgctacgtgcttgtgtgttttcaggactaattgcttggtacaggacaaccaatttgcgtgctcttccatagggaagacccaactctcccaattcctctccttagatgtctctcaagctctccatgtggggttgagggttttggccttatggtctcttcatctgtctctgtctttgtctgtctttctatctctctctgtctccatctctgtctctgtttctccctgtctctttctctctctctctctctctctctctctctcacacacacacacacacacacacagacacactgttatgtgtgtgggtgttttgcctgaatgtatgtttgtgcagcacttgggtgtttggtggtcaataaggccagaagggacatcttattccctggagttggagttacaaatggttgtgagcctccttttggctctggaaacttgagtctacatcctctgcaagtgttgcaagtgctcttaactgctgagccatctcttcagctccttaaactaaaaaaaatacttgcttatttttacttctttttttttttttacattttcttgatccttgccccctttgttactgttctagagacagtctcatacaacacacgctagactggatctgttcttaacaataaaagaacttccgggggagtcaccatccttgagctcaatctgtattactacagagcaataatgataaaaactccatggtattggtacagagatagacaggtcaatcaatggaatagaattgaagacacagaaataaacccacacacctatgggcacttgaactctgacaaagaagccaaaaacatataatggaaaaaaaaagcatcttaagaaatggtgctggtctaactggcagtctgcatgtaggaaaaatgaaaataaatccatatttatcaccttgcacaaagctcaggtccaagtggctcaagaacctcaacataaaatcagatacactgaatcgaatagaagagaaagtgagaaagagccttgaactcattgacatggggaaatgtcctaaatagaacaggcatagctcagatcaacaattgataaatgggacctcatgaaattgaaaagcttctgtgaggcaaaaggcacagtcagtaggataaaccggcaacctacagaatgggaaaaaaaaccttcactgaccctccgtctgatagagggctattatccaaaatatataaagaactcaagaagcttccaaacaaccaaacaacccaactaaaaatggggtacagagctaaacagatttcacaacaagaggactctcgaatggctgagatgcacttaaagaaagtccttaatcatcagggaaatgcaaatcaaaatgaccctgagactccaccttacaccaatcagaatgactaagatcaaaacctcaggtgacagcagatgctggggaggatgtggagaaagagggacactcctccattgctggtgggattacaagctggtacaaccactctggaaatcagtctggaggttcctcagaaaattggaaataggcctatctgaagacccagctatatccaaaagatgccccaccataccacagggacacatgctcctctatgttcatggtggccttggttgtgatagccagaagctggaaacaacccaggtgttccacaactgaagaatggatacagaaaatgtggtacatttacccaatggaatactattcacctattaaaaatgggatatattctttaaaaacctcttgatagcatttctttgggccatcctgacaatgtgattcttcagctcttgtctctctctctcctccccctcccctatctcccccctcccctatctcccctctccccctcctctctctctctctttctctctttctctctctctctctctctctctctctctctctctctctctctctttctctctctccctatagctgtatttgcctcatgtattagtcagggttctctaggctcacagaactcatgcaagatttctatgtcaggatctgggtcagaagcctgtgtcttccagcctcaaggtcacaggtatggccttcgtttctggatcgtccttcattctagatgtcaagctgacaacctgtaacttcatcaaagccctttgtcgaattgtgatggcaatctccgtgatgggtctggagcccaaaggctaccctcagaaggttatatagacagaggtttcaatattgttattcagtctacagttggtgagaaactaggatgtgactgtacttatgcaaagccttagcttggttccaagacctcatgaataagctgagtctcctccacttttcaagtgccaggttgggttttcactggtcagtatctctataacactgccaaggaatgactagtcttctaggagtgttaacttttttttttttttttttttgcaaggacttctattttatcttcttcctgtgtaagcctgaccttcattccaaatatcaaatacacttagtcttgccacttccaagctttggaaaaaacttgaagtgatacattgcgtatatctcaactttccccactggctccagttttatttctgccaagtcattttgttggttctgctaagtcagcagtagctgttatgcggagttttcctcagaactaatcacctgcctcagaagatgaggtctacctgcttgcaaaagaccatcccaggtgtgccttttgagagttgaattctcttataccaggaggaaagtcgtggaatcctcgcctgagtcactagtcacacctcctgaccactaatatgaatcaataagtaatctcacatggcatcctggtcttgggaagggtccagagtagacaggttgggaagaatttgcagaggggagtctccatctatgaagccataaagaagccatcacccatgctgagcatacacctttctatgaggcctctcgcttgtatttttttaaagatttatttatttatttattattcatgagtgctgtgacttcatgcacatcagaagagggactcagatcctctccatgttgcaaatctaacctctcagtactcatttagttcccatgttattccttcccagttggcttaagcctcctctcattccttctcttaccatgtagcccatgctgaactcacagaaagccactggttctgtctcatgagagggctgggcttacatgaccaggcctgaccacagacctcctgttacattgcctccctactgaatttctcctgttcagatttggttgttgtacattccagtcacttccagtttctttctttcaaatctaccttttctttatcttgtttctttagggctaaaatataaaattttattctattatgtggctgacaaattcatgctgatatatccagctgttgtaattatattggagaagtctcccaggtatagacttgcattttaagacagcatattttagaagcagcctacccaaaggcttctgcagagattttttgtgagtttttttaaaaaagatttatttatttattttatgtatatgagtacactatagctatacagatggttgtgagccttcatgtggttgttgagaattgaattttaaggacctctgctcgctctggtaggctctgctcgctctgttaggctgctgcccactctcccaacctccccccttctcttgcaactcccctccccccttggttaggtaaaccctgctcgctcccacctaaagatttatttactattatacttaagtacactgtagctgtcttcagacacaccagaagagggcgtcagatctcataatgggtggttgtgagccaccatatggtttttgggatttgaactcaggctttggaagagcagtcagtgctcttacccacttagccatctcgccagcccaattttgtgagtttttaatctttggggacaaagtgtttcgctgctgaagaccatgctttcttttctaatgacccttcacagcccctagtagtgtctctctattgggtttccttgtacgttggctaaaactctggttagactaagcagaacattgaaatttgcaacattggtttattctgtgacttggtggcaagatgtgcaagttggtgcacgacagaatgatacggaaagcagtttagagtgcaggcccttgtctatctaaggtcacccagtgtttgttttctgtttttatttaatacattaccacatatttagtggcttaaaaaacatagacttactttcataaagatctgattgaacctaacatggtgttgtacacctgtaatcccagcacttgggaggtagaggtagggaacccatgaattcaagttccttgttagcaatatagcctacatggcaagtttgaggtcaaccagagctatgaccctatctcagagcaaaaacaagatcaaagatctataggctcagaagtccaaagtcattgtcaccacatctcagatccaagtaccttggaaagctgcatttcctcaggcagccctggaaaggacttgtttccagtgttcatagtgacataataacatcatgtttatacacctgagatgggaaagcagccaaacacaagtggccttgctgtagaaacacaagttatctagatcaagatacctccccagaagacatggtcattctgagaagagatttcacaggtgccagagctccagaaaggaaggtgggctcatcaagtacctgaccactgtgaccctgctgcgctgtccagatgtgctgagctcagcaagtgagaagggcgcctcctccggggattcaggtgcacttgccttcccagccttcagaggcctggcaaatgctttacccagcagtgacagaagtactaggtgggagctgaaaatgatagctgtgcaaatgaactaaaaggggccccgaataaccttgacatctgtgtctgtttactgtagagcattgcattgccacaggttctggtgctcaggcagcaacatgcaaacaatgtggatggccttgagttcaagtcccgtgtctctcgagaaagtcagctcacagattgctaatcttcattgccttctagagccactgcttcctgccattctttacccatgtcccttccaacctcaaagcagcatgacatcttgcttcagtcaccacattgtctactggttctgcgataaaatctttccgtgtttccattgtaaaatgcatgtttatatttagggcccacctagataatctagactgtttcctctatgaaactcttttattttgtctaattactcagtttaccatggtgtccatagctggtccatgtagaaggcccctcttggttgcctgaaccctgtttcttcaataacaaggtagggaaagacagttttcctctactctctaggtctcctatccaggtgtgatttaactcatggaaagacaaacaggagcaaagacagacagagggaagcacagtcaatttattttgctctagttttatgaaacaggggtcttcagagtctagaatccaaggcccagggaacactgtctgttttcacacttaggaatagtgagccttggaggcatgtgatcagattaaaattgggatgattcaacagcagtagagagaaagggtttgggggacccaggaatggctctctgtatgactaccctcctcctggatatgggctggggcccttagaaggaggttcagacttccagacaatctaagttccataatttctttacaattggcacttactaagaaagacagagaaaagtttggagtaacatttctagttttttttttctgcaaaggttgtgggcccaatctctataacttacttagggactatcaattctggtttctatagcccactttatagaataggggtcatgataaagaagggcagaatagggtcatggtaaccctctgtccaagctcctttccttccattgcaagtccccaagtttttcatactctagagatcatattctgagcctcaaaatatctacatgacaaagctattgttaggtctcaggtttacaaaagaattgtgagtattaagctcccacagaaggtatttggaatccttggtttgatcagatttccacccaatcctggactagtctggattcttcaaaatgtgttacacttttcaacttgttgaaggggagtagtttttagacagaaagaaaacacagagaagacctcatctgaggttattgattcagctacaactaaagataaaatatagatcatgttctggaatatacgaagcgttttgcttgtattgagccaggtgaacccaacaagaaacgataagatacttattgattatcattattttgctctctaagccaaatgataaacggaggcagttccagagtcctgaaaatgagcagtaacctcttctgtatgtgcagaaagaactcagagatgattgtgtagtgtagaggaaagtctagacacagataatcagtagatagttgctactgcctgtgtcttcctcatgccttcgacttaaaaccatttgccatcgttgagtttgggattgcagacctgtgtttgaccctgaagaccccctccagtcactgcctcggcatttgcaggccagctgggatcggcccctggggagccattcagttctttccagggagaattatgtttgtaacctaaatcatgctcacattccttctggatttttggatatgagatcacatttgtttctagcattcttatcttgaactttattttgctaaagaagtagatttcttctgtgacctttgagatttgctctttcttttctgattacaacaagaatactaagattttacatggtgaaggcatatttttatattttattgctacacacagttcccaataggacagttgcgtagtaaaaactagtttggggattaattaattgatgatacttgtgatagaagaaaatgaccatattcaacagtatactgttattccaggcacaaacttctgaagaacatagcttcttctgagttggctcacatgatgtgcctagttcagctagatgacaatagatcaacaagcacaggattactgtaatattgaaagctagtattaaaatgcaacaagagctccagtttacactttttactaaatcttcaagaattgcaaataataaatgaaataggtttcacactagcagaagcaaatggctgccatatttggaaaagggggtgatgatcttcccggagtggtctgtgttaagcagtcactttgtgtctcccttggatattgttcagcaaggtcgcagcagatgtggcttagctatttatactgggtgtgataatacagattttaggaagtaggcacaaaaagaataaagtggtttctgttaggaaaccaatgaaggatgaagggttggcgctgctcaagacggggctctgtaatgtgcaatagatgtaggtgctgacccacaagtgtgtggaaagtgccagtctctgaaaccatctgctgcaatgcatttatattagcaaattacagatgtaactgtggccgtgcagggctcactgtgtgctgtggtgctgtctgccagtggggtgccaagccaaattgcacattcttggtactgtgtatgatttcttaagatgtattacacatttgctatgccctcccttaataatgtaccactaatctaacacattaatgccatgccacagtggaattattcatgtccatacctgcaggtcagaggatctcaagaggaaaggactcagagcatcagttctccactgtttggtttccttcactcacaagttaggggctactgctaaaaacaatggaatctgactctcattatggcagaattgctgcctgttttgactgtgggtaaaagcttttatcaaacgacccaagccacctgccttccattctcagaatcgagaggggagggagagatacgactcctgaggttccctctgacttgtatgtatggaccaggacacaactcctaaaacctagcaaataaaaataaataaaataaaacctattgaaaaagaaagaatccatatattgtttgtatttgtttattttattattatattgaattatacactaggagcaaacttttaacagaattctctgtgaaattaagacaatactaacatcaaatattttgtatgcaataaaatccaaatatgttaattcagaaattagaacaggagttcattacataaatgatattctacaactctccattgtactcaatgttctgtaacattctatcctactcagtgttctgtaacactctatcctactcaagagttctcagcactccatcctactcagtgttctgtaacactctatcctactcagtgttctgtaacactccatcctactcagtgttctacagctctccatcctactcagtgttctgtaacactccattctactcagtgttctgtaacactccatcctactcagtgttctgtaacactccatcctactcagtgttctgtaacactccatcctactcagtgttctgtaacactccatcctactcagtgttctacagctctccatcctactcagtgttctgtaacactccatcctactcagtgttctgtaacactccatcctactcagtgttctacagctctccatcctactcagtgttctgtaacactccatcctactcagtgttctgtaacactccatcctactcagtgttctgtaacactccatcctactcagtgttctacagctctccatcctactcagtgttctgtaacactccatcctactcagtgttctgtaacactccatcctactcagtgttctgtaacactccatcctactcagtgttctacagctctccatcctactcagtgttctgtaacactccatcctactcagtgttctgtaacactccatcctactcagtgttctgtaacactccatcctactcagtgttctgtaacactccatcctactcagtgttctgtaacactccatcctactcagtgttctgtaacactccatcctactcagtgttctgtaacactccatcctactcagtgttctgtaacactccatcctactcagtgttctgtaacactccatcctactcagtgttctgtaacactccatcctactcagtgttctgtaacactccatcctactcagtgttctgtaacactccatcctactcagtgttctgtaacactccatcctactcagtgttctacagctctccatcctactcagtgttctgtaacactccatcctactcagtgttctacagctctccatcctactcagtgttctgtaacactccatcctactcagtgttctgtaacactccatcctactcagtgttctgtaacactccatcctactcagtgttctacagctctccatcctactcagtgttctgtaacactccatcctactcagtgtgttctgtaacactccatcctactcagtgttctgtaacactccatcctactcagtgttctgtaacactccatcctactcagtgttctgtaacactccatcctactcagtgttctacagctctccatcctactcagtgttctacagctctccattctactcagtgttctgtaacactccatcctactcagtgttctacagctctccatcctactcagtgttctgtaacactccatcctactcagtgttctgtaacactccatcctactcagtgttctgtaacactccatcctactcagtgttctacagctctccatcctactcagtgttctgtaacactccatcctactcagtgttctgtaacactccatcctactcagtgttctgtaacactccatcctactcagtgttctgtaacactccatcctactcagtgttctacagctctccatcctactcagtgttctgtaacactccatcctactcagtgttctgtaacactccatcctactcagtgttctgtaacactccatcctactcagtgttctgtaacactccatcctactcagtgttctacagctctccatcctactcagtgttctgtaacactccatcctactcagtgtgttctgtaacactccatcctactcagtgttctgtaacactccatcctactcagtgttctgtaacactccatcctactcagtgttctgtaacactccatcctactcagtgttctgtaacactccatcctactcagtgttctgtaacactccatcctactcagtgttctgtaacactccatcctactcagtgttctgtaacactccatcctactcagtgttctgtaacactccatcctactcagtgttctgtaacactccatcctactcagtgttctgtaacactccatcctactcagtgttctacagctctccatcctactcagtgttctgtaacactccatcctactcagtgtgttctgtaacactccatcctactcagtgttctgtaacactccatcctactcagtgttctgtaacactccatcctactcagtgttctgtaacactccatcctactcagtgttctacagctctccatcctactcagtgttctgtaacactccattctactcagtgttctgtaacactccatcctactcagtgttctacagctctccatcctactcagtgttctgtaacactccatcctactcagtgttctgtaacactccatcctactcagtgttctgtaacactccatcctactcagtgttctgtaacactccatcctactcagtgttctgtaacactccatcctactcagtgttctgtaacactccatcctactcagtgttctacagctctccatcctactcagtgttctgtaacactccatcctactcagtgttctgtaacactccatcctactcagtgttctgtaacactccatcctactcagtgttctacagctctccatcctactcagtgttctgtaacactccatcctactcagtgttctgtaacactccatcctactcagtgttctgtaacactccatcctactcagtgttctgtaacactccatcctactcagtgttctacagctctccatcctactcagtgttctgtaacactccatcctactcagtgttctgtaacactccatcctactcagtgttctgtaacactccatcctactcagtgttctacagctctccatcctactcagtgttctgtaacactccatcctactcagtgttctacagctctccatcctactcagtgttctgtaacactccatcctactcagtgttctgtaacactccatcctactcagtgttctgtaacactccatcctactcagtgttctgtaacactccatcctactcagtgttctacagctctccatcctactcagtgttctgtaacactccatcctactcagtgttctacagctctccatcctactcagtgttctgtaacactccatcctactcagtgttctatagctctccatcctactcagtgttctgtaacactccatcctcctctgtgttctacagctctttagcctactcagtgttctatagcactcccttctactcaaagggccatttagtctacaggcacagaggagggctggagacatggctcaattgttaagagccctagttgctcttacagaggaaccaggtttatttcccagcacttatatacaagcagagaaaacaaacactcctgcaaataaaattatttagtattttttcattgaaaaagggggcatttgtagagtgtaaaccttacttgcgaataaccttaaaaggaactatatattgttttatatccattctctatccattattgaaatttaattgattaatagatagtgtagtatacaaatttttaaaaggcaataactaaacagtattccattcaaataattatattgcctataaattcatataagtaaatcaactgattaaggatgggactttctgtaaacaatgtaggcatttctgtttttagataaggaagtgactattatgtcaaagatggaactctgcctcagaaaacccaggtcccaaggggtttttagttttcgtttctttcttttaaaaattttttttgaccggaattagttttgatagaatagccattagttttaggattagactttataattttttttaatcttcaaagtgataatgttaaaattattgagaattactgaataaaacctacatatctttctagggaggctgagaagaaggattgcataatttctagtaggagtttataagggctggcaagatggctgagtggtaaaggcaattgctatgcggggagacagcccgtttcactgctggtactcagagtgagaacccagctcccagagttgcctctgggctgcagggatttgccagtgtcctccccttcccctgcatcgggcttgtgtgtgtgttgtggagatctgaactcaggttttcatgcttgtatgacaggtacttatcaactgagtcatctcccaacacccgtacccccttttcttaaggtgggttcttggtttgcggacccttgactcttctggttgtagctgtagggatgatagatataaaccaccatcctgagcacaatcatcttgttttgataattacaggagagcatcctgtggcatgcactctgatagatctctgctgctagcacagctttttcatgctgatggaggtttgctcgctcatttctattgcctagtatagaaaacaaatagtatgggtcatattgatggtttcaaagatttatgagacattaggcataatagttcatgccaggagtctgagctacttgggaggctgagtcaggatggcttaagctcaagagtttggggccagcctggggatgtgtagtgagaccctatcttaaaaaaacaaaacaacccccctccccccccaaaaaaaaaccccaacccattgtcttagtcagggtttctattcctgcacaaacatcatgaccaagaagcaagttggggaggaaagggtttattcagcttacacttccacattgctgttgatcaccaaaggaagtcaggactggaactcaagcagggcaggaagctggagctgatgcagaggccatcttgctcagcctgctttcttatagaacccataactatccgcccagggatggcaccacccatagtgggcccttctacccttgatcactaattgagaaaatgccttatagctggatctcacagaggcatcaaatccagcctcttgaagtggacaaccccatgacttatataaccagtaaagtggtgtcttcatctctgctgtgtggctccagaaacttcattcattaccagacaggttttgccctcccagtctgtggcatccttacttactttctacctgcatggactttccgtccctgggtattctgaataaatgtaattgtatagcatgtacccatttcctgttaaccacaggataaagggatttaagtctagaggtatccccttttttaaccaggcaaaattgagcactctacatcccggagacttggtgagatgtgagaaagttggtgtagtgatcttcccaatcaggtgggacgaaggggttcatgaagctgctctcgtgagaattctgagaccagttgaaggaccagttggaaagggaaaatgaggaaggacttttaagggctgggcatagagctcagtgccacctccttgccaatcaggcacagcccttccttaatccccagcactggtaaccagctcccccccccccaaaaaaagagaaaaataacagaggaagaaaaaaaacccatttatttcagatataaattccttcttgtttgtctgttgttttgaaatagagctatactctagcctgagcagactcatgacagctctactgtcgcaagtctgtaactgtattttgatggcctggcggttcaaaatttactatttagtattacagcgaactgcctacctctagctattgaccctgaaagtcgcttctggcattctgtgccctgccagcagctgcgttctgaggcctaggtggcaagcgtggttttgtagggccttgtggatcattctccaaacgtgtcagtgagttcttgtccacatgcgctcttagctgaatgcaaagctcttcatgatccgaactgtcattgcttaatttggtaatcaggatattcatttttctgaccagttcacgcacctttagagcaggaacacaaagctgtctctgggttctctcttggccagagtggcagcagttttaaaaaaatctgcatctgaatgttgtgactgcctcactgaagacagcctgtcagcctggcagctccaagccggttatttctgcatcttacccctttccaatctcatgttttgacaaataagattgtacttttgacaagtgatttctagttcatctaagaatttcaaagtgttttaaatatgtttattaaactatcgaagacatcttatcttctcatctttggtagaacaaaattttcctgataagaagtaagacagagcgtgataggactggcatccctgcaattaaaaagtgttttagacagtaattgtttttcttttctttcacaataattattgcttagttttcagaaacatttctgtcaattcttctgatttagacctgagtgttcttgaataatggacctttctgtctgtctttcttgatctctctcctctcctctcttctcctttcccttttgtcctgtcctcccctccccctccctctctttccccttccccttctccctctccctctcctcttcctaggcagacttggaactcactggcctggaactcagtatttaaaacagaactcatggctgttctccatcatcagcctccttggactgaatttataggtgtaagccaccccaaccaaaagtcttattgttaaagcaaattctatgtatttaatatcattatgtaactgaaattatagcttgttgttgtggttcagcagatacttaatgatgactgtgctagactgtttcatgtcaacttgatacaagctgaagtcaccagagaggagggaacctgatttgagaaaatgcctgcatgagaaaggtctgtaatcaagcctgtagggcattttcttgttagtaagtgacagggaagggatcagcccattgtgagtggggccagccctgagccagtggtcttgggttttttaaggaagcaggttgagcaagccaggggaaacaaggctgaaagcagcaccctccatggcctctgcatcagtgcctgcctccaggttcctgccctgcttaatgatggcctacaatgtggaagtagaagccaaataacccccttctaccagcaacgtgcttggtcatggtgtctgatcatagcaatagtaacctaactaatacttatgctgaatctaccccaaagtctggatccataatgatgaacaattactacttatagagcttacatattcaaagtaaattatgccatttcaaattgattgaaatttatttatttatttatttattagacggactttcactatggctctaaatacctaggctcaaataattctccttcctcagtctcccaagagctgtgactgtagaaatgtatggaaggagcaaatggtggcctatctgggaaaacaatactaaacaaactggagtgcagaaaagaaaattcctgttttccaggaagaatgtttgcagatatttgcagccactgaggtcatgaaggctggtttggctgcagcagagagaaggcaggtactgtgagaatgtgggtaaaaagtgtagaacatgggaagggcattaatcttctagttctgttctctctctctctctctctctctctctctctctctctctctctctctgtgtgtgtgtgtgtgtgtgtgtgtgtgtgtgtgtgtgtgtgtgtgtgtgtaagaggagaggagaagaaaggaaaggagagagatcaagaaagagagaaagaaagaaagaaagaaagccaaagattcccttgagtatcttcgttgctctcagcctttttttataatctgacgattacatgcatatgtgtgtttgaacctttctcccattgtctcccttgctattcttcctccacagcttttccctcctcatgggatttgtttttctaaactgctgagtctacttagtgttgcctgtgtgtgcatgagagtaggccagtctctcgagccggcagcctctctggggtcacatcctaagaaagccaactctcagcattggttgctggaccctcagctaggagtggggcctcacgagccacttccccacccctgttagtatgttggctggcttgatcatgtgcaggatttatacatgtgaatggcctctgagttctcaggacgatgtggagattttttccatcttactcagataaggtctcttcataacctggagcttgctgtttggcagtgaacatctgggatctgcttgtctctcacctctagtgctgtggctctaggcatgcaccactgtgcaccacttactcgagtgctagggagcctaacagagaaactcaggctctcaaatactttacacaccgagccatctcccagcccccgaattttactttttatggaaagggaacattgacaccggtcttttactaggagaattgtgtggtttatgttgcagggttgttccacctgatgaagaggccagcagaatggcagctatgatagtcaggaggcccgaggatactgacattaatgaaggaaggaagtgcagagactgctctgcctgcttcctcaaaaaggagagaaaagtctttcacttcatatttaagttttagttctctgaatggtgtgtgtgtgtgtgtgtgtgtgtgtgtgtgttgagatagtgtcttacttctagcccaaggcagttttgaattttctatgtagcctgagctggctccacgctccaatcctgtctccaccctgccagtgctggggtcacagccacgcaccccaagcccagctttgtggtgataacactgttatgacagtggactgactgactacttgccagagagataagaaagccctttctggccagtagccacgtcactgcatgaactggggaagtgagagctgggtttttatgctgagtgtctgtctagttgtattctgtctcggagttcaggcagacggtcgcttgcccgtgtccaccctttcacaggttgttttaaggtgtggagaactcacagcaggcctagaaatagtcttccagtaggacgtgatactttcttgtttttgagacaggatctcatgtagctaggctggctttacacttccaatctctgttcttcaatgctctgagtactgggattcgaggcctatgccatcattcctagtaagatggcatctgcttgttttttggggtgggttggttgccctgttgccctttagtgtctggtattatgtcacgtgaggacaggtcgatgcaggcgtctcgtgcaccctaagcacagctccccacacccggctactcttcccttcctcacattccagctcccatgagctccttccattctttgatgatttcacttttactgtcatgtgatgtcacatgtacatacatgattttatgcatcagtataaaatccaggaaccataaatgcgagaaagtgtggcttttgtctgcagtcacatttgtttttctgcagacgacacaacttcattctttatggatgaaaaaaattgcactgtgtgtacatataaacaacctttcctttattcctctgtgacagacagggatgttggttccttagctgttctgagttgagtagcaaggacctatgatgcccagatacccaccattctgagactgctactgaatgtccagggtgatgactttctgcttctacaatttcattatgtttttttttaatggctgaaaaataattccattgtgtgtataaactgcattttctttatctattccttgtgacagacatggatgctggttccttagctgttgtgaacagagcagcaaggactgatacgcaggcaaaactctaatgtactttcaccgtgaggtgctgcgcattgtctaaaacgctccgagagcactttcctctctgttgcccagcctcttagccatgtctgcctagccagttgctctgtcatgggcagtggcgggagtcaggctgggagatgatggttccatcgctgtccatgtactcctgcatctgtacactacccatagcttgacaggaaaggagtttcaaaaccacagccaaacaagcagtgcagtaaactgcagtggcaataactagatataaatatacaggcttgtccttatagtagagatgctgcatatgtgatcatgtatgtatataatcgaactcactgaagtgttaaaatttccaacatagtaaaatgacacaagatcacacagataccaagtgatggctcgtgagtttgcttcaggcagtattattgaaataaaaattcctttgttaaggacatcagttaactgcccagttaacttctatctggttatgaaggcagctgtagtttttaaaagaatacattagaccagtagggctggttaaagcatgtagtcccagcccttgggagtcagaagcagaaagatcagaagttcaaggttacccttggctatatacctagttcagactagcctaggacataggagatcctgtcctcttccccaaagtaaagatataaccttgttaggtggagagatggctcagcagcttagagtactggctgctctttctgggttcaaatcccagctcctacatagagttcacagctgtctgtaactacaattctaggggactgggaaccctcacacagacatacatgtaggcaaatgcacatagaagaagaattgcttaagattcaaattaggtcttttctcctcttcctctccttctttgtctctgttttctccctcccttgtgtctcagtcctctctgtatctctctcatcttggttctcattcccttcttggagaacttttatcaacctaaagttttatgtgatgttagcatagtctttatagttgtgtttatgaatgtatgtattgatctggatactgacttgtctattaactatatcatgtctgtcatctatcatctatatctacctatctatgtatcatctatcatctgtctatttctactgcctatcatttgtctgtgtatcatctctatcatttgttctctctctctctctctctctctctctctctctctctctctctctctttctctctctctctttctctctctcatctatcagtctgttatccacctgtccatctccagaccacacctcttcctccttgtccccattgctgcatctgtcatctcagtaccttgaactctacaggtctcaagctgaatttgtgatcttcctgttctgactgtcaactatgctttaattaacaaagtgcccgttgtttctgaaagacggtacacattttgcgataacccttaattccttccctcttggcccccttcaccagcaggatctcctaagaagtcttcttttttggttgtgctcccccaattcaaggctccttcactccttattgatttattgccacaaaaacttatttgatcttcctgcctttattgttttcctgttctgtctttcagagcatttacaggattatcaactaaagctcaaatagatttttccagcagcttgtgtgacatcttgtgcaggttcatcactgtagcctaaccctggagtcaggatgaagtctttgggttctggctgacaactggagcctccttcccaccactttgtgtgcacacacacagggagtttagcaacgtttcctcttcctaaaatgggaatgttaatagtcccttttcatgaggaggttatttcatgttatttgtgtttgtgcacacgtgtgtgcttgtgtgtgtgtgtgtggtgtgtgagtgtgtgtttggtgtgtgtgtgcactcctgtgaggcactctcctttatcaccctcatttctttgagacggggtctcttcctaaacctgaacctcatccttctcagtgaggctggcagcagtgagcccagcaatgctcctgtctctccccccctctcctactgcagtgctgggctagggaccacactttgagacgtcaactccggttcccatacttacataataactgcttaactactgaggtgtctctcctgttccaagatgatataattttaaggatataaaataaccatctgagatgttttagtgcatgagtatactcagtgaatgataactgatattggtaatactcttttgtagcattcctagctttctatattgtcttaaaatgtttgtgtgtgtgaacatgtagatgggccccatcttcaagtgttatgtcttatatgccgctcaccttgtttgaggcagcatcgctcactgagacctcggggtttgtgagtaggctggcccaggtgcctcagcgatcctcttgcctcaggtcccgatgctttagcacgtgagctgtcttcccaccctgcccctctttagttttagccatgcagcccacattggcctccaaatgcactgcctctgcggctatacaagtcttccttatgtaactgcagtgcagcctgactcgcatcttagggtccagacctattgggtgactttctaatgtggccgcaatactggccgctcaggcatgggctcctccctgagtctagctcactgtcactcagcctgacctgtggaaactactccagcagccacagtcagattcaaccactcttgggttcccctgtcctaacgacacaagtgcctgatgactccctgtgtcctcatgcttgtcaagtgtggtcctgcactgttggctggtgctggtagctctgcacttccttcctccacctctacctgactgctccttcctccagcacaccaccatcatcctttctgctttggagggaggtgcatagctagccagtggaggaagtgaggcagggacattagagaacaggcagtttccacagccagggggcgtgtggctcactgctgaactgtgtctgtccacagtcaatgtgacatgtctcagtccctacagacccctctccacggtcagggtggtatgtgtcggtccttactgaatcccgaagaatgtgacagcaatgctgacaggcatgttcttagcactgactcattttcattcaggtttgcatagacaagtcgttagtgaaataagttgtgttcactagactggcatgcaccacctgtgtttagggatgttatttgccaagttttatgttaaaaagtcagtaggttggggttagagaagtggctcaatcaagagaactttctgctcttctggaggactagggttcaattcccagcacccatatgctgtctcacaaccatctataacttcagtttcaggggatctgatgccctcttctggcctccatgagtaccaggcatacatgcgttgcacaaacacacatgcaggcaaaaacatatatacattaaataattaaacatatcttttaaaaatcagaaatgccctttagtatcttaagatctgtaacatatattcttggtgctcagttttgagtcttggaagcagtgacctgtggtaacaatagcttcatataaataatccctaatagtgcaagtgcattggcataatggaagcctgtgagtatctcaggtacaaataccaatccaccctttattatataaggcctagtaaataagatacaaagaagaaaaatataaaaggttaagtatggtgttggtatttaaaagcttctagttaatggtcctctattaaatgaaagctaaaacagttactagacttcaggggaagaagtcccacacagactacaaatatgtgacacacagggaagacatgtaaacaatgagaagacatcttaaagctttggataactctgatgtaattaggttgattctcttttgacaggcatgttttggttggcttgttagaatgcttcgggagagttctgagcaaaaggaaatggggaagtttgtagctcctcctgacatattagaggcctcaccaggagtccttaccacctgctcccccccccccccgccccccaatcctggacttgagcttcacatcttcatagcttctttcgtttcagacccggttttcatgtatgcattctgcttgccctgtctgtttgaaaatgtgtgttagatagaaggtcaaaagaaatgtccccttacctctaaggccaccaccagccagccactcatgtctccaggaggggccagacctctaggtctttctttgctgtcaacttgggatgtggccttggatttggatgtggccaggtcacggaaagactctgagcttcagtgttgttatctgtcaaagagtaataatgagccctttaaccatagtgttaaaaaagttcctagagcctcataaaatcagagttaatattttctcttgtattaggtaggttaaaattaaatgctgctttgggctgggcatgatacatgcctgttataccaacagtttgtgaagctcagtcaggatgattaaaggtcagactagaactccaacattcacacacacacacacacacacacagagagagagagagagagagagagagagagagagagagagagagagagagagacacacatagagactgtttgagacagtgagacattccgagagacagagagacagaaagagacagagagagacagagacagacagacagacggacagagactgcttcagccgtgacctttctcactgttaatctttccagtgctttgcattctatacagtaaactccaaatttggttccaacaacaaactgccttgtcttccatatgaagtagaatggagtcttactcattcgccgttcttttccactctgtcttctttcattcttgttttgttttgttgttggaacccaactggcctgggtgtcaagccatctaggaaggagttacaggagttcgtagattagatgtggggaatgttgtggcaggaatctgtgatcttgggaacatagtgacatcatggtcagaagctagggctgttgggaagagagctgattttaggaaagacgatagggaattttcagttcgagtaggatatgtataggaagttgccagaacaatttgagtatgtcacagtacactgaaaatgttggctttctttgtggctgaagtcatgatttggagcagactcttccttgtgtttgtagcacccaggaaaggggttgacggggtacggtgacgacaaggggtgtgtagtatacagagagagccctgagtgagtgagtatgtgctttgacacaggcgcagccatgactcagactcatgagtctcagggtcagagagttggcacagccttctccaggggacttgagttcaagtgtcgatgatgtgtgtggaaaaggtccacaatagctttctcctctggatggttaaggcctgaagactgctcgcctgcaaagactgctccaactgagattgctaactgtgtctccttggtcgggtgcagaccatgggccctacctccttgcttctctgtaataacctcacctcgttgctcatctgaaggcaggaacctcacctctgttcaactccagatactaaacacaatgatcttctggggagctgaggtttctccatcagagatcccagaccatctgaccccaggtgtccatctatctgtcttttcctcattcccttaccaccccaatcaggttccagtccctggagctgtgcaaggacatggcagggttatgtggcatgtagctgtggtgttgagtgtgtaatgacttaggctctggagtaaggtcctgtgggtctgacttccagttctcaagtgctgtctgtgtgtttcagttgagcaagcagcctcccatggaaggtggagtgagtgagagtcactggaggttggctatttggggtgttttagtcacagccctgctgcatcagattccctgcataagtagttctgatagttgatgaagaatgttgaatgcagttaacagtgtgggcaccccttagtagaatagtaatttctaatgccaattgtattagcatctaccaaaataaccttaagggggaatggcagtcaacaggtgtgttggataatacatgataatagtattatatactatcttgtattcatgaattagtcagcatccataagatggaatttttgcacaaaagaggaataaaactcaggccatctatatctgcctatctatctatctatctatctatctatctatctatctatctatctatctatctatctatctatcagtcatctgtccagtctatccatctatctggtttttccaggctgggcttctctttgtagccccggctggccttgaactccaagatctgcctgcttctgcctcccaagtgctaggattaaaggcgtgtacaccactgcccggctgcaatattttatagtaatacaatcagtgctactcaagcatggtggtctgtgcttgtagttcctgctcagctactcaggaggctgaaatggaaggatggcttgatttcacaagttcaagacccaccttacttatatagtaaaactttgttaaaaagcggtttaatttagagaagcaaataaaatgtatatataagtttatttatgataaagtttctgattaacttttttttgatcgagatctcaaatctcttctttaaatcagaatttttagggctttcaaaaaagattaattttaaaatttattttatttatgttgtgttttgcttgtttgagtctcacagtcatatgcaggagtcagtggaggtcgaatcccaggcaatggcttgtcctctgggaataggtcctcagtacagttagccacgcggcggccatctctccagcccctctgtggaagtttgatttggactcttgccccttttacttctccaagtagctcatacaaatataagaattcttgagaggtttcggagccggcctgtggacgcatatggaactgtagcttcacttttctgctgtgtaaatgtcgtggcactaagacccagaaactctttgctgtggtggctggagctgggctggctgtgctcgcactgaagggaaggaagtcattagtgcagaccgagctgtggagttaggttcttgcaggatttccttccagcctttccccacttaggttcttgggaattaagaaaaaaaaaatctaaacacacaaaccaagttttcctatttactaggttcagggaaggtggacatttcggaagggcagatccgatcccaagttgtctaagaagcagaaaactgcgcaaagaagctctgattacagatctttggaattttctttgctaaatttttacaaacgagaaatacacccagaattttgggaattgctccaggctgcgtgtgagggtttgattgcttgtctaatctttttcttttttggagaagaggagaattcgccaagaggggcttggatggcaggagcccggccgggtttctgtggcagcttctgccgtgggtctctgctctgaggggtctgcggcccatcccagagctcctgcctggagccttttcgcaggcgcgggtcggggaacatgccccgctccggcccgggcgcgcctctggccgccgggacgtcctagccccgtgggagagtgtggtggccgcggcacttcgcgctgaaccgaagacgaagactgtctgtcctatcggggaaagaacgagggggtgcaaggaggcagcatgacttgcagtcgccgccgccctgcgtctgcccccagcccccagcccacctcttgatgtgtcccgggtcggctgtacaaatatgatgaaatggcagccccggaagaaggtgagtgcggcgacggcggcggtggggctgatggggagggggccccgcgggaccccggggccatccgggtccgtgcgcccatcgcccgccaagttctcgcctccgggcgcgcgcggcccggcggggtgacagctgagactcagccccgcgtgctggcccggagccgcggcgcgcccgccccgcttaggcccgcaggtgggcgtcggagcgccccctgccccgcggggaccggcgtcccggccgctggcagccgcttcccctgggccccgctggggggcgggcagccccggagcgagcgccgagcggctccccgcgacggccgagcctcgggcgccggggctgcggcggggaggctgcggggacctgcggccgcgtgggcgagtgcgggcgcgccggccattgtgcgccgcgtgtgtgcatcgatcgtgggcaagggggagggggtactttgctttttgcaagattatttcctaatatggctcctttgttgagaaccggaggaaaaaacatgcagtggttctatcaaaataaattgctattggtccccgaaataacgtttctaaatgtgggaccggtcccttccttgggacaccgagggagaaagacagctttcttcaagttcttggcagcccgtgtttttggccagggttctcctttgcaaacttgcctgactgccactcttaggttaacccagcggtttacggcatagcgggactttcccttcaatacctcatttggccatggtttttattgacattcttctgaaggaaaacacagcgagctgaatgtgccgtgcccctccccagccgtgacctgtctctgctagcagctgtctggtgtttcactcaactagctaaactggttctttctttgtgccgtgatgtgagatgtcgggtttgacatcagaactgaaatagaaatcatgtgtgaagtactgagacgacacggcgctggcttgactgccagggagccgaggaaaccgcgcttcattataggccggcgaatgcaaaggttttctttggtatctaattgattcgattttatccagtggcagttgtttctacctcagcccaaagccacaatcactcacatatttgttcggttctcatcatagggcttccttcaatgagactgatataaaagtgtatgctgccccctcctcccatgagaacacaggaaaaccccatataatcaaacatcttaaacagatgctgcatagacctacaatcttctacatttgtgcaatcatcaagagtagtttagagatctctgcaaacagtgcatccacaaatgcctgctttttctattttactcaacatgtagtaactcatacggttatgtcactgaaaacccctctgggcactgggattgctcgaaccacggaagtattattcttggcagccaggtggatttctggactctggaagattctgtttcaagtgttaagattcactgcagtatttactcatgccgtgacgtttagatggctataccagagattgtgtctattttctgtattcacagtcacaaggcatcatggtatgaggatccagatatcagtctggagagctcatagaggccgagctgtccgactgtgtgtgattatttgttggtggcttgagagcagttcttgtacactgaacgtgaaagctactctgggaaagatgctattcactccagcaggcatcaccgagccttcagcagactccgtttattttcttagtcattccagaatactcaaatgatcatacataccactgccacgatctctggctgcgtctgttaacacatttgtggtggtatagtcacacgtcaggtggtttaccaaacggatccatacagactattcacaccccacatagagagtggtgctgtactgtgtggtctgaatggagctagggagaacacccacaaattgtactgcccaactggactttagggctggggctgattggtggctgggtatcttgagggtcttgtccgccacttctagtttgggcttttttgaattctgggtttctgggttcactggtaactgagtaactatcatttcctgatttctttgtttctaactgaacatggaactgggggcacattgactgaaggggaattatctcctccgatttacactattaatttgatagattaaatactcaagacaaagtttatgaatgtgtgagtatgcagtattctactagggtctgattatcttctcacaaaggagcctcccaacatggttcatcaggtccacgccaggccatgccatgtcactccaacctacaccacaggccaggatgagtctcagtgggacttccaaacctaatagatctctcactgagagttgagcagttttccccaaagcaagatgcataggtccacttatctccagactcatcacattttatgtattaaatacaagcaggtttttctttgccggtcacactctaattaattgtcttaattaaaaatgtaggattctgaatagttgctctggctttgtggctgaaatgatattttacatcattcaggtagcacccagcatttttttttttttaggcacctgctgtgtgccaggcacctctgtttagtctgcatttgttcagttcttatctagtaaggaaagggtgtgttacttgaatttcacaaataaggggactggtgtagaaaagggattcgactcactggggtgacagtgtgtgtgtgtgtgtgtgtgtgtgtgtgtgtgtgtgtgtgtgtttgtgtgtgtgtgtatgtgtgtgtgtggtgtcagatcaggatggaggcaggtcttacttgaattttcctcttccacttcaaggaccattaccaggatgctgcctccatccctcaccccctccctcttggaggagcacagagatttaagctacctgggaattgtaagcatttacagtctctgccacagactataaatagattctggcttttggggctgacttcattttgttggctgggatcttttctttctccttgtaaatttaggtgtttatctggcctctttgtagagttgtagctccttaagttcagggaccatatctcttttgttttcaagaataatgcagttgctcaaaaagtgcttattttatgtaagagtaagtagctcccgctgtgtccttacactctattcttcagtccattcctaggtttgactctggtggcttatttaagtgccccagaatatcttgtcattggcttccaacctttacagacaacatcagaaagggggcagccattctccacaaaatctccctggtagtcatgattaagacagacacgtttaagatgaggtaccaggcttagtacctgaactcgctccagtattgtgcttgcttggtttatgcaacctaattggccttgcagaatgccctgtgccctgttcttatttatttatttatttatttatttatttatttatttattattgtttttatcttgtatttgccgaggtgatagtaatcaaaatgccagtctcggaggaatatgtttatttaccactctgaagagatttctgctttccaaatccaaggattagtgttagatagcactgtgtcaataagactccagcatgaaggtcgggaagcccctctgattgcatttctccattgcttgtctaatgttattttactgttcatgcatgataaacgattattaataggaatgtgtcacataagctacattaattatgtaatttgagagtcttatgatgtgtttatcttgttatagtcggcaccttaataaaatacgaatctggctttacttatctggtttatttaagcacacagagtaatgagcttcattgtgacatttccgttcctcttctggtatgttgttcttatttgctttctcctctgccttcttccagtcagtaccttgcttcttaggacttctctgaaggggctcccctggaaagctcgtgggaaggatcacaccctgtagatctgtgtcttgcaacgacataacttttataagaatatgtcacagacccttccctactctttctctgtgatgaaatatttaattttggagtataatgttaatttcaaattttaatgcagtcatgctttatacttagtgttttagcatttattacctagtgcgatcttttgagtgggcatggccccatcgattagtctgtttgaatacttggcccacagggagtgtcgctattaggaggcgtggccttgttgtagtgggtatggtctttttggatgaagtgtgtcactctgggggtggcctttgagacccctctcctagctgcctgagagagtcagtcttctagtggtcttcagatcaggatgtagcattcacaggtcctttgccagcaccatgtctgcctgtatgctgccatgctccccgccatgatgattatgggctggacctctgaaaaatttaaatcagccccagttaaatgttttcctttgtaaaagttgccacagtcctggtgtctcttcctagtcacttctgaattctttacagttgctatcacggctattcatcttgggacccgacttgtttagtggtgtcaggtcacgttggaatctcctgtggatctcctttcatggtccctgcagcctggagacccaggctctgatgctggcagctcccttgacttgtgttcctgggagtcatccaatctcttatgtctgtcctcatagagtttatcaccctggatctattgtaaatggcatcctaatgattttcctttttgtagcctcttttctctgtggtttcttcttcatatccctttcaagtaattgccgataagacaaatatatgcttacagtacaggccttgttaaagtcctgacctccatccatgctctgggggaggctggcggtggagtaagcacgtcctgagccaggcagggtcaggataaaacagaagacatggtatggcttgtcacttgctctcttcctcacccagaggccaccggggttcttagtggtgcccattcatcattcacacaagttcaccctcatcgtattgtatggaactgaagcttctaccatacagctgcaacttggaattagacttactaaaaaaggagaacctggaaacaaatggctgtactgtgaattccctactgatgagcacactcttaagctggacagtggtgaggatccagctgtgctgcagagcagctctgtgatgggtggtgatgggtggcgggggtgggggtggggggggcagtgtcttggttatgtcagtgggaatggcacctggctcctacaagaatacttggcatgcagcatgtcctcactgcaatttcactgcagtacaaccacaccctgcagtctcgctggatatcactcactagtttctatcctatgtctagaatttccttcctgcttctcctgttcccccctcctctctctgcccctcctatcccccaactccccttgctcctcctcccattccccatcctcctgttcttcctcctcctcctcctccttctgcttctcttcctcctcttttatttgtttctttttgagataggttctcatttgctggcctggaccttacagagctccacctgcctctgcctgatgagtttcctcacattaactcatcctgatcctgtctttggttttattgtggagtgtgccttccctttggcagttctgttgctgggcatcatgggccatgccttcctttgaccacgttcctgtaaaccacagtgctggctcagtgcttcagttcccactgggtccatctccgagacgggtaggcagtgaggaagagccaagtgaatgaatgcttgaatgaatgaatgcacttatggatggcttggtaagattcttggacttgctagctacagggagtgcctagtttacaagattacctctgtgcgcttttgaaccttctgagaatgccgtattgcctagaacccagtctaagtcattaaaaggataatctgaacagcacacctattaaaagtacagtcacgcccatgggacggcggcttcacactgttgtgcatgcggtaagtgtctctgtgacacactctgctgatgaacagtcttatctcacatgaacttcacctcgcttgggggaggaaaaaacattgtgacacatttaacgctgatcacaagatatcggcctatcagtgccatgaatgtgaacttccatattaaacctttattctcttcagcccctggtattttgctttgtgtggtgtgtgtgcacatgtctgtgtgggtgtgtatgtgtgatgcatgcagaggcatacatctggtatctttctcaatcactgcttccttaggttttaatgctctattagcatatgttaactattcatagcagtgagcttcattgttgcaccttcttgtgtgtgtgtgtgtgtgtgtaatgtgtttcaactgtatccttccttgccccctttccttacctgtctcccttcaacttctgacaatccctttcctcttcccatctgctcctcctctctgtttgtgtctgccatttttgtgtgtttgacccacagagtctcattagattgtttcagtcaacatgtacatgagagtcatgtctctacccttgtcttagtcagggtttctattcctgcacaaacatcatgaccaagaagcagttggggaggaaagggtttattcggcttacacttccatactgctgttcatcaccaaaggactggaactcaagcaggtcaggaagcaggagctgatgcagaggccatggagggatgttctttactggcttgcctcccctggcttgctcagcctgctctcttatagaaccaagactaccagcccagagatggtcccacccacaaggggcctttcccccttgatcactaattgagaaaatgccttacagcggatctcgtggcggcatctccccaactgaagctcctttctctgtgataactccagccagtgtctagttgacacaaaaccagccagtacaaccctcaacccttaattgtatttaaatcctcagggagaggtgaggcccttgagctttgcccctctatgacaagatgtttgcagacccattctttcatggattaggatagactgattggcctacaagcttttggggtttaaccatccctggggttactgccgtgcatgcaattatttagcttagaggtcagtgcaggggtcttgaactcaggtccccattcttggtgccatacacacttgaccccattgagctatcttcccaactacagtccttgacccactgagctatctccccaaccccagccctcaacgtctttgattgtgtatactcggtaggaagtggacactgacacaagattttggagtgttggaacacttggggatagttttacaggctctatagagatgaggaagtctgtgtgggcacttctgttcaggaggagctggtaagtatgccagtatgagaggctacagggtttagctgacccagcttgaagaaagggcaccaggagcctcttttccttttgctagtcagttaccatgatggtgtgctatggagaatacggaaggagcagagaggagcctggagttctggctggccctgtcagctccggcttctgcagcgaatgcatgtgttgttaataacagtgcctgcctcagcagttaagagttctctcttgttgtgctaaaaccatgttgttttattgaaaactcaaaatcatttcatttaacccacattttcaggattcatggggcgcatttgtcctgctcttttctcaccccctgtaagggttcagcagctaagaattttcacattctcacatggctgagctctgtagcttggtccacttctggcatcttttgtccttttgattagtctattagtattctttgtgatttttcaaccctgtgtcctttttgcacatagtttaaggaaaactataaaatcgcatcctttaccatacctttctctagaaataaacagcacacaaactaactttagcaacacttgctacctggtgataggtacctcacgatctgaagttttatttagtacatatctgattctgtaagcctgtgtcacaaatactccagtgcgttcagcaatactggtgatgtttctgatttacatcacacgggctgagacttgtagatgtacgtatattattaagacatggccaagttgtgggacagctcacatctggaggatcagccaagaggaagcagggacagctcacatctggaggaccagcccagaggaagcgggagccagaaggccattgtggaaactcaccgagtctggatacatcctctccaaacactcaatcttcagatttgagtaaacctggaaaggtggtggatgtgagaaaaccacagagaagcttgttggataccctagactttattataatcccaaattttcttttctttaatttatttttaatcccccttttattaaacatagattcttttctcatgcagtataattactctccctctgctcctctgacttcctcctctcccattcacaaccgcttggtttctgtctctcattggaaaagagcaggcctctaggacatacaaccaaacctaacaaagtagaatataataagataataggaaaaccatttgtaaatagtttttcattgataaatggttgcttattctgctgtgtctaatgttttaaggaaagtgaaaacacaccattttccttttcttaatatttctagtcagtatacaaaattctgggtcatatcgtgacaccttcatagataaatttctgtgttcactgttcttagtccacactcccacctactgattctcctctccctcaaagagtttcattttggccttcgtggcatacagaacttaggttctgtatataagagaaaacatttagttctctgtctttctcttgtctgctttgtttgcacttaacatggtgatctccagttctgataaatttcctgtgaatgagccaaccttattcttccttatagctgtgtataagcatcggtaggtggactgtcttggtggttatgtatggccttgttggaaatagttggtaataaacatagatgtgctggcatctgtgggtcaggtggattctgggtacatagccagaagtattgtatatgatcacataagggctattttaaaaattttcctccctccctctctccctctttccttgtcttccttcctttcttcctctttctttctttctttctttctttctttctttctttctttctttctttctttctttctttccttccttccttccttccttccttccttcttctttccttctttccttctctctctctctctctctcttgaccttgtgtctacagaggccagagaacaatttgtgggagttggttctcttcttccatcctgtaggtgggtcctgggcactgaactcaagccatcagggacagttacaaatgcctttaatcactgagccttctcaactaggtagttctaattttagtttttcaaaatgtgcttatgcgcttggatgttttcttgcttgtatgtacatgtgcccctcacccggtgtcttctgcagatcatgatgtaggattccctagaactagagttatggacactgtgagctgctgcgtgggaagagcaccaggccctactggctctcttagccacggaaccatctctccaggctctacttttagttatcttggggtgtctctgtattgattcccaccgaatgccttccagtccacatctccaccatccatgtgtgaggatttctgtacccacatcctcactggaattctcagtccctcattttctctattcttcccggggaaggatggactttgctgttccacagtggttaagggcattgtacatactttcaaatacttcttggctagttcttctggagactgcgtgttcactcaggatttgattcttttggtatttattttttagttatttgtaggctctagatgcccagtatatgactggcaaagaatctctcctcactgatcatgtcatgatgtggaatggcactgtcagcttctgatactgttagctcttagagtccttctctgaaggcccttgctgattctgtatcttgaacttttttccctgtaagtttcaggcatttctctgagacctttgatctactttgagttgagttttgtgtgggatgtgagataagggtctattgtgatttgtcatatgtggacatccagcattcccagcgccattgctgaaaaggctgtctttcccccacaaatgtcttttgtatcttggtaaatatcaggtggctgtaagttccttttatttctatcctgtcctactggtgtgtgtgtgtgtggctcctgtgcctgtgtgatgcttgccactgtcgctgtagtgtaaatgagttccagtcggctgtccctactggttactgttgctgtagtgtaactgaggttgggtctgaggtccctgctggttactgttgctgtagtgtaactgagttcctgtctgcattgcctgctggttactgttgctgtagtgtaactgagttcctgtctgcattgcctgctggttactgttgctgtagtgtaactgagttcctgtctgcattgcctgctggttactgttgctgtagtgcaactgaggtctgatctgccttacctgtggccctgctctttctgcttagtttcacccgggttactctgggtcttcatgcttccatatgaagtttaggattgaaaacaattttaaatttaaaaaatttaaattggaaagtagacagaatgtcagtgtcattgagtaaatgagaactccgtccatatgcttacctggctaatgtcctcattctggcagcagtgcattcccagcatgctccattttacccatgtgtccatactgagaatgcacacacacacccacagtttcaagattatccgaaaagctgcagttacatgaagatccattatgctttgtgggagctgagtttgtggagtggagagtatccagcataggtaagagaggaactggggctgcagcttagccagtggagtgcttgcccagtgtgcaggcagtcctgggccaggtttctagtgcactatcaatctggcacagtgacacacacctgtaattctagcactttgaaggtagaggcaggcggattaggagtttaaggaatcctgctctctagaatagctgggggagcagtctgagctacatgaaacccctccccccaaaagttttgctttcagttgaagagtcatgattctttctgtcaccctatttctttatttctttcttctctttatgcttgtgggttttttttttttttttttttttttttttttttggctgtcctgtaactcactctgtaaaacaggctggccttgaacgcaaagagatttacctgcctctgactctcgggtaccaggattaaagttgtgagccacctcactgggctgttatctcattatcatatctgcccccaaagatgctagatcaaagaaaggaaagataaatgaaaatttatttcaaaattattgttaatgacttattagtttcgagctgatctgggttgcttctgtgtggtcatcttggctcttgttttggaggagggcaggtttgatgctgccagacaggttgatgagtaaaaggagatcgtgtcagaggtgatggcatgaattctccgtggtcaccatctcaccggagattgctgcactgagttttattttatctgtaatgtccttttgactttcctggtaactcaagctataatttactatctgggaactcaagctgtaattcattatctgccaacatttgaaaattacagtcattatatgtgaaaatttctaaaaaatgtattttatattttgtcataaacagagtgccaagaataatccaacttactgataactcaggaatgtgtgcatgggaatattttagtgtcctaacacactaatatgataggaaactgtaaagaatatagggttatttgttcttatgctgaatgaccccaggttgatttttttttcttttaaaatcatcatgtgccttatgtgtgcacaagtttttcctttccccttgtgttttcaatatactgttgcttcatagagtaacccatgatctacttatcaaacacagctgaaagcctggcagaagaatgaccccaagtacttggcaggtagaggcagagaggtcaggaggtcaagattaccctcagttacttgagacttctctcagaataagaggaagcgagttggtttgtgcttatgatctttagaacttgaagcatcttgtgggctttctgtgccagactggcctgaagagtaagtttctgttacaccacagaagcaacaacaaaaagcgtaaacacttcaattaagagaactgatacatgaaaaaatatatatcagtcctaaatgtgttcaaatagttcaaaatctaagaaagcccaggtgaaaaacaaaagaaaacgtgtcttagggtttctattgctgtgatgaaaccaaaagcaaactggggggagaaagttaattcagctcacatttccattgctgtcaggacagggctcacacaggccggaacctggaggcaggagctgatacggaggccacggagggcgctgcttagggtttgcttcatggcttgctcagcctgccttcttatagaacccaggaccatcagcccaggggtgccctcccccatcaattactaattaaaaagtgccctataggcttatctataggccaacattatggaggtataagctagagtcacagaagatacaggatcttcaagtgactctagtttgactagacttgacttcaagttgacagaaagccagccagcacactgcttgcgtgcagatgtggttgtgtgtgcatacaatcctagtattttggaggagaaaccaaaagactgagtgggttatgtaagaccatgcctgagatcctatcttagttagggtttccattgctgtggagagacactatgaccaaggcaactcttataaaggacaacatttaactggagctggcttagagtttcagaggttcagtccatcatcatcaaggaaggaagcatggtgctggtagagctgagagggaaacaggaggcgactgtctccaagcagcaaggagcagggtctcaaagcccacccccacagtgacacacttcctccaactagggcccgcctactctaatgaggccatacctactccaacaaggccacacctcctaatagtgccactttctccctcactttttaaaaccaccacggatctcatctcaaaaaacaaaaaccaaactctggcatttgtcgtgtttttatgctttcttgttttaggttgttttctaaatatcttccagtaaattagcaaatattactttgcagtgaaaaccaagaatgcatatattcaatgttcatcatggagccaagcatattccaaatggcatgataaacatgcctgtaacggcatcctgagaaacacacctgtaatgatgtcctgttttccctcttctgattttgttgtagtgtttctgatgtagtattaacacgtcaacagcatattcaagataaaactcctgaagtgcttcctatagtgggatttaactatagccttgaaaactcaggggcctgagacatgaggagtgatagagcctaggggtgcaagccaagcctggaagtagctgaacaatgctacaaaatatcaacaaagacagggagcagaaggaggtccgtgatcctgagtcttcagaattagcatcccaggatgtgtgaagtgacacaagttagcagtaaacggttaaactaggcctgttgatgtgtacctgtcacccccaactccaggaaacaactgaggcaaaaggatcaatactccatgagaccccaactcagaaaaaaaatcagttaaccaatcaaccaacaaatcaataacatttcacttaagtaagactcatgtattagttaaattagttaaattatggtttatgagtgtggcaggtgtcatttttttcctcagttgccttgtaccttatttttttgagaagagtctctcactcaacctggagcctactgattggctagattggctgaccagtgaaccccagggatccacctgtttcctagcccctaaaactaggaccatagacgtgcaccaccacggttggctcccatgaaggggctgggaatccaagttctgcttcgcacaactggaccattgttccaggcctacatttatttatattgtgagaaatattatttattcaaataatcttttcattctagtctaggcttcccaaacagcatttgcaatacttaggctagagcagttttaggaaggaactttcaaacataacaagcatggtgccggacagaaagccatgggtgctcagcaattagccttggctcttactactcaccagaggggtttctttatagtaaagtagctaacaggggcggtatgtctgaagtccctgaagatagataacatgatggtatatatattttctttcagacatgttgtttcttactctcctcctcttctctccttttcccctcctcttcctacctcttctccttctcttcccctcttcgtccctcctcctttcctcctttttgcctcctcttccatcctcttcctgtcctcttccctcctcttttcctccttttcccctcctcttccatcctcttccccgtcttccttcctctttccctcttcttccccttctcttcctcttctcttcacctactcttcacctctcttcccttcccttcccctcttctctcttctatttcattctttaggaggcaggatatccacgtgtcatccaggctagccctgaaatcccagactcaaggcatgcctctacttcagccttccaagcatctggaagttcctgtcttataatttactttcctgaaattccattgtgctgaagctttaaaaacccgtatcaaaatgtatatcaaagttatatttgtttgttgttagttttagttatctgccactgtgctggcgactaagttaactttatttaagctagagtcattagagaggaggaaccctcagctgagaaaatgcctccataaggttggactgcaggcaagcctgtaggacattttcttaattaatgtgggtggggccatctccctgggctggtgtttcctgggtgctacaataaagcagactgagcaagcaatgatgagcaagccagtaagcagcaccccgccatggcctctgcatcagctgcctccagggtcctgccctgtgtgaatttctgccctcactgcttcttctgatgaactgttgtaaggaactctgagtgaaacaaaccttttcctatgcaggttgctttggttatgttttttcatcacggcaatagtaaccctaactaggacagtcacccagaaacttgcttagaaatgggctgcatgttaatcatttatgtagttgggagaactgtgaaatacaaggatgacagtctctgatggcctggctgcctcagaggtagaggtgaggccactctgctggggaccttgggcagctgaggagcagcactaagggtgtctgcacctttacagacaggacaaagctgcagttggaagccaagatagggagaagatgttgatcataaactctacagccagagaaccccagtcataggtcagtgtggaccaagagtcagggcagagtaagtgactgcgctcaattaaggcagaaaagtgtgtgaaaaggaagcagttgatacaaattcagagccctcatttgcaggtcaactttatgagtgtcctgtcattggtctgtttctggtgacagctgaggatccccaggacctttaatgaattatgttatcttatataatgtttacgaaagaaagcatttgaagtgacggggctgtgacagaaccagtgtttcccctacagaactgtaactgggcaaagcatccttgctaatttgcatagaactttatgacttaattttccaaagtaaatttgtaatatttatttgcactgtctcatactaggctaagaatggatcaggtgagagtgtaaaattttctttaagatttatttttaattgtgtgttgggtttggtctgtgcacatgagtgcagttgtgatctctggtgctggagttgcaccttacatgtgcctgtgaggtattccccatgggtgctgagaactcaactcaggtcctctgcaagagcagcacccctcttaattgttgagcaatctctgtagctccagaaatgtaaaattcttaaagttaaattttaaaatattataaatatataggatacagtgccatgtttcaattcccagcacctacttggcagctcaaaactatttctaactccagttccaggggatccaatgccatctcccgacttcagtgggccctgcatgtacaaccatgctccacagtcatgcatgcaaggcatgcatgtacatacacaggcatgcatgctccacaggcaagcatgcaaggcatgcatgcacatacacaggcatgcatgctccacaggcatgcatgcaagcaaaataaccataggggtaaaataataaaataaaaataattaaaaataaataaaacattacttaaaaaaaagaaaatctagagaaacaagcataaaagttcttgccataacattctagtcagggctggggatgcaggtcagctgatagtgtccttgtcctacgcctttaagtttgctccacagcactgcattaagtcgacatggtggtgaatgcttagaatcccagtgtgcagtgtgcaggaggcaggaggcaggaggcaggaggcaggaggcaggaggcaggaggcaggaggcaggaggcaggaggcaggaggcaggaggcaggaggcaggaggcaggaggcaggaggcaggaggcaggaggcaggaggcaggaggcaggaggcaggaggcaggaggcaggaggcaggaggcaggtcagaagctcagagtcactcttagttacatactcaattcaagggatgcctaggctacctgagaaaattgttctcagaacaaataaatatattttaaggtgagctcttaaattccaggttattgactgtgtaaacaggtttgcaaacacagttaacatttgtgtcagatgcacctggctatggtgcatctcaggacagctcttgtatacctgcttgaggtccttggtgcaactgagtaccaggaaaggttaacagtcacagagcttatcatgttaccactgttgggctttaaatactaatgtaacacgtgtagctcttataaatgaaatcatgtgtttatttatactctgtagccttttagagactacttcaatgataggcttttaaataggagcaatttataaatcaagttgattttcggatgatcacagtattaaatatttagcatagttataagatacggaaatagtgctgaaacacattcctcagcttataagatcgatagagaacgagacgccaggtggcacatggcaggcatcaccagggcagcagaaatgtgatgaaacaggtcacagctgggctggggagactcgaggatggacctggatttggagaagagacgcgtggaccaagcgtcttcgtggtgagtaacacatcagccatgctggttgggtctgttggttttgaccaggcaggaatgagcctcctccaggcagtgagagtgatgtgcagagagatgaatcccgggcatggttttcactatggtaaggaatcccaatttggctggggaggagacttgggttgccaactgaagtctatatggtaattggctgcaaagatggtgaaattagacttcacgtgcttactctcctcatgatgcccagcctgtaactggcttctctcacattttcatattaaaggaaaataaaaagcggagcaggctgctcatgatgggattttacttggctctgcaaggagttttagaaaaatgacagcagctgtttacatggtttctgtgattgccctgtgcacatcagaatgatttcctcattgttctgtgcacgagcccacatctgattcagctgtcgttgcccgcttgccaatactactgtgtttgtacctgctgatgggagtagaaacactgtgagtttggaattctgagctcttccggctatagaatggcacttctttactatatgttatgtggcaccggtgatcagtttgagagctgaagcacaattcacaaagcagcaatcgctcctggatttccaaataaagcatttgaaggaaatgatatttgcagaatgtgctatagtggtgaatttagagagtacaagataattacttgtaattatggcaatttctgtaagggaaatcatcttaatttgttcccactaagaaacagaattgcttttctcatagcattgaatctttttaggagattaatgccgtgtgccttcattactctgaatggacattacggcttttcactgcatctgaaattacccttttaattcacacttctgtttgaatctcggttaaatgcagtctccacttatttaaaaaaatcatattccagagctcttggaccgaacttacacatgtatcccaagagaataatacatcccgaccaggcacagatgaagcgacagtgtggtgagagagtctctgccaactgttccctgaaatgtttaaaattagctagcccttaggctgatgggtaattgccctgggttcaaggaatgctgtctgtgcccgggtatttttgtggagacagactctgacttcttttatttctaagtatttaattatgccatttgggaaaggtaactgtgtataggacaaatcagaaactgaagtgggaagagtgaatttttagtagaatataattaactggaaaaatactgaaaaagaaacgagggacatatgtctcagtaggtgacagggatgttaactacaagagctaagttactgttagactgcagtcatccacaaaaatgagtgactccgtcatctgagcatctgggggatgtttacagtagcatcttgaaggctggggagaccccccctcagcaggttgaaaacctgagcttggaaccccagcattcaggtaaaagccaggcataataatgtgtgctcctctgaaatcctagcactgggggagacaggaagctggagacaggaggataagggggtcaggccgccaaaagagtaagctccaggacatggcagactgtcccggctgtccctaaaaataaagtggaagtgacattgatgtcttgcccttaaatgcacatgtgggggttgtgcagatgcacgcatgcatgcacacacacacacaacaggcgggggtgggggggagaaggagagagagttttgtttttcttttttacattgtgtagggtttcttttggctatagtgaattgaagagcttgtgttgtcttagttactgttccgttgctgtgaagagacaccatgaccaaggcaacttataaaagaaagcatttaatttgggggcttgctttggataaaaccatgacagttattgcagggcaggcatggtgctggagcaatagctgagagctcacatctgatccacaagcatgaactgggggggggggggggagacagagagagagagacagagagacacagagagagagaaacagagacacacacagagagagagagagagagagagagagagagagagagagagattgattgattgattgattgattctgtggctgttgtgagctttgaaacctcagagcccatcctccatgacacacttcatccaataaggccaaagttcctaatccttccccctaaagttccaccaacaggaagccaaacaaatgtatgggccaaggggccattctcactcagttgtaatagaaattttctcttcttcagtcccaggcagaatctctatgtgagatccaagaggaaggaaggtattttggctgttagttctcagcaccaagcagaaagtgtagcttttaggtaggatgaggcagagagggacagaaacttcaagtaacccagaatccccatctttgaagttcccaccccttttacaaaggtctaaaccatagccaacttggatgagttggctgaataattacttcagtatgtatttattggtggtctactgctatgccaaatggtttggatttggcccttttcaggttttggaatatttgcatatacttaagatatcttgcaaatgggactcatgcctaaccacagagttcgtttgggtcatgcatgccgtgtgtgtgtgtgtgtgtatgtgtgtgtgtgtgtatgtatgtatgtatatatgtatgagtgtgtgtgtgtaattttctatctattgcatcatgctgacactcttaaacctaagattttagaacctgttggatctttcacttttatcctagcaattcccactctgggatggtaattgtctgtcccatgatctctgctttttttgtagcacaccatcctctaagaactcccaagtggaaggatgaagcccatactgttgttacgtttttgatttagaaaactagtttccaagagatttattgaagaagaataacttcagttttttaaattattatttttttattttattagatattttcttcatttacatttcaaatgctatcccaaaagttccctgtaccctccctctgccctgctcccctacccacccactcctgcttcttggccctggcattcccctgtactggggcatataaagtttgcaagacctaggggcctctcttcccaactaggccatcttctgctacatatgcagctagagacacaagctctgggggtactggttagttcatattgttgatcctcctatagggttgcagaccccttcagctccttgggtgctttctctagctcctccattgggggccctgtgttccatcctatagatgattatgagcatcacttctgtatttgccaggtactggcatagcctcatacgagacaactgtatcagggtcccttcagcaaaatcttgctggcatatgcaatgtgtctgggtttggtggctgattatgggatggatccccgggtggggataacttcagtttttaaaggagtttggaggaggtgtatgtagtctctccctcctagggactccgtggctcattgtagggccaaaacagactctaggttagcaagaggccagatgctttcctgatatgacccgtgcttgacacggaactgcctgccttagaaattgctttcttatcatgtctttatttgaggattagatatgaaaatgttgtccacatagaaatattctctccacagttgaaattgatcagaaggaagtgaaggaaggaagaaagggaggaaatcatggaaggaggactcgcaggcacacagaagggcaacgggatatgtgtactggaaagatacaaaatatgatcaccatgtggcatatcaggaacccgtggtaaaacacctggatttaatatttccccagagctgtgagataaccactaagggacaaagtatttttcctagcagttaactttcatagctcttaaaacatgctcccactggttttacttaaaacaaaataaaaacaaaagaaaacaaaaaaccatatgggattcactttaactctcaaaggcatcactttttaaggacggaagattagagaagagggtgggtaggcaagctggttctccctggctgcctcacttaggatgtgcctgggagctgtggagtctccacagaaggaaaagatgaggttttgtttagggacctttgctattcttcttttgtatctccactgagaatcaaggccacgtgagcaccaccgtcaccttgtcaccagagtgcgcagcacaccagcgattgggaacattgctccatttctcacacacagacagcataatgcagtaatgtgtggtctggtgcagtggacacaggacagtagaaccatctacctgtctatctattgaatgaacttgtgaattactttagcccagtgtttatagagtcatagacattctgaaaaaaatgttatctacaattttatagtaccctaatgaagcagctgctgtagctattatttaaaatttaaaatttggcaatttagaatgtccataaatctttgggaatatcagggatctttaacagtttttaaactgttgatcttgaaacttacatgacagaaacatagtgtataatatttgtttctccattaaacaaagcaaaacagacacctaaaccatgctttcactattttgagcaaagaagaggttagaaataaagcaacagacggtgttatacaaggctaacaacaagaggctaccagcaatgccagggcctaaacatagctaaagtactactgattgtacaattaaaaattaagacctttagttcattttgttttgggcagggtctcaggctgtaaccctggttgacctggaactcactctgtagaccaaactacccttgaactcacagatctgcctgcttcccacaggtatgtgctgtgattaaaggcatggccaccacacccagacagagtgttagcttttatgaatgaaggggcagttttccatgtaagctttaatgggtttccttatgacgtttcagacatatatagtgcatgctgatcatacccccactgccctcttttctctaactttttctgagctttcttcctctttccagctggtttcccttctgcctgtgtgtgtgtgtgtgtggggggggtgcacacatgcatgcatgcatgtatatgtaaatgtatatgtaaaacatatggatgcaactgtgtgcatgtatttgtacatttggacagtgcattttgtgcgtttgtgtgtgttcatcccattaagttttattagtgctgtttactggcacatgggtaataatttatttacaggagaaagagcatctcaccagtggctacaccactaaaaagatcatatgtccctcccaccaccacccattaatggccagtagctcctcagtacagctttgagagtcccttttcactttgtgatggaatgttgtgttgtgtgtgtatcatatgtgtgtgtgttgtgtgtgtatcgtattgtggggtatgtgtgtgtgtggtatgtagtgtatgatatatggtgtatgtattgtacatgtatgtggtatctatgtgtggtatggggcgtacattgtgggtgtgttgtatgtgtgcagtatgtatgtgtgttgtatgttgtttggtgtatatgttgtatgtgtggggtatgtgtgtgttgtgtgttgtatggtggggtatgggggtgtgttgcatggtatatagtgtgtgtgtattatatgtgtttggcatgtatttgtgttgtttggtatttagtgtgtatgtatggggtgtgtgtgtgcattgtttgtgtggggtatgtgtgttgtgtgtgtgcattgtacatgtgtgttgtgtgtgttttgtgagtgtaatatgtgtgtgtattgtatgtgtggatgtgtgtttatgtatgtgtggtgtatgtatgtgtggggtgtgtgtgtatatatatgtatgtacgtgtgtgcacatgtgattgcatgtgtgtacaatttagggtagtatgctctctcctttcacaaggttccatccctggaacccagatcttggctacagatacctttgtcctctaagctatcatgctgactcttgctttactctttgaagtgaagtacccagcttccatgtggcatttgtgtttagtcgatttttgatggtgctgaaggtagaaggagagaacttccccgagatacttccaggactctcagtgtgcgcatgctccgtacatgcatgcttggcgcgcttatgctcggcgccctcacgctctttccttttcttgttttgtgtttttttttttgaaatttgagataagatcttgtaacccagacctgaccttgactcctgaacctactgcctatgcaccactattcttgactacccaccttctcctatctacaacccatattgttagttaatagcaaatactattagattttcagtagggagagtaacagacgtgtagatgtctcgccatccagccaaaagtgttgatctgtctcttcctcaatggaaacgaaacccacccgtcttgtcactcagccgtctggtgtgatgacagaggctgtacaaacactcctggcagctgccaaagaatcaaaatctaacttttcaaaaatcaaagttgctgcctaggaaataaatcagccttttgtgataagattggtagcttgtttgcccagctctgatatattttgtgaattaacatctacagtttggatctcaggacactttggatctatcatttctctcccagccacccaacagttttatgtctatcatcaagtcatccatccattttccacatctacctgtcatctatccatgtataacccatcacctatcttccatccctctgtccatctgcccttccttggatctgcattccatctgtcatctatgtatctgttatccctccgactacctattgcactctttctttagataaccagtttcttctttcttttcaagttgcagttactgttcaaaagacagaactcaggcactgtagctccgctggatgtcagaaggccgtccctgagaatgggaccacagccattgttgttggctcacccatcgagggctctcctttagacagattgctggcacgctgtgcctgtcaagtcgtcattttgttgtattttttaatttaactaaaaacttggtttgctgatgaacgtcacatgtttttagccagggttctaaatcagtagcactcccgcgcagacagtaagcaacagacaaaagctcaactgagcaaatttgtgtggagcatctaccttgagcaagtaattagccgctgaaatagatggattgtatagatgaggttctatctattaaagaggctagccacttatcaagtgctaacagcccactgcagcagaaggccgtgatgtcagaaggataattatagcacactagaataaaccttgaaatttgttcctgttcaactgcccagagaggcttcattggaaacagaaatattttcatttgtcatgaaaatgggtagatgagcaataagtagatgtgggagtagagtattttttaaaatataaattctgctatatagccctagtaggcctcaggtttattatatctcccaggctggccttgaactcggggtaatccccctgcctccctctttctggtgccaggattataggtatacactgttgtacacaactgttatttttcccaatcatgctgccacacaagccacagtcacctgggaagaggggacctcagttggggatttgtgtccatcaggttgggtgtgaccatccatgtctttgggggcattttgtttggtttgtgatctatgtgggagggctcagccccatgtgggtggtgccacctctgagtaggtgggtgtgagctatacaagaaaggctgtcttctgagcgagccatggaaaacaagccagtgagcagcattccccaccatctgtaccctacttcctgtcaccagcatcttgcttgagtctgtgccttggtgacatcccatgagggactgtgacctgtgagctaaaataacccctttctatttaagctgggcttggtcaaagtgggttttttttttgtttgtttttttgtttttgtttttttatcacagcaaccgagaaataaactagaatagaaatgacttcaattttgttatttttatttatgtgtgtgtgaatgccaagtgtgtggaggttcccatggagaccagaagagggcattggactccctggaactggagttaaagcagttgtgagctgttcagtgtgggtgctaggaactgaactctagccctctggaagtgcaagctctcctaaccatgccgccatccctcccgggccctcaaatgatgactttggaaggggaaatggcatccagaagcatgtgcaggatttatagttatatatttacataaatttatatatgtagttatatacatttagatatatagttatatatttatatacagtcagatatatagttatatatttaaagttaaaactctttagcttttagcttccggagatccataaaacacttgggacaatgactcttgaacctgcaagattgttttcacaaccttaaagaaacaaacctgtttggacccttctcccagaggatatccctgtaagccttgtctagggctacaattcctctgctcgctctctgtgacagcccagtcagtgttgttgctggttaatttgagatagggcctcacaacgtagcacttgctggacaggaactcacagagactcaccggcctctgcctccccagtcctggggttaaaggtgcagtcttggcccctgtgtctaagggaacgtgtctcaggttgtgtttatttatcaattggaaaatctaaatgttcaagtgagtttggagtttcttcttctctataggcacacgcacagttgttcagtagtagtaattgctagtagataagaacacgataacacgtcataggttcaattctggaatgccccacaagaagttaagaggcttccctctcttcttctctccacctctcttcctccctttttctttgatatttgattccagattattaagctcttagatttgggggtggtggagctctgcagtatgctgtggtccacatgtagagcaccaatgacaatcaagttcccttaacttcccagcaggcactgagatggagtggtcatgctgctgaacgtttctgtgacacccacctccctttgatggtggtacttttttgcttttgctttttttttttttccttctagacatgggtctcactctttagcccagcctgtgctgaaacttaatatgtagccaaggttggccttgaacttgtgacaaccctctgcctctgaagcttacagcagaagccatcatgcctggctgaatacctgtaattgtaagtctctgttgtggcctggtgttttatttcttcactcgtccaaaaatctgtcttctggagggttctggggggagggaatgcgtgaagttctaagtagttccagtgacgtcactgagggtggagctgagcccgtttgatctgttatagctcccctattctactctctcagcattttcctgccagttaattacacagcggcttaggggacaattccataacatgctgaagacagcttcgctgaaggctgacacactttcctccttggttacacagctaatggccactcagggataattagtgaggagaaactccaacggtccaattactgtcttctcaaggttcccccccttcattcttctttgctcaaatcttgagagattgccctcactgtaggtattgcttgtgtgctatttaaaactgggtttttctccgttcagtcagacaaaaggtaggagacctatatttagcatgtgaggggaacaccctgtgaggagaagctgatgtcctgcagtgtggccctggagcaagcagcattcggagaagtggcagccagtattttacaggccacagctatgcctgggtttcagttcctgggttaagacttgtaccctgtccgtgcactgaaaaggtttgagcttttcttctcccgagttgctagagcacccatggctttgtatggtatgtagattagcagtcagatgggccatctttctgtcaggagatcttggcttggggtattatagcttaccaaagtaatgaaaatgtatgtgcatatgcctcggtaggaaaaccgtgtgagcacacccatcgcagtgtttggtaggtagagaggatgtctagcccttgtaaacttctgagtcaactaaccaggccatgtgttgtctgctcttttgggaagtctgtccaacaaaaaacacagtgatttcattctttttccgaaggtccatgtgagccttaggtgctgcttagtggaactgggcaagcaaacctctgtttctgaattttgtccaaacagggaaaaaatgactatgttaaaagaaattcctttgggggggggaacccctgccttctggaattaatatcgtgactgtgctgtatagatgccacttgtgtgaatgttttctttatatatcttgccccgtgagcgtttgttgatggagcaggcgtaatgaaagcctgtatcgtaaggagtttgaatctctcctttcgctgccctcttcctgtttggtttaatgtcccggctccctcactccagcactggggctttcctaagggccgggtcaaggttagcagaggctttctgaagtcttcaagtgatggagtcgagccatgccttgcagacggtcctctggtcttcagaggcagaggcgaggggctgcatcctacatgcagtgaccatataagtggtgtatggcgaggctctcaaggggcaatatgcatttgaggaattataaagcaatatattttttatataagacactttcaaatcatatttacctcttggtggctgtggcttattataaataaatctgcatgtaatttttatttaaatattacttgaggatagttctagaattatgttgaaaatagtttttggccttcatttagtgaagtgatatttccctttaaatctctgtcatcaattacttgtcttaataaaaatcacagctgcttacccacgtggctgctgggggaagtctttgctgcttttactttaaacttttctgctacatctagttattatgcgtgtgcagggtcttgctgtctcacacatgacgtcagaaggcagctccctccttccaccacagggatcccagggatggaattcaggctctgaagcttggcagcaagcccctttccccgcagagctaagccatctctgctttcctcgcagagcggagccatctctgctttccccgccgagccatctctgctagcttctgaacttcttccataatggtttctacatttatctcagggcattctattaatctggtatcttagttatctggtgttacttttctgccacctaaggatcttagcaagtacaccgagggcatcactaaccgttcaagtaccccaagatcgttctctggcacaccctattcttttcctgtgtgatcccaggaccctccatccatctgaagtgttcatctccagctgaacgactgttttgcttttcatctgcttttattttatgctgaatttaatcctgtgccatgagtttttgtttcttccgtttcttcagggattatcctcctcttctatgcagcctcctcttctggctttggaacagtctgttccttcttagtgaggatcatctatctcagtgtggcagggggagctcatgtatgggccaatccagccatgagctctgtaaattcatcagcacatattaggtgtcgtgtccacttggatgtgtccgctgactagagactctgcatctaagccctcacggtcaccatcaccctgcatttttaagcgtgtgcagcaataaagtgaagacaaagagttgaacttgttggtttgcatgcttttatagggcttcctaggtcactgagtagttgaaccatctttacaggtcacccgtagctgcttgcaggaagagctagggtggcagacttttaattaagcttgtgagttagattctgagcacttattgtacatattttactagaatataattttaagtcattagttatgccttaataaaacaaattatgcacttaaaatagttagtgagaattgaccaattttgtccaaacctgctataaacattgtattaattactacctaatgcccccatttattttgatttattaagacagggtttcactatgtagccctggctggcatggaacttgccttgtagatcaggctggcctctaactcatagagatttgcctgtcttggcctccagagtcctgggatttaaaggcatgtggtatccaccacacttggctcttccatttattttaaaggaaagcgtgtcctctttttccccccactcatttctattgtttgagactttcatacatatctatcatggatttggatcaatttccccactccctcccctaaagtccctccaaccccatcccttataggccatccttcccctcccctcccctccagtccctcccatacagtcagttcttcccctcccttccaaacccttaccttccctacagcccctcccctctcttatagtccctctcctcccctagagtcagtctctcccctctcctacagcccctccccttccctacagtccctcccctccccactcctcatgtgaacacagtttgctctgtttaaacccactgggcacacaaagggttgccagtatgtgcatgatacagggcgtctcctagagcccgagtagcttcctatgtctttatttccaaagaaaactaactcgcccccaccccagcagtcattcctcagtccattctggggtttggtctggtctgatcttgcatggctcttgctcattctttcacgaccaccatgatgtcacacacaggtccagctgtcgggtcgtattggaacactatgtttgactgtagccattctgcctcctcttcctttgatgaaccctgaagctttggaggaggggccatgataactgctgtccactgagagctcaccactgtgcaggcttgtactctgcgcattgaatagttgtggggcttggtaataatattcatcttctgcacagagaggcttccctgatgagggttgaaggatgtactggcccacacgtgtaatcataaatcattaggagtccttttcatgctatgacccattagcagaatagtagtagtagattatttctgagggcctatcatgtctctagacaagggttcttgacaccaccagcagtgccaaacatggcttttgtcttgtggaatggttcttaaatccagacagaatgtggttggtcgcctcatacgtctgtgccattattgcaacagtaggtgtgtcttgccaggctcgtcacagtcactctcatacttgacagtactcatcgctcgtgactgctttccccctctggcagcatgtggagcatcttcccactgtacaaaagtggccagccggtaggggtgaaggttccaggttggtgccagcttgatttctccacgttttatgactcatggatgtgatgtctttggcagtaggattttaccatcaagttctggagactagcccagaataatggcagtagcctttaacgctaggaggtctatggggccccactgactgacaactccaaaagagctaaactgttgacgatactgggttttttccttgatagcctgtggtatctaggagggtcattgttcactgctgctacagggtaattccatttaagctgtgtatgtgtgtatattttaggaagcttctatagtaacaggtttcatgtggttttttgaaaaggtctttagtgttcagtatcgctctccataccccttcctcaccctgccttcccattccacattgcactcaatccttcttgctgttatcccaatgtttttctcttataccccctacattctatcccccttttagcaccccccacattctactcccccttacagccccccttactgttttctctcatacgtggatattagcttttagagctttgacatagttatctacacgtagtgctaaggaaggtatttctggtgtttctattcaaaattggacagtgagctcttccgatggaatttcatggacacttcacagaatttagtaccattcttggtgtgtggatcccctcacactcacttttcttcccttgggaactaactgacttagacttcccgcctgtcctcacccatttgtatgcttctgctgctccttactgactgtctgtgttgcccttcatccctgaaggatatggttctgcagaggttgcctgtctcctcggagaatgcttctcctgccgcaggtctctctgctgtgattctcagtcctgaactctgcgccgtcctcccagcctggagactaacacattcatcttcccacaccctccaccttgcctcgttgtcttcgaggggtgtgcttagctcccagatgtttccaatatcccttcctgtggccattccccggctacagcctgacaagtgcagatttactgctgctctctagagagcagagttgcatctgtgcagggtacttgcttctaaaaggtcatttcctgctgtgaattccaaccaccaggagcaagctggaggttgcccttgttctctcatgtcctcactttacttgggagagaatcagtaatgctggaagcacgtgacgtcacatgacaatgggacatgccagaggtcgaccgtgtcaggggaaaataagaagatgtttaagctcacttgagctttgacacgtgtctaggtttcctagtgaattagagggaagggtctgagtttgaattagtcagaggttctgctcctcattgtttataacacctgccaagagcataaagatagcccacctctctctcagttgaatctcactgtcagttattatactgcacttctgaacagcccaaagcaaggaatcttctttattttgtctttgttcattgacacaaaccacagcttatggcagtggcgggggacagccagcttatcactttttctcttaattctcaacttaaatcgtttaaaaaatgcagatttgcttccttatcattttaagtaatcttgagatgagttatttgaaatgtagcacacccttcctgcgttatgattttaaagtaagttttcatgtaaagaatacgattctccttttttaacccacgtggccgctgccgtccaggctacttgtcatatcgattaagtctgctcatcgaagcatcgaagcattccagctccatgatgataaaatctagtttacattgttctgccctcaggtggccaggaacactctggttttaaggcctgtatgtattgggcggggcaggtcattcccaaggccctgctggagctgctgcttggtctctccaagccaagccttgcagcctgtgtcatcacgtttgagaagcgcccaggcagtggcttagctcaagtgtttaatgtggggaacgtctgcctgctgctgttttacagtctgtttgcagttcacttgcaccaccagccccaaatgcagaaagaaaaattacagaaaagcacagaacacgctaaacccttgaaattagtggaatagtaataacggaagaacggaggaacagggctgcttgcgggtgggctctgaagaaggaaggagaagagagtccagaacggagctggccaactcctggcatacctgtggtggggagagactgccactcctcaccttggagctgcccggaagctgcaaagccctgttgaggagtttctgagatctaggaagcagaagacatccaacatgtttcaaacttggtggaaaacaatggttccctcccaccctgaaacagtagaggatgatctgggaaacagcagctgcacagggtaggggtgggtggggccgacctagtgaccaggctgcactcagacgcttagggaccagagaccaagtgttaataaccaaggctgcactcagacgctggttccagtttgcatagcatccgttcatctccgtcgagcaactcttgagagatctaaaggcctttttgtgtttttatttggagaacctacacagtcacagctcccctctcagagtagagtggggtggattagtgatgtgccatcccgccccagaatactcctccttactctcaaatcccggatcccaggagactgttgggttatgctgatcctgaatgacaatgctttaaaatacttactttgaaataattcttatataaggcttttctttgtcttaggaaattttcatccagagctttgagaagtcagggttctgaaatctgtatgtcatgatgctgtggtcttggtttcagactcagcaagaatgatgggttttggttatttattatatatatttttttaatgatttaggtagtacatttgtatagcctgtataccactgagtgtgtagtgatttgagattgtggcttgttgttcttggtggtgtgtgtgtgattgtatgtgtgggtgtgtgctttagtgtttttgaagcaggctcttgctgtgtagcaccagttgatcataacctcgtggccttcagcatttcaggcacatgccacactcctgctaggactggtgaattactgttttcctctgttatcttcatgcctttatggtcatggctatcactaatagtgttgtgggccatgagaatgacaccatagctgttgctgtgacccaggactgtcttccaggtatcatctcatcccacctctttttggaaagcctgtggtcctcctgtgtttgttgcaggactattgctttctaatgcactcgtttagacggaaaacttgtaagtcttgtacaacttcctgggttgatctggttctcaagagtgctgttcttccagctcctgtgagagtggtgagggcactaagacttggttctgagagagatctcatcttcagtttgtagctgtgtaatttaacaattgttcttcttcttccgccacattctgaagacacactctatgttatattgtgaggcagatcagaagaaataatggaggaactgtcaccagaagggtggtcttctggccatttagagccaatagaaatgccttctctatgtgagaactaaaaaaaatattacagaacttgtcaccaagtcctatacatgcactgtgtgtgtgagccacgaagtatccaacactgccaaatatctagctcaagatattgctgtctgtgccttgctacaaccataatttttatttgctgtaaaatgactacagctctaaaaaatgtgatcagagagcgaagccgttaaatgggttattaagtatgcctatctcaatcttacactgaatcaaaagaccatcctatccaaatatccaaaccttgtataaagcactgctgttgcgtctgtgtgtgcatatcatatttcctgatcaggagcctaaggagtccagcatgctggggaaagacttgtttatagagcgctattagggagatgccagataaagaagatttggaaattaatatggctacctatgtgcgccttcctccctctgctttctctagaattgtctttgtctctggtctaggaaagtgttaggcagatatggacagaatgctgcctctttgcttactaattaggtcagaaaataagaataaatatatttctgcttcttcataggcaggtgaaaattctctttctaagaaacaccaggaagggtggtgcccactgtctggtcaccaggcgtcaagtgtgtcaccgtctagtttgccatcatgggctactatttctacaggctccttggagggccaaaacacttcttagacattaatagtcctttcatattttccagaagttgtatgaattaacaataagctggaaacaatcccacttttaaccggcagagatgcacagaatggaacttcatccagccctcgctcttgtgtgaggagggatttactggacagtgtaaattcatcaaactgggttgtctgatattgtcatcaggtgttgtgagatattgaaattcagagactcgtgtctgagataaagtatctcttctcataattggatgttactagcagcaggctccagactttgaatgtaccagatgccatgaaagtttatgattgtctttctgagtgtctttaagattgttttgctagatcccagtgggaaatgcatctccaagcccacaaggctgcttctctgttacacagcagggccaggctcttccccatctgtctcaaacatagatttcagcctgaaattgagaagaacgtgtgccgtgttaagtcattaacaactgtttcaaaacagtctgatttctaacagttggtgcatgtggagacacctaattaaaataattccagtctcgttaataagataagtgtgttttctagttgccatgggattatcactatcggatacaaagggtttgaggcttagctgagcaaatgaagcttatatttcagcccctttattaacttcattatgatttaaagagttaaatcctcttttcccattacattttcattttagtgaacagaaatgggggctgggaagatggtccccacagcagtgtgagcagcagtcatggcacctctgaacccaggagactgagctgccatagacgtcacagagaaggaacacataggtgcagtggactgttagcctctgatagtcactgacactgtcttgtccataagactttgagttgaagagtccagagtacattagagtgcattgtctgtgtccttgttctccataccttcttagccatcaacgtgctggtgctgtgaaggtgcctctctctgctgctgctcctctgtggttccagtgctgccgtggctccattgttgcagtgctgcagccccagtgttgcagtgctgcagccccagtgttacagtgctgtggctccagtgttgcagtgctgtggctccagtgttgcagtgctgtgggcccagtgttgtagtgctgtggctctagtgttgcagtgctgcagccccagtgttgcagtgctgtggctccagtgttacagtgctgtagccccagtgttgcagtgctgtggctccagtgttgcagtgttatggctccagcattgcagtgttatagctccagcattatagtgctgcagctccattgttgcagtgctgcagctccagtgttacagtgctgtggctccagtgttgaagtgctgtggccccagtgttgcagggctgagattccagtgttgcagtgctgcagccccagtgttacagtgctgtggccccagtgtttcagggctgagattccagtgttgcagtgctgtggctccagtgttgcagtgctgtgggcccagtgtttcagggctgagattccagtatttcagtgctgtgggcccagtgtttcagggctgagattccagtgttgcagtgctgtggccccagtgttgcagggctgagattccagtgttgcagtgttgtggctccagcattgcagtgttatggctccagcattgcagtgttatagctccagcattatagtgctgcagctccagtgttgcagtgttgtggctccagtgttgcagggctgagattccagtgttgcagtgctgtggctccagtgtttcagggctgagattccagtgttgcagtgctgtggctccagtgtttcagggctgagattccagtgttgcagtgctgtggctccagtgttgcagtgctgtggccccagtgttgcagggctgagattccagtgttgcagtgttgtggctccagtgttgcagggctgagattccagtgttgcagtgctgtatccccagtgttgcagtgctgtggcttcagcactgcagtgctatggctcgagtgttgctgtggctccagaattgcagtactgcggctccatgatgtttgttcagtaaatagcaaaggtaaaataacctacatattccctcccacacactttactctctttgatgtgatcacttcagaatctcaacaaaggacccacaggggccagagaaatgggccagcagccagtgtgcttgccaccaagctgatgacttgaggtgactcttgaaaattgtcctctgaccttcatgtgcatattgtagctccccaataaatagaaaggaaagaaggggcccaaaacctgtaactgtgcatatggggacgcttattctaaaatctgaagaacattaagtcagatcattttgaaaaagttcctcatgctgaactgcatatgagaattaagagtgttatgacacgaaagccttctttagggaactctgaacaaaggcagacttctttcttagctgctcagtgctggagctatttactcaagtatgtcttgagaacacacactgttaaatgcaaaactgctacacatacagaaaaaccatacatttcagcagattctggaaaacaaaactttctgtcacattccacttctgtcggacattggccactcccaggcctgtgggactggatcagtttcctgccactgctgttaggcaccttctgtatccttcatgcttgttacccacaccatttccccagagttcatgcccttaaaactacaattgtctcctgccctcagcctgagtaggctttgacacctaagggcagagttactgtttgaataatatgtcacgtggatgaactggggtggggagaggagagggggagagggagaaagggagagctggcgggttggaggaaggaggaaggaagctggaggcaggtgctacaaggcaggtgagggagctggcgccatgggaggcaacacctgtacggcatagctgaagtccatatttgctgccctccccatgtccttattgcatgttccatcaggaggagaatgaacacatctgatgttctaacttcctgacaaatgaggaggttccttcgttggtattgagcgtcttcttctcctggatcctgtcatttgacaagcaaacgtaccccaagccaagctgcacatttgaaaatgggagcttgttactcaagcgcctgggacaagcggttcttaagagaaacatctcaattcattgtctctgttaactttcctgcttcaccgacatcctctcaccggcagtgaatggctgcagagatggtgttcaggagggaatcctaagccatggctgctttggaccacacaaaactacttacctgtgatgacaaggaggccactaaaactgccttctacctgtcccatgtatgtgagcagactgaatgagggcttttcaggcagcatactctttatagccaagagacagctataacccaacaccaggtgtgttgggagccaaggatcctgaaggcactattggccttcacagacgcacctggctcaggtagcatctatttagtttattattattaattaatacttttaatgtatttacatgtgtatgtgtggtatatgtgtgtgtaccatgggcatgcatgagcctgagggcgtgagaagagggctctgggtgctcaggagccagagtgacaggcagctgcaggttgccttgtgagcactgggaactgtatccaggtcctcagtgataacagtaagcactcctacccatcgagccaccgccgcaggccctgttttagggcccaaagcagtgaaggacttgagcaaatgtcagcaaagctttgaatctagaactcagacttgtaacaaacaagggaacagctgacaccaaataagctgaacgttcaaagtggagtgcacctgcctgttctaaagccaggccacctcatgggcactgacatcaccaggattgtggggtatgggacgtgtggcgggacagtactctccttgtgtgtggtctagatcccagcaccagtctcagagtatggaatagtgttctgttccttccaatgaacttggcaagaggcagccagggtttctgtgtctcatttgcttaatggcatcccccaggaacttgaggagcatgttgtctgcagtttgaacatgggtgccccttaggtgaagttgtccttttgaaactgtgaagttgtgtaaaagtcatttgtggatcttatttcagtgctagctttatagttagaccccatggtatgtggagtcttggctgtccgagccaaattgcaagtaaaacttttcagattcttatttgttttcatggacgttcccagcagaggcacgggcaagcccagctagtgttcagggactgctaaacgctgggcactgccccagagccatctcacctaacaggatgacaataccgagaagttcagaatagctgttttacagggaggagaccgagtctgagacttgcttagtaactgttactacattgtgatctgggctttgaacttgagtctctttatgtcagatgcactacacaggtctgtacatttgagcttaaaaatgaggaaggattatagacacatctaaagggacgcttcgggaatttcaaaacactcaaatgcatagaatctcagaaagctgtgcttgggaggtgactcagggaaaggacaggttctgggctccttcagaggaccaggattcagtctccagcactctcgtcaggtggatcaaaactgtgattccagctccccagtcacacgcagctacacataattaaaataaaaaagtaaaacatttctaaaaatctcagaaagcagagcttccagtgcttgttatcaaaggtcaccaaccgacagcatgtgacacccgggttgaatttagaagccagtcactgaactggactgcaggataactaggcagagcattagagttttaataggcctcagcattgtttgtatgttcttaacaagctgggtttctcacagacccttgtctcatgtcgctgccttagatatcatttggagtagacagcaggaacctttctcctctgtgtgtctgtcaccacttctggaaactggaattctgtggaaggaacctgccagtcacaggctttctctgggtgtgggggcccgatggggtgagctgtgcacactgctctttctgccccagcagctgcctgggtgtgccatatggaaaggaaatgatgctgaagtcagacatgaattttgtactaagggtaggtggccttgagcaagaagctgacatcaggagatcttggcttttatctgagaacagcataaaagtgtcttataagtgtagtgacagtgaattaagtttacagctctttcccaacagattggtgcttagatttcccataatggatccgtaatggattaggtgtgtgttctgctgctattctaacagcttatatgtttttgctttgttttgcttgtgagatcaggtctcacatagcctgggctggctttgaactcaccctatagctggggaagaccttgaacctgcctccacatctcaagtgctaggcttacaggtatgctctaccatgtctggattgtgtgtgtgtgtgtgtgtgtgtgtgtgtgtgtgagagagagagagagagagagagagagagagagagagagagagagatcaggcctagtgtcaagcacctttacttgctgagccatttcacgggctcttctagcctatctatgtcacctggacataagctagactcatccaagagtagggaacctcagttatgaaaatgctttcttaagattgggctgtaggcaagtatgtagaacattttattaattactgattgatgttggagggcccaccccattgtgggtgggattacctgttagctggtggtcctggggtctataacaaagcaggctgagcaagctatggggagcaagccagtaagcagcacccctccatggcctctgcatcagctcctgcctccaggctcctaccctgctagagttcctgctctcagtgtttctgatgatgagctgttccatggaactgtgaggaaactaaaccccttttctccccgagttgcttttggttgtggtgttacatcatagccacagtgaccacaactaagacactgtccctaatggtccatgttttagcgaatggttctgaccttcactaggaagtattagctcatggagaatgaaatttgactggggtaatagaataagttcattgcattctcgtccccattcccaaaaaagggttgctcagacttactatgcaaataggctcaccttaaattcacagtgatcctcctgctttggcccgtgcctcccaggtgctgggattacgagcgtgggccaccacatctggcttctctcccttcataggtgccagttacttggttgacaggcatcctggcttggccatgtttcttggtcttggtgccttccacagaggggtttgaactaacctggtgagggagggagggaagtgtctcgcctcactaaccttcctttagttgagtctgagaactttgggtcttatcctttgttgatctgattcgattcatagttaagaagcagtaacctggttgtttatcagaagaggagcaaggagtgaagccccctcaagtgtggttcactcacctctcccaccgcgcgcttggctgtctcccgtgtgcctctgctcttctctctgtctccctttacagctggtttctaaccagctggtctgttccccgagggtgttttgttatctctcttttcttctttctcaattcaaacacaagcaagaattaaataagtcaaaacataatttaaagtaaaaattgtatcatttcaatgtttgatgaatacatctttatatcttttttagaatttatttttattttatgtgtataggggttttgcctgcatgtatatctgtgtaccacgtgtgtgtctggtgcccctggagcccagaagagggtgttgatcctttggaagtggagttacaaatgcttgtgagctgctttgtggtgctgggaataatcgaatgcaggtcctctgcaagatcagcaatgcgctctctctctctctcttttaatctttaaaaattatttattcactttacaacccaatatcagtccttcctctccccccagtacctcgtcatgtaaatcctcccttcagtcactgtcccctcagaagggaaggccacctctgggtgtcatacccctacacacacacacacacacacacacacacacacatacacacatcaagtcattgtgggactaggcacatcctctcccactgaggctagaagacccagttcatttaggggcgtgggatccatgggcaggcaggcaggcaacaggctcaggtacagcccctccaacagtgctcttaatcactgatccatttttccagcctctgtatttatatcttttgaaaaatgttttgagtccaagaattgagggctttcacttcacttcttttggatgtagttgtttaggatgtttaaggctgaagtagttccagtagaaatgcattcgtcagtgaagaattggctcatagtacctttgccatatgggccaccctaaatattttagccaatatttgcatattaaatcataacgttcacttacatctcaatcatactagatatggcctcaaaaaccaaaggaagggtatgtgtgtcggattgcggatgaactaattgccagcttggttctatttgcagtgagctttgcaacaaacatgttgtttggaacaacatatataatggcttaggggaggagccagggtggctctcggggtgggaaaggactgagctggcaggctggtgactggaagatggtgggtcactcctggcaccgggagaaagcctgaagtgagacttggctggtgatgggttcagatcggtacccaatttagataaggcagctgggccccatctgcggtgtttgattttgtgtgaattaaatgagatggagacttctagaaatggaaaagtaaaggtctgggctttcaaaacaaagtcgtagaggagggtgtagagttaagtattaacagtgaaaggtgtacgtggggtaacgggtggaccttcccactgggtcaaggtggtaaagtgtctgtgttcagggcagttgtcatcacaagcaatagctggcaaattctcttcttgatagacacggggatggctcaggagctggctgcagggcctcatgaggcgtgataagtagtggagctttgcagtgggtaccagctaataatatagtggcttcggcggcgtaagacttgaagagcaaagacttatctttgaacggtgcttaagataaattgtgtgattataaaaacatctatgataaaactctcttctattctccagttatacacagattgtactggaaagagctcagaaatgagctgagtggctggggaagccaggctgggatttaaatttcaaacaaaggcagacatgcttggtggttggctggagaatgacagagtccattgggatctcacagtgagtgtcactgccaagtctccccagctaacaattgaaacactttcacttgtgtaacccagattgtgtcttaacaatcacattacatctgaacaggctgttacagcctgagatttctaaattgtagtaagaaggaggctgtggattaatgcactagaataatgactgaagactgttggtgctcaggtgactggaagtggcctcactggaggtgattccacagtcagagccaacagtgaaaaggggaatactcaagattgcctcaaaacagcctttagaaattctgttagaatccatagatccagcccttggtggagccccaggtgtctctaggggccgtaatgcttgagaataagcccccccccccacactacctttcagccagtcagcagtcagtgtgtcctggtgagagacttggggacaaagctgcatgaggcccagcagattctccccttcctcccataccgggagcccacagtccgttgctgtgccttctttcccttttgtctgtattcatccagtctctgtcctttctccttctcctccatctctcctgagttcacctgggagcactctttccactctggttgcttagctcacagaaggcctgtgtcaggatctcacctgctcctcacctgtgtcaggagctcccattcatttcatccccaatagatttgtgcttagtcttggggcagctagtgtcatcttgagccagtgcctgcgctgtgctgtaagggaccaccagtgttgtctgcacacctttagtatgtccaggcctagtctacaaactctgggggtcattatgatgctttccagtgtgggggggtgttgttgggaatcctggaccaacagcactgtgcaccgtgaaagggtctttagcggagtgcatttcctgagtgtgcagtgagatgctgaatcgttagtcacaatcaccctgaggggggaagagcgatcggagaactggttctgcacctccaccctcgatctgtgctccttgctgcttatgcttgtggcctgttctgtagtatagaattttgatgctacgactgatggggagaaagagtcaaaatagcggtaataaatgagcagccattcagcactcccagtccccggagcacacgcttggcccctgccttttgcatgaccaccttctgcccttccctgctcacctgcagccaagctgtaacacgatgcaggcagattgaggctcctgtttgagcagcagctttgggggtgtggcccctcctgccctagcagttctcaacactgaattcactcttctgcctgtcaagcactgagctctgtcaccctttgcaggaccttatcaaggagcagtgagctatgaaggatgcgtaaggtacagagggccagcaagatgatctggatcaggggctgaatttcttttcttcttcctcctccttctcctctcctttctttctttctttctccctctttctcctcccctctagtatgtacgtgtgtgtgtgtgtgtgtgtgtgtgtgtgtgtgtgcgcgcgcgcgcatgcatgcacactcgcaagctcacacgtgtgggtaggcttgaggttgatgtcatgtgcttatctcaatgattctctgtgtagctctggctggcctggaacccactgtgtaggcgtgactggcctgtctttgcctcccactgctggaatacagacacatgccaccatgcctttgtcatgtgtgacctagttcgttcctcttgctagcacagcaaagctcgtttactgactgagccgtctccctcgccttgggtttatttatttatttatttatttttgctttgtttcagtatcagattcagtaactggtatagtaaagatgttccctaagcacccattgagtttggattttaactcatcttggttcttaccggtgagttggtctgccatgcagtcagcctttctgcagcatacttttagcgacacagccctcatgtgccgagggaaaggccaaggctttatttctggtaaacggtagtggtagaaagtcagtcagggttaggagtcctctctcaggcctcatctcctgctgtcctaggctagcactgccccatgggaggggagcgcagcattttgttcagtctggcttgaggtatctgagggtttttattatctcggcgaatctgttggaagctcctctactgccgtatagatttcattttctttaattgggatggagatggaggaagaaaatagcatttactaggcattcttgccttttagagcggtgggttattgattcaggggcctgcaatggtaatgcttggaagtaaagtttccctggggagcacctgtgttaaagggcaaagggaaaatgattagaatttaaatctccagactccactgaactcgtggcttcattaaaacaaggaggggaggaggaaatgatctgggctgccgtgggctttgtttaacactcgcatccagaaactgataactcagaataaagcccccacaagagcagctgcagggcccctgagccgccgcctgccaggtgtcggcaggccagcgtgctggggacaagctccagcttcctgggagaggcttgaacctttggcttcctttaagctagtttaatctttcctgcctgtctgtgatcatgcatcacaaagctacaggagcgctcgcatacgtgcgcgcgcgcacacacacacacacacacacacacactcactgtactttgatgtgtcactatttagaaattggaggaaagaggctcatgagttgaacaccagcctggatttgacagtgaatgctgtctccatttctaaagactttccccaagttggaattgcctttcagactatatatctgattcttaacattgctactttaaacactgtattatcttttctatctattagcagctaggggcgggggaaatgtgactgtgggatacggaaaatatattggaccagaaatagattttgccaccaaacagaaggtgaccctggaaaaaaaaccacccaacctccttatcaaaattcctaggtgtttataaagaactagggagttacacctgaagtctgaggttgaaaattcgctttacactaaataaaatatagtccatcaatcttctaacatctggctacacaaaaccaaaccaaacaaacgaacaaaaagataaaacccaccccccacccccaaaacctccctatgtcctttcacgtgtacagctgccgtgtgcagaagctgcggacagcaggcgctctgaggagtgtgtctgggatgcagctgttgagctgcagtgtggccagcctctatttgttggtttcctcacaagcagtgagggctcaaacagcaccagcaaacagacagagggcactgccgttatccagctttcttagggagtcaccttcttcccgagtctcctaaagtatttaatgtggcatatagttcttgtgcacttttcaacacatagaaaaggctacctaaacattctggaaagatgacagttgccctctcagacttacaaatgtggaaggacctagaggaagaaatcagagcttcctgcgtgtgctgctaagtcagcacacagatttctgaagtctggaaaagcacctttcgataatacttaagtttacttcaaattctgtttgaatgtatattttaagctacgtgaaggggctcaggagttggtgaacctgctgttactactgtgaccttagctcagccactaccttcagggcgagcaaatgacatagctgctgctctgcaaatgatgtaactgggcgggcctgagcgtcgaagtgcccctttggttgatcctgtataactctgggattaggactgagaagccttgaccgaggccttagccccctccctccctccctccctccctccctccctctctccctctctccctctgtactggtcatagttataaataattcccagattcttgtagtttctagatgccatctctcaatgcctttcctggcctggctcacctggagactgatcagccacagatcacagcagtgcagcagctaggccttgactctgtgtgtgtttctaaatgtcattgcttttattcaagtgtgttttgtaaggagagaacatggtgactgagcatggtatctcagacatgacacgtggggctgtgtgtacacgtatgtaacacacagcaatgggtagtatggtggtagccgtttggaaagcaaaagtgttttctagtgcagcacctgctctctggaaaagggaaaggaggcagcaaggaaagacaggaaagcaggctgactgagggattggctttaaagaaaatagtgaagatcctttactgagttcacgcatatatacacagacacatgcacactgctgggtgaatatgaatgatcggggccaggctggacacacagctttaatgcatcctcactccaagtttttaaactgaagctcaggctcctgcttagaggcttgaactcagggtgaactggggaggcttccagctaaaacagtgtgctgagtcttcatcttgccgacagtaagatcattcaggctcaagtaggacgtggggctccagctcgcgtgggcttttgactttctgaggagaagacaaaatattgagcaggtgaggacagcatagtattgtacgtgctgaaatccaggcgatgttgaatgccgtgtgctctgcgcactacagctttccacagaacaaagcaggagacccttggctctgggggctgggcagcagccccagcggccgtgagagtgggcatagcaatgtccctatttgtcttgcctttcaattggttttgtcccatagtttaacatcaccagagaggtcacatcgcttactggggctttgaaagtcagcctgacattgatgcagataagattattgtgcacagtcagtgggtctgctgtaagcagagcctgtggaacacaagcaaatgcaatgtgatcagagaaagacgccttaggtgcggctgagggtttttagggatctcagatgtggacatgaatatcaattttaaatttaagatcttgagaataatggatggaatattttcagttgattccaaaatagagtgcagtcaagtactagacttttgactttggataaaaactgagtattttcctataacattattctacaaaactgtccactgaaaagtgacaacttataagcaatagtagggctgactacagccctattattattaaaagtctgtgctaccttgagccatagaagcatgtccaagcatgtatgcatgtgtaagcattacccctcccccacaaaaccaaacaacaacaaaaataatagaacttagacatacagctgagcatgggtgtgagtgccaaggaggatattgaaaatgtatgtggcaaactagtatggtgaaagtgctgacttgcagaatacgagggggaactggaagtgaggggcaccagaagtgtggccgtgagccagcagggtcatttattaagcggccacaacaggagaaagtctggtttgaggtgagaactattcttaaccttgtgtgtggatgatcactttagattttccttaaataaagtgagagccttctccgtagagcagcctgcagtagctgatttactcttcctgtggaattctattgttttccactttttgcctagggaaagaaaaagaaaaccccacacaaactgtaacgcccatgtcctctcgggtctcagctaagtggtcagtggaagtgtgtattttagcagaagagaccattaaggtctggaatgtttagtggatgcaaccagaaataaacagtgaaaagtttggaagtagctctcctgtgctcgctccagaagatgagctacatcctgttcctcagcggcctgcttcataaggccaggtattgttcagctcgtgctctgcggtccctgcccacgaggcaaggactggaaaagagacataaagttaacatttgaaagtatagcagaaatgggcagacgccaaccggcggagttgggtgagtctttctgtagaaaatggggtcccagctgggctttgaaagactgggagagcttggcagacatgctggagggggaagtatttttggcagaaatggagcatagaacagaaatagtaaaatgtagaatgtgatcagaaacagggagtagaactgtggatggaattaagactgcacagaggcaacgggatagaggtaattagtgaaagacacagcccagcaaggggttggatacaaatcatagaactctttgaaagccaaactaaaggtccagtgagatgggtcatttggtgctcactgccaaggtggcgtcctgagtttgatggccaaggattcacacagtggaaggagagaaccgacccctgattgttgccctctgacctccatatgcatgtcacggacttacaccccctccatgtatgtacgtctgaatacacaaatcccaattcatgcaagtaaaaataaaaatagaaaataggactaaaggactcgatttgctctcagtagagtggtaagccagttagagttgtaaaggaggggtgacctaatcagagtttggaaaggtgcaaaaaccttgacatgggtgactacatgtataactcagttatacatatggctgacctgtatttatttcccacactagtcctgaaagcattgtatggctagcatttgaaaccatacaatgtttctctgtaccttttgttcaattttgctctgaacctaaaactctttttaaaattgtatctactgagttggtcatggtgatccaccttttgaggctgaggcaggaagatgagatgtctgaggtcaaccggggctacatagtgaaacactgtgtcaaaatcagaaccaaacaaaactaaagaaaaaaaaaaaaaaaaagaccagattatcaattaaggccagaagaaaagccaggagactcgatgggacgttcctgtaatcctagcacgtgtgagatggaagacgagggtggggagcttagcaacactcctgcatacacagccagttcctggacagcccaggcaactgaggtcatgtctgagcaccaagccagagccacctacccactactgtctccacttacacaggagcaagccttctgcatcttctcagctccatcatacaaagatgggacagagcaagggtcacagggaggccgagagagacagtggatatcgagggccttgtggggagtggggagacgtaaagtgtatggatataggcagagagtctagagactcatggcacagaagcagcagaggtgcccagctgggacccaggcaacctgccttgttcacatacgtaagctgcacttgccgtctgcctgccacgctaaggcagtgcagagtcagccctgagaagagcaaagtcccagcttccatgtaacttagcttctactgagagagagaacaaatgtacgtcatgcatgctgtggaactccatcactagagcatggtatgccacggctgccttgaaatcagcgtagctgtgatcatctacgcaagaccctctgggattagcttcattagcattctcttgtggcaggagaggagggcccgtctctgtctgtccatctctctgtgtgtgagtgtgtgtcagggtgggaaggccactcttcatggttgtggtggtgttgtaaattggttgttctcctgtaagtaacccttcacctgtcttcctgtgagcaactcctaagaactgcattgctgtgccaagttagacttgagctagatgctgtatggagaatatgtccagtgtgcaaaggctggatcccaggaggccattgaaaggtccatgttatctgagtgagagttgacggcatagttcaaggtggttagggggtgctaggatatgtttgtttgtttgtttgttttctgagagcagaactaagtgaagttttggaaggattcaacagggtcttaacagaaagtgggattcagatatttggcctgagtatctagtggattagagaaagagaatgtagacagagaagatttatggagaaggtagctggaattaatggtttatttttttatgactgttaagcatctcagtggttatttgagtacgtacatagaattcagtggagtaatgcattcatagttaggctgtggctgtggccagttactctgaacaggtcgagctgggaggaaggatgtgggcagttggaggcaataggtgaaggagtcactcatcctacttgatacggttctcatcaaagaaggcgcatgaggtctgctcaccagatcttccttagtccatcgtcaaacaacggatgaagatcaatgagaggagtcagtgaagggatgaaggagcttacacccgcacaccccacccacacacccatacatctgagtccttaactactgtctgccctgtgtggggcctgacactctttgttatggggacagcatgggaccttgagacccaacagagctgaggattggctcaatcaaacaagactgagaatggagctggtgtgacgctgccgtctgtaaccttgctcagatctgtcatcctgaaggtggttcatggaaatgggagacagagactgaagagatggcccagtggttcagggcgtgtcctgctctttcagaggaccctcatgtggatcctggtgcccatgtgaacagctcacaaccacctgtaactgaagctcggggaggcggggcggagggaggactcaacacctctggcctccaggggcatctgtcctgcaaactcccccacaaggactatacccaggcacatgattatataaaggaaaaaaaggaaaagtagtggctaagaagtcacaactctttgccttttgagattctgctactccaggcatatgtgcttagggggatgttattatggatggattttcacttttgttattataaaatggttattgtccaagcttaatgtccacttcattggtggacaatagccccatttgtcgaaaccatatagatcagggactctctcttgggttgtttctttgggttctcagtccgttccttagccgaggccatgactggaagcatttgcccaggactgctcactggacctccaacagtacagtccactgataatccgccagagtcaggtctactctactgtctctgttttgaagatgactatggcacatttgtgagaagcagctctgggattgaggaaggaagatgatgtggagaaggactctggccatgtttgttagagagcagtaagacactcaacggccgtcattgctacaccactgctgtttgcaacctcagtgaaaattcgtgaaactgatgttgagccttggttatctggatggtagttcgatgtttgtctgtgatggctaggatcatgccagcagtcctctcttgctgatccagtaacgaggttcatgctgttcgttacaaaggagcgattacgtcctgctattgggcctgggctgtgtctacaatgcctgtcttttagctggaagtctggatgctggctatccagtgccttctcttttgttctttagccaaatctcaaagaacaggcactttctctcctgtgcctcccgtaaggacattgctaatgtgtctgagagtaaatcgaggaatactttgattagtttttaatctaatctctcaggacatcagagaaatatatgtttggaaatataaacaagacaatttttttaatggaaaatagcctataaatcttgccattttctttggcaggacagtattaacatctggttagcaaactgtggtacccttaagagaattggagttggtccaatttccaataaaatattggattaagtgacttcgcttgagtttttattattttcaagtacatttttaagcctctcttctccctgtaatttgcagtccacgtttcctcataagctgtgattttcgtaagatgaatcactctctccaccaacatgtgtaggccaccacagaaacaacctcagagccgaaatgccaggttgctgaccggctgcagaccgggaggctccgtctcctaagaggcagacgttttctggagtcttctggttgagagggaggggcctggtatccttgagtactggtgtagtaccagcgacttgctgtgtctgatgtacctcagccccaaggcagcctctggtaggctcattaagtctgaagcacagcatatgtcatgctctatctatttcggagtggtcaagactagcagatacagaggacctgtgagttccctcattcctggccagtagtgaagctgggaatacaacctcaattacacattccttgtaaaaccttcaatgcttttattaattattccttactaacattatacaatgtactttgatcatattcaatccagctcctccagatctcctcccacctttctgacctgccaatttcctctttgtgatgtgtgtaccttacttatatctgtgttttacttaaacttaagtgtggtcaggtgctcttgaccactgagcaactctctggcccaatccatttctttttatttcttatcacccgccaagtctaatctgtgctgattgggtactcatgggtatgtggccgttcctggagtgtggttgacctaccaggagtcagtgccacctgactctgctttccccagaagccgtcacggttccaccatgagcccctccccatcccacactagaatgctgtgatgatttgtacatgctcagcccagggagtggcactattagaaggtgtgaccctgttgaagtaggtttggccttgttggagtagatgtgtcactgtgggtgtgggctttaagacccttatcctagctgcctggaagtcagtcttctgcttgtagccttcagatgaagatgtagaactctcagctccttctgcctggacactgccacattcctgccttgataataccgaaccaaacctctgaacctgtaagccagccccaattaaatgttgtccttggaagagttggcttgatcatggtgtctgctcatagcagtaaaaccctaactaagacaaatgctgactggctcagtcatgtgcaagcaaccacattgccatgagctcgtgcgtgaggccatcctgtcattcccagaagacgctgtcatctctggtcctccctgacctcgtgccttacagtctccccccccccccgcacctcccccacagtgacccctgagcctgggaggggaagagcatagccatcccacttatggctgagcactcctcagacatggattctctgcactctgatcagcggtgagggtgtgtgtgtgtgtgtgtgtgtgtgtgtgtgtgtgtgtgtgtgtaccaccgtcctcagcatgaagaaacttctccgatgaggtccaggagctgtacttgtctgtgcaaagacacacatggagcagtttagagagcagctggatactgcattcatttagcagaatatcagtggtaaattctcccctttggcctgtgagctccctcaccatatggtcttggctagatttatactaccagacacgcatttcctgttgattaggtcttaaatcccaattggaaagctgttggttgcctccataacattcatgccacgattgtgctcttacgaaaaccctgccacacccaccacaaactacgaaagtttcgcctattccactgggtctccctatattggttttgagaatatgatggtgtcacctggagaaacttgattgacttattttcaaattcagtcttcttacccaccatccttttccctgctgttgtaagtccagtacaagtatatgcccaagaccaagacgaatactgtcttatcctgtctgggtttgcagttgggtgagtcaaccagaaaggagagacacttcccaggtgagggttgtcgagagcataacccttctcactggtcaactggaggagccgggactagtgtgtccagctgtaaagatggcatgatggtgcattcttatgttggagaagaggattcacgggactgtagggtggctagtgggtagagtatttccagaagtacctgctgagcagggttgtgcttgctccttgttccatacaactatagtcctggttgacatgtgcaaagtggagaatcgaatgctgtctgtcatcttgtggacagggatggtggacacaaagcacccgtgcttggcactcttgtgtggttggatttgaggaagatttattgctgtcacacatgctacaactttggagaggagggattttttttaaattttgttttatgtaggtcatgaacttgaggcccttccaagagtgtggcctggactcactatttctgtatactgttgtttaaataaaacaagatggagttgttcctctcccacgagtgacctctgaactgtgctcatcttggagtttacctgtattgatagtggggccttttcacttagaaatatcagacctgcagaaaagctacaaaaaaccacaagagagtcctgatacccagacccagctggctccaggcttgcgtttatgaataggggaagtgcagttgacatccagttaatgcagactctggactttgccactcgtggccacatcaatgctaaaggaaggccccgggagcctgtattctgtgtcatcacgactgtgtctctgtttcaggaaggccctgggaaccttccatgtcatggctgtgtctcctaatggcattgagccttgcctttgccgtgtcagactttaacactttttgtagtgaaagtctcctgtgctgagttctttcatgcctgacgtgtcttgtgcatgcatgcacacatacacacagagaataaatgaacactaaaggcagatgcctaggaccaacaccctaggtcatcctgttacctccaaatgttctctaccctgacacacgtgtggccaccctcccaggttattcacacacacttagatcacattatgtacacacttaaagaagctgatcagatgtgtgacttgggtactatctgttcactgattttttttcttcatgtatactttcctgttcttttctccttaagactcagccgcaggtcttcaggtttgctagacattactcctcattctgactcagggctactggaggttactcctgctctgattttctgttgaaaagtgtttttcactttcaattgcttctgccagtgtgtctctgaatttaccaaccttcagtttggaatttcctggttatccagacctctgttcccttcctgtgggacattgtagtttttgtttctggacctttaatttgtgtctttaaaaggtactttccaatcctctcttcctctcaagcttccctgtgttcagaggcctgattgtaacctctctttttatgtaatctttgtgctgccctgtgcttccccttggtttatatgcgctgtgttgcttgcacagatgatgcttgactttctggtatgctctgtgtttttgtatttaagaaatgcctttagactgttaagttatgtggagttggcttgctttatctgacccttgctttcagtctgtcagagtgagactagagcatccctggatgcaggtggattttgctcactgctgaggcagtgactgctgggccagctgggcccttctgggatttttccttgatggcttgtgagctctgtgggttatgagctgtctagggttcactgctcatatcctcttaacctgtgttagcctgagaatgctccgcttgcttgctttggggctctttccccgccgcagggacgtttttcttaggatgtttctccactgaaggttcagggtgacagcaggagtctccttccccaggtgcagccatcttcctttccaggctcctgtagtgaaggttacactctgctccatcttgtcactctgcctctggagtctttcaggttcccattttagagctgggcaggtgtgggcttctatattctctccatcacaggggctgcttatctcattacctagtgtcttaaaaatgctcagttgtagatggttttctccagggcattttgttgttttaagtcattaggtaggtcattctttttttttttttttttttcttactccattttggccaaagtggatttttaaaaagtaattcaatctcctcgaattctgacttactcacatggaaacaaagacaggacaatgggtttgtgaagaccgagtaagatggcatcaattctgttcctataacatatggaatgtgaggtgccagttagtggctgtggtcacatgacaaggggtgtgaagggagccagtgcctttgttctgattccattttctcatgatacaaaagcaagagctgcattctacgggtaccccccataaccccttcccatgcttgcttatttttagccgggttacaacatcattccaagtactctaaatatctaaataatataggctgtaagattgttctaagtcggaaacgtttaactctggcactcagccctggggtgaagtctgtctccatctgcctagttgtcactttgtgaattagacagccctacaaggcaggcctttgggagacataaaccaatggacacactccctgtcacaaggaggggccttcataaatagcagcaaagtttaccccagagatccgaaactgaaatgactacctctgactgctgacctcccaggcaccacttgtatgtttgtggccttgtcttcccctgaccccctttctgagacctatatagatcatacttgttatatagaccaggctggccttgagctcacagaagtcctgcctctgttgcatgaatgctgcagttaaatgtatgccctattttgcccagccaccgccttcttcttcctctttctcttcttcttctaggcttatttatttattttatgtctatgagtgtttttcatgcatgtatgtttacataccaatgtgtgtgcctggtgccctgtcagaagggggcatctgatctcttgggactgtagttgtagatgcttggaaactgacatgtgggggctggaaatttatagtgctcttggctgctgaactcagcctgtggccgagtcttttaatgtatactttaatagtgtgtatgtgtgtgtgtgtgtgcgtgtgtgtgtatccctcaccacaatctatttgcacacattttccttatttgaggcctgagtctctgtctctgtttcataatgagaaaactgagactcagggacagtaagcagtaaccttaggactagggatccagtaaaggacccagcccagagagcagtgtaagagctcgggcgtgatggtgtgcgcctcagaggcactctggaagctgagctgagctcaggagctagaccctgatctggaaacagagtgagacctttcttacccctaaccatacaaccatccttgacattgtccatgttgcttcctagtgagacactccactgcaggttgctcacccacaatggattccgtctcctttcagggccagggcgagggccaccatactgcttttacttcatctgttggccaacactcagtgtttgcacattatgaaagaaattcacggtatctaggaagagaaaaacatgacttatattcaaaagtttacttcttcaggttgaatgtgattattaaataacaaatccagatttgctaaagacaatcctataatggcaactctttttgtacagtgtaagcatgtaactgcattctcggattttaattttcagagcagatatcttcttggtggctactactagtattattttcttttcaggctaaagcttttccagaattacatcaaatggagctgctgttcgccaatttcatggaagttgtaataattcctttagtaggttctatttatagatcaaatgtctggctaaatataattacttacagctaaatccgatcaaagcaataagctcagaataatttatatggaatttaaaacaaaggagggaggcagggcttgcagggaagggcgttctcagttgtttctctaggaaaaaatggctgttttttcaagccattgtctatatttgtttttaaaaaccataacataacaaaacaaaacaagtacccagcctttatctcatcagagtgtccttgaaggaagcagtcttctcctcagatttaagctggtaattatcaggatttatgcgtggtaactgataaattatatttttgttgactttcttggcattagagcagttgtgttctctgaagggttccgttcctgtcctgaccagtttctcttttgtttgtggggatcccgggaagagaagcacccctcactgtctgcgcaggtttccttcaggtccctggagacctttgggaagttaattactagtattatttatcccctcagctagagttgggggcttcacaactacctatcagacaagcttccatccctcgagtgacaggtctgcagcctgctgtcaccaaaatgcctccagttaggtgtgctctccttgcttctcaagtttgaaagggatcgaggttccctggctgtggtttctggcagtgccatgtctggagccaggcagaggtggttcctccccctgccgcctggtgggggtcgatggctgctctgtcgtccccccaccctctgctctctggacctttcctttctgcttttgttgttcatgattctgtcttcccttcctttctctgtttccccacctttacctccccactccccctccctctctctccctctctgctaacccgcttagttggctttctgtctctatagcatccgagatctataaagaaagaggtcttgctgttgacagttgtaagagctctaggatgcgacttggggggttgtgctgctctgtgcctgtggggaaggagagggaaggtaggtccttgttgcacacattgcacttgagagagaataaataaaagccttgtggtaagagcagttctaagaggaagacacaaacccgaaggaccacacccctccgtctctctcacacagtctactcaaggacagcatgtatgatgtgggtgagttgttactttgaatatttgcttactaatgtgggaccaaagcacagcacagagagagactgaagaccagagaggactgtcaactgttaacaacgccaacagtgcaatcccatccgagtctgtagttgcggttctcccagctctctgaggaacaacattgaggacttgggcagttgtctacattttcattcacctttgacatggagagatggtggttccctcaagcacagcatctgccaggctggcttgaccattacaggatgcttgggtgataattcagaatccattagtattaaagtcaccctcctgatttaattatggcccttaaaggagcagtacttctacgtggccaaagatttaagcttgataaggttcagactggccagctatttgaactagttttttaaaacacagccattaagttcttcatctataaaataagagaattttgctttccaagccccccctccctttgtctgtgactttatgtttttatcctttagataaggaacatttcacaaattgccacttggggactcaagaattttgttcaaattcttgtttgtatcaattccccatcagtatatgaattttttccccactgaatggagctttatatcttctgggtttaatctgaagatcaatcagtacataataataactcctcaattacccatctaatagagatgaggaattgtttaaacaaagtatcccttcattcattctggaatatactgcagcagtttcctcccactgactatcctcaggtcagagtcggacactgccaccagccaccctccatgctgtgtctgactatagtcggcggctttgtaggcagagcaactgtgggtcgagcgagctgcgcgatgggcttgatttggtaaagaagaagcgagggtgctgggtgggaaggcgacaagatcctcgcttgctaggttgttgggtcagcctttctgcactgtgaatgagcttggacttagtaactcagaatatggcattgacatgttttctactaacttaatcattgagtttctgagataaacccttccctttcttcaggcaagcctttgcaagtttgaggttatgcatagtgacttggggcgagacgctgagtctttataaggtgtattgtatttatatttttataaataaggtggctgggacagagagactggctgctcttgctgagggtcctggttcaatttccagcacccacatggggactcaaaactgtctatagctccatttccagggtgtccaatgccctcctctgacctcagtgggcactagggacacacatgatacagaaacatacatgcaggcaaaacagtcacatacacagggtataaataatatttaaaaataagatgaggctcgatgaactaagatacctagcattggcctctggtgtccacatttgtaatggacattagcaggtacacaacaccccagatataagcgtacacccaaaaataagtacagtgatttgagatatatactcagtctatactcagtcattgtatcacagtgaaagtttagagaggtgggctgtgtaagactggacaggacacagaattacatgtatgtaaaatgttcatttatctctcaagatgggtatatcttgctttaaagaaatgcactatacagaaagtcaggtttcaactgcagagactctaatgagagatctgtttgtagaggtctgagaagaatcaggaggctgacagaatggtgagctctagggacaacatgactggggggctggaaatagagagcgcctgaggagagacttctcctctggttgtcttatggcaggagctaaggtgggagagaacagccgggcatcagcagggctgggagcacccccctcccagcagtggggaggagggctgcgttatcagtccataaagggagctggtatggcggagtgtggatggcacttagcacttagcgtggtcaccacagaaaggacagctgtcaattaacagtaaattcaacttccaaacagagtaaagcacacccctgaatatacatgaatccttctattcttgtgcatgagaatttattctgcaagcacttcacagataatgatttccactccgccttccgcatcccttcaggagacagagttgtatataattgctaaaagccgagcctagctccagagatttgtttccttctgtaagccctcattttattcaaaaaaaggagatgtgctagtggtgttgacatttcctttaaagctgatgaaagatattttaaattaagcatgaatctttgaagacctccatagctcatttttaaaacatgacccattctctgaagtgcgtgaactgtgagaaaggagtctctctgtgtaagcactcagtgttttcttttgaacgattcattactaatgtaattatcggacttgttacaactgatcacacagaggatgatccttttctgtacatttctgcaatccacgtatctctgatatacatgggtccccatctgcgcactgcctcgcctttattggtaagccaccagagtcttcatccctgagcaagaatcctgtgtgaggaacacacacacgtgcacacgtgcacgcacgcgcacacacacacgtagccctgcaataactcttaatgtatttgtgagtcctaaagattcagcctttgtggtcaagctcccagaccctgtgaggaagcatggaagggcgtttgtttattgtctctggagacgtcaggggttcctctccagaccagagagtcacctttgcaaggtgctctcagctcttgccacaagatgtttgtttattgcactgcttgatcctgggcactaacaagcaaaaggagacaggtgcaaaggggatacaagttgagttaccaaagggacacttgcaggtccgctgagcagccactgagttctccagacaccaagttctctttacaagttaacaccataaggtgagaaagtgacctcaagggcagggcttattctagactacaagtgtctctccagaacttcctggaatcttcctgacatgttgaagggtatttattctgtcagtgtattttgtagagtctcaaaatacatgctgttcaaccttttcaagtaagtctttatgttcttttaaatgtctttgcacaccctttcagcactgcccactgctctattggtttaaacacttgtcctaccagacagagaagtcacacaccacagtgtgtgctctcgactccagtgtgacatcacgcaaatattgtagcatcgtgtttccacaacagcacagaaacattctttgtagtgttgtaacattacagtaaaacaaaaacaaatggtgggtgggtgggtgggtgtgaagagcagcgtgtctgcagagactggttgactgactagaatttcagtactgcacagagattggaatgttgcaggtccagggactgagtacctatcttggactgggtctagcctctggaacaaccatttcttgtcctcctctgtgttggaactaacatcttgtgacttctagatagaaacctatctggtgtgtggaggtagattttagcctttgtggttctccatgtggcctttctccactagggcatccccctcggttaagtccaagcaaattcctccaagaagcttgcttttccctgggtaaaccggtcccttttggagttgccatcacaccgcagagatctgttgagtgtttgttactttgattgtgattctttttgcacatctgtctttcctaactgctgttatctacgaagaccacaatcaatcatgtttacatccattcactagaactctcaaagtaaggaaatgctgagagagaggttgtgggaagaagagaggctgtacaagtagacatttaaaaagctgttgctaggaaatgcacttcgtttagatttgaatgctctcatgagcttaaagtagcctcacaggatcttgccgtttgtacaggatctttgtgtgtttacaggatcctcacatgtttgtttacaggatcttgccgtgtgtacaggatctttgtgtgtttatagggctcttggctgacgtctgacactgtttctttggataggtcagtgctgttagtaaatggcatgggaaaacagatccagtacttaagagagagaggtgtgttgagagcagcatctcaacacacagagcccacagttgtcactggacagttaggactcagaaagtccctctatccaggaatgagctggactatagaaggatttctggcagttaggtataagtcagcattcctcaggaacttgtgaaatgagagtcatttcccttgcctctggcagaggggaaatctggctctccattgactacacctgtggtgacggctatcagcatatcaaagcccacgctggcctcctggctcctgcagtcccttttcgcaagtgcccattattcatttcaaagctctctcgctgctgtaggccgcatggtgagtggcgtgccctgccacggcttttcagatgtaatttttttcattcccaatactgataaaaatagatttaattagacatgtgcaagggatctaattttggttctggttccgtattgtactactcaataagacttggcaatattttctaatatgctgacaaattcagagtagaaaagggaagtgatgagaagtacacaaaggattgtgcatgtgtgtgtgtgtgcgcgcgcgtgtgtgtgtgtgtgtgtgtgtgtgtgtgtgtgtatgagtgggcttcaccacagagaacaagagttgtgttcttgaaccatttgcagaaacagcccctgggcagagatgctgaggccattagcactaataaaaagaatcacaagagacttcctagatggcttctgtttgcttgtggcaacccctcatgacatcagctaggtgggctggctggctcgcttgcttccttccttccttcctttctttctttttgcttttttcccccagagttttccttctgtgcttgcaggttcctgtttccatttcctggcagctaagcttgtagcaatgacacatttcatacctgtctattacttcatgactttattacctgcctctattcctctctttccctctctccctccctccctccacagggttttgttgtgtactccaggcttcccacagtccatcctctcactcccccaccccccttcccgtcccccacccccactcccagtgctgaaattataggcaggagccattgctgggctcattctgataccagatggtcacataggtcacactaaagctccaggtgtagtaagagctacagtcaatttgttgctgactgagtttttttgaagggtttatttttgttgttgtgtatgtctctgtgcgtgtgtacagctatccttggactcctgaagattcactagagctggagttgaggagcttaacctggtcttttgcaagagcagcggtgcttgtaaccactctccagctcaccccacccaccccacccagcccttaaacatggctttgagagtgttaaacaagaaaaccaaatggaggaaaatgacctttaagagagcaagtggcacctcaatgtatgtcttattagagaaagagactggctccttgcagctgttgatgacagtggaggacctggggaggggcgggagggaagggagttggttatgcatttggaagcagtaacggaatagctatgttgactgcatgtcatcccggcgagatggtttgggggcccagattttctcttctgcgtgtgcacatggaaggacaggatgctgtacggaggtcagcccttgacactgctcatgtgtgggctgatgctctccttcatgctggtctggaatctctgacctgaccctgctgcccccacatctctggaccaattgcagctgagatgccacatagtgatgctggtgggctggcccgttgtgatctgtgagatgcttctttctccatgctcttggtagtatgcttggccttgctaggagcatggttgtctgtctgcctgtccatttatctgtcattggcccttagattcactactttttaactgagactgccagaaaggatttctgttttccccaaagtcattttccctggatcctaggaacaatgctgaaacacatgcagaggctctcctttcctttaatgtctgttaaaggttccctggtattgtagttacagaaagttgtgactgaccacgcaggtgctggggactgaactcgggtcttctataagggcaggcagtgctcataaccactgagccatctgaccggccatgagaagcacttatttcctaactccagtaaatgtgtctcgtgtgatcagaagcagaccttggattctagctgggtgggtgtctagctggacagttggtgtctggtttctttgatctgtctctaagtcagttcgctatgttagtttccagcctggttcaagaggctgtcctaggtaaaggctggcgtgaagtggacaagggttgtggctaccagtgaagagcagaccagtttgtggagagtctggcatggtgcctgggatggctattggaggaaaagcgagacacaagcctatcagttggtaaaattatgccaaactatgcttcagcagtgctgtgagtggaacaatctgcctgttggagttatcattggtatgtgtaataccagagcagaaaggacccaaggtaataccaagaggtgaactagtaagtaataaagagcgaagtgcgggacccgccctggaaacccgatgaagctatgtgcccagtgtaccggaagtcatagtgccccatactgtctgtccaccatgggaactccaggctcaatgcaaacaattacttcaaaataataagttccttggcaggaggtatttcatctttggagcagagaatgagttctgcaacatatgaggctattgctggcccgggacacgactttctgttctaattggagccttgttgtaggaccacgtttaacgtgccagccacccctcttgtgtgagctcgccagcccacttgtgttgcagtgtaaattgccgattaactgcttttatgcatgcagagccgacacaccacctcatctggaaacaaacagaagtgctctatggagccagtcagaagttcaagctgccattagaaatcgaaagcccagagacttcatgacaagcagcgctgtcagtttaaattccaggttttccacctagagacaggacaatggagcagggctgatggcctgtgagctgtgcattagcagatgtgctctggcaagctgagcgattgtgcgttcagatctgagatgtgcacgggcttcctttcacttggctatgatgttctgggtggtcagctgcagtgagggaggggcaactcggcaagtgcttacagcaaacacattattaattaagtgaaggaaaaaaaccaaactcgacctttgctgttaggtgatcagtttgaatgagctgatgagttaaaatgcatagagagttttacttttcaaaatactgttctctgtgtttacgtgaggacagctaagcaacatctcaccatctggaaaggttcaccatacagagtgtgtgtactgagtgggctgaagaggtggctcagctggtaagccctcttcctgttaaacccaagaactgaatttgacccctgtagccatcaattaaaaaaaaatcatagtgtggtgatttgtaatcccagccgtggggagagagacaggtagatttgggtccatggagctgcaggcaggccattcctgtctacttggcaagcttcaggccagtgagagaccttgtctcacaaacaagccggacagtacctgagggatgacattcttggctgttctctggcctaccccctctccccctccctctcccctcctccctcctcctcttctttcttctttctctctgtctctctgtctctctgtctctctctctgtctctctctctctgtctctctgtctctctctctctctctcacacacacacacacacacacacacacacacacacacacacacaaggtgctgaagaatacagctactccctgccccgattttggtgtctcctagccataactttcctggctcaagtgtctctactctttccttgattggttttcctacagtgtcaggaaatcagtcgctgtagtggagttctcacattagagagtccttggattaatggtgcatcgatgagtcattagatgaaattactggcgaaaaaaataagtttccatcacttactggttttagattacatgctggcatctggcctttaaattcctgaatatagaaaaatcaattgaattaaaaatcttgactgcaagtgacagaaatatgctagaaataattccccctcgtagctaaacctgtgctcctgtagacagatggctgctgtgcccattctcctgctttgccaagagagtcctggacctgggcagggcgtacggtgtcagctttcactccatgcttcatgtgacccatctcactttccctagtcaattataaagtgaggatacctgtttatgtacatacacacattcatacatacgtacatacatgcatgcatacatatgtgtgggcttgctgcaggactagagtgaaagggattattttgttgattcttgtttcaagcagatattacaattatatgggcacagaggagtcacagtcctgggtacatcggcaacatggctgcctgggatgtcagctgagaaggaaaagattttttttttttaactaaaaataaaatacttttacatgctatattctgaccagggcttcccctccctcatctcctccccaccttcccacccatcccgcttgagaaggggttgcttagctagtttacgttcagctggggagagggaagcaatatccttatagatgttagcctgagttactccaccagcccccgagtctgggatttaattctgtatgattgcgggccgtgtcccacgtgtcttgggtctgaaaacctgactacgccattaaggaaatggagagatggcagacacacacatagacaagctggactcaggtggacctcacacgctcttgttggagtggcaccaactaccttagcaacccaggccagccaggcaacccaggacctcagcgtgtttactatgcacagcaggaaggagaggtcagctggtctcaggagatgtccacaggcaggcagtctcaggctgtaaacatcagggaggaggaacctgccgttgctagtttttgcaaacactggttatttgttcttaaatacttgtttgctcaaagtctgtagtttataggcagggagtgtttacaaacactaatccttaggtcagaggaaggatttgccatcctgagcctgacctgaggaaggctttggcaacctcctaagggtctgaagcactggcccttgacatggctgtgcccttgtcaacaacacacagttactcagggttccctctgctttctatggttgctgtcttgaaattccaaacaaccaagtttggatgtttcatatgcggcaccagataggccagtagggtacctgcctggaaagggaaccctgcacatcttgcctccttggtcttcattaccacaggatctcagcatgccatgagcctggtgccccctcctacccttggccgagttcaggtgtagacacactggggcttcagtctgcacaccagcctgtgaatggtgcccaggaacatcacaacagtgaattgcaaataaaatttagaagtaacaggacttgcggaaagagacaaccaaaaagaggaagttctttctactttttaagacattttcattttgcactgggccccatgaattatataaccaacctggccttctgagtgtttggaatcttttagggccctatcaagacctccatgccataggtaattgtgacgtcaacaaagtcctttgtggaaaaagtagagcagacatggggtaagagtgagcaacgtgtggggaagtacaacaaaaatcgtcccagtaaatacatttattgaatcataattaccccacagctatgtctgaatcttacatagcagtaatttttaaaaaggctttaaaaagaaaggttggctttgaggaacaggggaagtggtaactggagtgagctctttgctttttgccggtaggagaaccctgagcagttgttaaatgttgaccagatgaagtcaagaggagaaaaagctgggtggggtcacttctaaattgtttgctgtgtggattttaccgttcactcttgagacgaggattttcttttctcaaagcaccaagagtgctttccacctcttcttagagcccaaaccaacccccttcccgtggctcagggccatccacacttggctggcttctcggccagcctctctgcagcagaagggcgcaacaacaaagccaggcgctctcccgccctgggctgggcgttgggttgtgagaatgcagccatgaggcatgctgggggcagctgccatattggctcttcccagtatcttgggaagctattggcaatgactaccactctttgactccctggggaatggaattaatggctcccacagggatcgaatatttaccagagcttgtcagttgtgaatacatgtttaggattatttattttggggtctatctatctatttatatctatgtatatctatatatctattatctatccttttaattgtaaaatggggataatgatccttaccttacaaagtaatagtcgattaaattaggtaagatgtgtacgatgatggaatcttgtttaagtatttgttcttattggtgaaataaagtatcctttatacaacctgggctatgatacataaacaagtgacaggacatgacttacatgccatttctgattatgtatttatttgttataatcttgctatcacaaaagttgttgttttgaaattgtaaacatgctgtacacatttccaaggggcattagctacattggtagccacacaggcaatgttactctccagcccccaaacagaaggtctacccctgggctctgaccactgatgatgctcgctccacagtctgtctccacgagattgcttttccagagtttcctgtgcttgttgattcaggttggccaggacttgctctctgtatctatcctccagcttcttttacttagcgtgatattttcaggatttagccatgttgtagcatgcatcagaatttcattcctttttatggctgaataatagtcagttatgtgtatacatcacattttgcttattaatccgtggattggcacctgaccagtttccacctgttggctctgagtacaggtgtgtgtgtgtctgcgtgagtcccttctctcagcgtttttagacacacacctaccaatgtgggatcatatgctatttctgtctctacctttttgagggcccacttagcaaaatggctatatctgtgcattcctgttacataccacagttccactttcttcctaatcgttgcctacacctacacctgtagactccttactttgaaaagcaaaacagatcaatagctgtcccagaaagtcaaagtgctacctcattgtggttttggcttgacacctgactggttttcctagggtctggttgcattgtggcctttttcctgtggtcctgtgtgtggtcgtgggtatgttgttaagtgattttatttttcttttgtgactggacttttggtgttatatccaagaaaaaaattgccaaatccatcacttaagagaaggctccccttaagtttttcttctaagagttttatactttcatgattaggtcttacaattaggagtttgaatgaggttgaagatttctctaataccatgttacagtttgtatatgttcggcccagggagtggccttattggaggccttgtcactgtgggcctgggctttaagacccttatcctaactgcctggaagccagtcttctgctagcagccttcagatgaagatgtagaactctcagctcctcctgcaccatgcctgcctggttgttgccatgttcccaccttgatgataatggactgaactgctgaacctgtaagccagccccaattaaatgtttgcctttataagagttgtcttagtcatggtgtctgttcacagcggtaaaaccctaactaagatgtaccatatggagaaagtatctcaaaacgtttggtgttgtatctaagggggaaaaagagattatggaatttgataccatgaaggtttctaagagtttctgaagtttaggcttaggtcttacaattaggactttgactccctttgagagacctgatgcctgtgggatcaggaggagtcccatttcattcttttacttgttagtctctgctttccaagaaccatttgctacagagattgcctttctccattgatggatagtcttggctcttttgttgaagacagtcctctacgtaggacagggattgacttcagacttttgttgttgttgtttgtttgattgtttgctttttcctccattagcccttggcactgttttgattcttgcaccttttaagccaagttctgaaatgaggaagctggaggctttcaactttgttcttttccatgattgttttgactattcagggttatgagagatttcatactagttttaatatacattttcttctgtctacttttagtaaatatttaaatgaattttaatttttcttaaagatgaaaaagcctgagagttccacagactaataagcctctgtggagtgctgagccacaaatgatccatcagagtcacataccctcccaaggctcaggaatgactaaggaagatggggtgagaagatgctgtgagccatgagccagggagggctgggtgctcaggactgctgagttggcagcttgtgacacttggtacttgtacaggttaggattccatcatagagaggaatgtagtgggaggggttcctgagccccagaccccaactgagaagctatgaacagttgcttgtttctagggaaaccattttttttcaaatggtgtgtctccttgtaggttggccacactccagtgggtgtccccacacccacaaacatatagacagcacactttggagtgaatgagttgattattaaatgaattttagaacccaacctgaagttgaggggtagggaggtggggggtagatctggaaggagttgaggctggctatgagaataatattaaattctcaaagagttttacgtactatttaatacattagtactaaaatcccaccttaagtttgtaatgtgctatgtatatcctttgctggacacacttgtgaatgacctctaagtttacagcaaggctgttctaggatgtagtctatctcctcactgtggggatgcctgtttattttagagccgcatcaatgtagtgacactgtcccgtagacttacacacctttgagtccctgctctgctgtttactgtttatactatgtgtatgcggagcttcaggcaagctcccctcactaagaccgcttctgtctcagaaacaaaacagatgatagagttggtgtgaagattcagctggtgagtcaagcccactaggttttggcaacatctgacatgttcaaggagcatgccacgttctatgcagctagagaaatcttcacctcgggcaggtgttggagcagaagagtgagtctggccctttacactcttctttgttgcctctaacaggcggtgagactggagacgtctctgggccaagcctttcccactgtggaatgggctctcctacagtagtttgggctccttatccttgtcttgtctttcctccttgctcctttgaactcctgtttgatgcgttcggagctctcttattccgacttctcctcttggcttcattttcccgtggttacctcctgtctgtcgtgcaacttggatttaatttgattgccattgtgacctttgggttacctgcccagccactgtcagcaactgttctgttttgtggtctgctgggcccctccagttcaggtttctgttttaattctttttcaagcctgccttggtgtttgctagattgctcttcactaagttcttttgtttctttcaccttcttccacatttagacacagttgctttgtagttccggtttgttgtattaattcaattctccccttgatgtcactgccctgggtgatggctgaccttcccaccctctttctgtccgtggacttcctaactcccgctttattcagctagctcatggccaccaaacatgcagccttggcactgtttgaggtgacttctccagggctgagtcctggactctttatcccccaccccctgggagttcttcccgctccagcccctgcctatctttctgctcgtttcctcactgtttctcgctcttgtacattttccttcattggatataactcggcacacagcttaaacttatgttcatgtatactgtctattcttggttttgagattgagagatttgaaatgtaagatttaagaagttttgagatttaagtcttggccctgtgcaccgttttcccatatgttgacagggagcctctgcacatgcttagatacagacgcagacattaacatattcctaagacgtctttaggatctgtgattaaacaattcctcttttgttcacacgtagcactcggtaactagctgataaatgagggataaatgagagagatctcatgccccagtctccgttttgaggttataagctccctggtagcttgtgtgatactgcagctctccgctttgtttcattttaaagaagtgatccgaagatactgattaattaaagtggatcaaaggagagagaatagccaggaagcccaacacctggtgtttaaaattggaccgtatatcagcaagaaaggtcaatatcaataagacaccagcagatactcctagatggaaccagcagacacccccagggacactggtgagggcagagggccgtccatttgtgctttcccacttcactggcttccttatcgtcataagcagactctgataaaagatcaccaactaagtggtttgctttctcttggcttccaaggctcctttaatttccccataaacaccgagataatctcacttaaatgaagtgcctccttgagtctgccagaacctgcttctccattgtcagcttaacgctgaaagggttaacgctgactctggatgaacatctgctggccccatattgacacaggaataaattattcatagtgtagtatttgggaattttaaaagctctgtgatgaattctacgaaactatattgtgtctccgacatcctcgggcctcattattttgtcgtcaattattcacaaaagctacccgcctctcagagcatacgcgggattcttgaggtcaggcgggcacatggctgaaacggaagagaccgcgttaagacatggtcttctttttctttgggtgccgttgctcttgtggggggttctggagctctttctctgcaccaaaggtgcgcgtggtgtgtgtgtgtgtgtgtgtgtgcacgcgaatgcacttctgtctgtggagcacgaacatctcaggctgtgcttcttgtatgcagtgcagccagtctttccccagtcgctctgaagaaaagctgcttcagggatttttcagcccgcacttgctataaaaagatttgctgggtttcgtgtgagtgcacagagatctaagctctagattcaagcagagggcttccctgggtgtggctagcagcagttgtcgtttgttagccactggggcattgactcctgccttctgcctctggttgcatcatccataactaggggattcttgaacatgtgtttgtgtgtgcttctgtgtgcggtactggtctctgtagcaatcaagtggagtctgtgataaaaaaaaaattactacagctgcagtatagtttcatcttgttgtaggatagagtgcagggccttgtgcattgctcagttacaccccaacctccacccatgttctgtacggctcaaagccaacctattatctattttattttactgctgaccccaaaaatactccatcaaagcaaaaactttgcatttctgtgattaacactgaagcaagtttttggaaatgtgtagtaggaaagtattcatgtagctctgagaaaaatatacttctctgaagaactgcctacccgaggactgctctacaacatccttcatgctgttttatgggcagagcatgaggagagagaccaaggacagtgagagaaaatgaacctctctcttcctagtgctctgtccctctaggagaggcccagcatcctgggccgctgctctcacctcaccaacagtgtcttgttaatgccgttaatgttttgatatgtgtgtgtgtgtgtgtgtgtgtgtgtgtgtgtgtgtgtgtgtataaaacattggtctggggactggccatgcactgcattgtgactggatgtgcactgcactggaacaaagcatacattgcactgggtctgggatatgcactgcatgggaacaggtagtgcaatgctgtgggactggccatgtactttttaggttgctattttgcttaagtaaattctaatatgcttttaggttatggtgagaaatgttccatttttcatattttaccccacaatgacatagaatctcataactgcttacatttttgaggtaaacatttacagaacactttagcttacttgatctgtctctccagggctgaaagatgtggcagaaattgatgctatttcacagagtaggttgtagggtggcggtgggaactccaacctctgtggtctcggctgcgtgttctgtgactccactggtcctcatgctgatggcagatggatgggcgtttgttcagtcctgataatggacatagattatatctccatctgcctggtagaaaatcagtgactacactgcactgtgtccatttaaagtattaaattgcatcaaaacttatgacatttaaagtgcttttacaatttagttaagataacaatttcatctgtttccatgtaattacagaggttctgagtcattttaatttagcaggctggaaaaatatgacctctggctacatggccttttcattgcatttcacgagaatgtgtgtgtgcgagcgcttgcgtgtgtgtgtgtgtgtgtgtgtgtgtgtgtgtgtgtgtgttgaacttgaagagagttcattgctttccattctgcttttccaagggctccagtagaccctgtggtagccccgggcccctcctcccatctgctgacagcactcagagtttccacgtgacagagcagcaaactactgatcttgttttccatgtcagggcacaccatgtgtgtcacttgaggcattcttgtgggcacttagttcctccgtgattatgcacaggacccacttgagcttgagctggggaggaaatgtcaggcaggaaagcatgggggtgcctctcctaggagtgagcatcagagaatcacacaggagagacactgccacccccgtcctccagcttgtcactttgacttccacttgacatgtttgaagaggttgacattttgcttttctgtattcatttgactggggagtgtgggatcagaagccactgatcggttggcggtggtctgtacctctcaagtagcatctggttgtgagtgaaaagtctgagtgtttgcaaaccagccctctaatagtggggtccacctactgtgggggagcctgtcttcttctgattcaactgtgagggagtcaattattacggctacaggaacgtctcacctcctctcaggtgagagctcactctaaggatgtccaaagctccatttctccacacaatagacttggaaaactctgtggcctttacagagttaaccttgggaggccttctaagtgggcttgcactaatgtcctgaaagtccagaacagcagctgccccccagcctctcagccacaccttgcctttcaaggctgaacagcacagagaaggccccgagagccactgtacccagttaagacatgtctgtgggtttggggtgtcactcctattgtcttccagaataatggctgttttctgtaaagcattttcccttcagggtaaccaccagtcacaatctcaagcattaggtagagtacagatctggccaaggtacagatttacagggctctggagtgatggggagatgtctgtctgtctcctgtgtgttgctgatgagtggagtgtgaatttggttttgattgattgatagcaatctggtggtctgagggaagatgctgagagtgctgcttttcttctgattggtcctcacctgccctgggtgggttggagagaggtcggtgagcgtgtgtggcgctcgaggtgtggtatacatctacatcgtggctcagtgtccatgggtgccgtttttcatgcctggggtgctccctgagtggaggaggcccttggactgaataggaagcagcagtcgctctcaccagcgtttccttcaccttctgtcccggccacctgccgtgttttcactcccctgttcctcatctggctcgtttctgtttttctttttctcctttactaccgtgccacgcagtgtgcttgtgtgcgtgtcccctcacctctcgaacctcacctcttgcttatcgttcccagcatctttgcttcctccttttcctctccttcctcccgttgccctggtgaccggtgctccctcctactttgtgtgttaacagactgctcagaagtgctcccggtacacaaaggatggcatgcaagttcttgctgtcagcttcctgccatagcaggtggcagccatggcccactgtcagcccgcttggatctcctgtttgcaaaatctggcgagagtgtgtagctgctgtcgatcctaccccccctcccatttctagtaagcagaaagtagcttcagtgttcagacgaatgtggagcaggccatgccttcctccacagtcgtttgagttgtgtcccgattctggcaggacgcatgagggcaggggtgccacaaaatgccagcactcaatctggacaagtctgtggtgtgcccacaggaagaatgctgaagtataaaacactgtgcagagaccggatgccctgagcttgctcctctgaacctcatgttctgttgtgtggaagggctactgctagctgcttcccagagagttctagagattaaatgagatcgcaggccacagcctgtctgaggtcatccctgacatttgctgtcctttcccccacccccacgaatacaaatcacgtgactaccagctcccaccctgaagattaaataaggacctagacacctgtgagaaataattagcctctgaatggcaacctttttctaaggaaggttttaatattgaatgagttcacgtttgttttaaacattagaatatatgatcttgtttgagatgaagaggagagactgtgtaacttctgtagaccttaaaacctgtggtttcgtggttcctgtctgggtttggggttctggtttctatagagcggatgtgtttgaagaagaggctgtgttagttccctgagaagccttccttgtttttgaaaccagacagtcatgcttttgtgatgatgtttcctcttaaaaataaaaaacaaccgaaaatgagtttctttgccaaactctcaaagtagctttgccttaggcacagcagagccataaaaggtcattgcaggcccagtggccgccagcctcttgtgcttctgaggatagggtggcttgggaaggagaaagacctggcacaagcactcgatagccccatgtgctgcaaagggactttaggggttgagtaataacattttggcagcgacatttttttttcttccatcccgtgaggttttagtttgggacctacctttgaaaattctgctaactagagctttattggctatagcttgacattttccttcgtggttccaaatatttgtggcttttgtgggtttttcttttttaattttagttcctacaatattaagaccagctggttagagttatttattttgatacagaaaggtattatgactaaaccacgctgactaaaacttgagtcagtgaggtggccggctttggggaggatgaggggacttcatgtcagaaaagagtctgcacctaggcctgctgctcagggagtgtggtcgaggagatgctgtaggcgggtcagtcttgggaggctccttccccaacccattagtttctgtgcgcttcaggtacattcagggaatatattggatacaactggtgctgatgcagggaggtgttacatgtcagccttcctttgttattctccctccccccctagtttatagacgagtgacctgctctctagctgcttccgagcctggagtcagggcagcagctttgggatgagaggaagagaggtcaggggggccatattcccttgccactgtgaaattccctacccctgtgccagactgctttggcgtgtggcatataattaggacagggactggagcgatggctcagtggttgagagcactgggagttcttccagaggtcccaggttcaattcccaggacccacatggcgactcactactgctgcaactccagttccaggagatgacaccctcttcaagcctctgtgggtatcaggcatgcatgtggtatatacacagacttgcagaaaaacactcacgtgaaagaagcaaacaaaattattttaaaaacagaatttgtgtgattatcaagtaattattggtattggggaatcaatggaacacccaagtgacagttataacagtttaaacctctaatgagcaatcagaagtctgttattttctgatgtatttccagcgtgccagggcaaccctacaggctccttgatgcttgcaggttcttgggcccagctaagtatcagctgaaaggtttttgcatggtctttttggttttccatgtcacccttttcaagcatattttaaaagaatcttggcctgagagtccttgtgtcactcgcgtgtgcatccttacttccgccatggccagtgtcccttccttaaggctcaacatggaggtggcttctgagccatactgggagatgtcactctaggctgctcgagtgtcatcaaaggtacaggtaatgcaagtacgggctgtcataggcataaaccagatgccaacagtgaggaaggagggactttaaaggagtggcatgcatggctattgtaagttatggtgtctttaactaaagcatagcagaagatacacacgtacatggttacctttaatgtaatgcaattaatattgcaacagatattcttcgttattctaggatagtgtgttaaattctttaaataattagaagcagcttttacacccaccttggaaagctacagaacacctgtctctggtgtgtgtgtgtgtgtgtgtgtgtgtgtgtgtgtgtgtgatatgtaactcagtgggcagatatgtaactcaactgacatgttactgtaaagagaacaggcttaagcaagtgttcatagatgtcagtatatgctctcatgccatcctgcaggcctggcagtgagctccagggcttgcctgtaccacgtaaaaggagtgtacaaaaaaagctgtcctactgtgtcagaagttttgaaagatagtgcttgatattccaagctggggatttcattctaatttctatctgttttgttttattttaagatgattgtgtgtgtgtgtgtgtgtcttatgcatcttggaagcagttgctccttccaggcttccatggaatgatatcattcccaaggtgaacctttttctatatctctgtgggcaactagaaactgtcagagagaaaatatttctctgtctcttgggaccatcatctggctctggaagtagccactgctgggaggagagccatttgtaacgtcatcttctgggtttaattgtgtccccactttaaaaaattctttcaagtattcagttccttttatgtattagtctatatgtctatgaccatatatgtatatgtatatgaccatatatgtatatgtctatgtctatgtctatgtctatgtctatgaccataacacaatcactgacttacaagtccagcatgctctgtaggctcacgtacctggatcattatgttaaacgattgcaaaatataagcttgactggttctgatgtaagctgaacaattaataccgggttttttgttttttttttttttttttttgtacatacatgtgtatgtttgtacaactgagtatacgtttttgtgtattatgcacttgaaatcttaactgacttgtaattattattttctcattacttaccgggacatatgtaactaattgactacttaaatcaacttaggctaaaaataagtgcccccaggaattctataaaattgtgtgtgtatagaaaagtgtgccaaaatgcaaataaaggcatatacaatagccaggcagtggtggccacacctttaattccagcacccgggaggccagcctgggctacagggttctaggacagcctgggcaacacaaagaagctctgtctcaaggaacaacactcaaacaaacaaacaaacaaacaaagtgtagacagtagcttcggggtgatgggatgggggtacatttacttattcttccttctttccttttatactttaactaaatttcccggaatgagcatacactctctagtgaagtaatatacatctttaaaataaaataaatggaaatttaatttctaagacacttaaaatttgtttattctgccctgtacttgagaaatagggtgtctaagtaagtacttaagattgagactctcaggagtgtggagtgactgtgcgttgcctttgggtgtcaccgttgcagcccaggtttgtctcaccccgagacctggttttctaagcaggaccatgtgcagggctagggagtggcacccatgatgttagcatgtgtaagcccaaatgcagatgatgttcattaatactttactacgtatcggagtctatgaacattaaattttcttttttatataagttgtcagtgcaaaatcttgtaataaaacgctgaaggtgcctgagttgacaaaataaataagaaattgctcgtgttattgtgaagggatagtctcagaaaaagactatgggtagtgaagatttcaccaggctgcttggctgttgagagttcgatgaagttacaatgttgcaggtccagagcctcattatcttaggtcctggttaagcccttatcagccattcctggcccacctctgtgtctgacccagcatcctgtaactctcatatgaaaccttgtagaatgtactgactgtgctcttgaccagtagcccaaagactaccagtggccaccaggcagcatccgaggcctttgctgaagtctcctaggtgcacaggcagggccttgacctatgaccctcacctgttctctggctgtgaaaatcaggaagccattaccaagtgggatcatgtgtttcaggtgacctgaatccggtttcctggaccaaggtcacacttatttccttctggggtaaattgtcttactccctttgagatgagaactgtgtttttgtgtctatattattatgatttcacaggaaagtgagcaggttttttgttttttttttaatttactcttttgctgtgatgtattggtctccaaatgcgctcagttactgtgagcatttgtctatcattcaccttagtcagctgaacttggattcttttggccttggagacacttcgggctctagggttgttttaggtttctcaaagaggccttgtgttgtactctttggagactttaaaataaggtattttctcttctaagacatattaatgcttgcaaaaggcatcggagcaatcaaacatggcattttcagagtgttcattaaatctataaagtgttggttttatctttggccactttataaaggactgtaactgtaggcccgtttatggcatgtgcctttatgcataaaccaactttgacattttccttactttaatgataatgtgacttgttaataattactatagtatctccaattaatgagaattgtgactctgattagatgccttctaattagtactttgtcattttacatcagcagaaaacgtgtgtgctgaatgaaggagagagttccatttggcaataggtggttcattaacacatggaaagagatagacagctcacacccttgcctatggttttgttgaaaagaaagggggtggaggtggcagatctgtgttcaggactgggggttgggggtggcagatctcgttctcacactggaggggcagtaatggcagatctcctgttctaaaccggggtgggggtgggggtatgacacatcccctgttcaatactttgtgttaggtttgcttctatagacaaatgtgtttgaaaataggtaagctgctgccgctagatcagctcccagtgagagtgagcttagaggcatgaggaagaagcctgaggtgcttcagcaggtagtcactgtgtgaataaggaaaggcaaaggggattgcacttcacaatctagaacctcgcagcactggggctgaacaggcccttcacaggtcacccgactccctcactttagaggtgatagcgctggggttcacataactggccaataagaaggttggggtcagctcagtgttttcttgccccatgtccagggccagcagtggggaggaggggtcaggcctaatgctctccaggaaatgggatcacctgtaactgaggttagtaaacagctatctgattcccttagatttgtcagaagcttggcacaatctcgtgctagaggactttgacttaactgctgtgccatgattaacaaagaaagccatggataagcagggagtcctcgtgcagtgagtgtaacggattcaggagtggggctaaagctgcttaggaggatcgggtgagacacagactatcaggccaaactgccagcagagctgggagcccgcagccttctccatccacaagtcgctctgtgacattgaagggccagaggcattccccaccccatccctcagaatgctctgtggctgctgctgtgagccagacagccagagtgattttcagcagaggctctcatgactctcacccctccaatgtggagggtgctggtgagacacaggctaagctctcgcctgcagtgagagcagttgtcattctacagagtaagccaacaggatgtgaccagggtctgagacccccttttgcttttattacaaagtatatttatagttgttccttttgtatgattaaaaaaagaaaagaaaagaaagaaaagaaaatccagactgcttggaataagcaaaagaaaatgtaagtgattttcaaatagaccaaattgtcttttgtacttagagtctcttcatgtctgcttgtgctagccctgcttattgcatataaatatttctcagggaaggaccctttctgatctctggtctccttggcgaatgaaatcagggcaagcttttgaattcaaatgcatgtgtttttacatttaaactgctataggaagagccatccatagttcataagggtagactcttgtggtgaaattagaggctattagaactattggtcttatttccaactgaattagttaactgcctgttaaggttcagagcctattgaccactaggcatttattaccttagccataatgacacaatgatttccattaacttccagagtttatggaaataaaaaagatctcgcaaagaaagtggttgcatttaattatgaggattaattaggcatttaaatgtgggtgtaaagtatgttttaaaaacaagtatttctttttcattgctgtgagccagtgcactgaaggtacgaagagcatgtgtctcctgaaaaagccctgggtctcctgcttcactgtcacttgggctgaaattgctgatccatgcttccagaggccacttatctgccagtgtcacatggtgtgcgatcatttaacattttccattagtcataaccaggattgtgctgggaaggaaccaccagccggctgctatctgtatctagtctactatattagaatattaaatatactcttctgagagcttcagaaagccacttgacttttttcctcaaagactttgaaagtgagacactccgaacccacactctagcacatccgtattcgtatttaattatggccacagctttataattaacacggattccttcatgagctatcaattaaactagagggcttgtgcattagctttgaacttgcagtgttgtggtaaaaatgtctgtttggagctgagttaaaagaactttttaaaaaattaatgcatcctgaaaggatgtagagaagatgacagattatgaagtggaacctactttttaagcatccgggattctattacattaaaaattgatgtgtgggctctgaatattcatctctaggagcgtttgaaatgatgctggcgaatcagaactacctctcttcagaagattcatttgcaagtgtcaacctgcattcatttcaaacagcttgaaatgggtttcttaatttgtttcagaagtatagtttccaaagttgacgcaactaagtatcctttgcgtttcctctccctagtcaaggtccactccctggatgccagcgtgagtgggtagtttctcccggtggggcggtgcagagttttcaggctcggggctttatgggtgaagcagctgtggatgattcttgtctgtcctggttagggagcatgggcagccacgggagagatgggaatgtgtatttactcactctggattttggggtttaaaggatggagaaccgagagtttgaaagaccatgagtgtagggtaaggaacgtggaattggtcagagttgcacacatccagggaaggctgaacagaagacgcacaggcaagaggccactgcttttcacacgtctaccctgtcatttagtaactgggacacacagagctgtgtaggccttgtctctgtactcctgggctgttggggtcacggaatagattgcttacattttctgtttggaaagtacaagtcctctccacttgtaaacatggtttaaaggcacagaactaaagctgtggcctcagagacaagaggctctgcatttgaatctttttattcctcacccccgaccccgacccctgaaagttgccttgggctagtcacctctgtcagtgctaggccctcctccattcagtcctttttcttttaaaggaagacagaacaatttactttatagggttttaaaaattcagtaagattacttatgtgaaagtgctttgtaacctaataaatgcaggttctatttcttctcctttctgtaatattgtagtcatcttctcactgtgacaagccattgtgaactggctggagaatctaactaccctttatgaatggtgaccagtcactgggaaaacttttaaactatctgaaacaactgacttcagaatggagaccaccaatctgaatttacatttgagcctgttcttaagttgctcccagacaactctacgtcagcacacggcttttacacacatccccgatggctgtgaactcctgactaagctcattgattcgtgcatgcccttgcaaccctgagtgcactctgaagagagggaatacaacacacccttaggaaaggcagacttgtttcaggagaatacgcccagggtattttttcattaaaaataaatgagtttgattctgtcacttcagatttttcaaatcctgaaagtgctgttttgacatgttttatggaaagagggcttcattgcgggagcgaatgaagtcagcacttggcgagctctggaaaaggtgtgtgcaggctgcaccgctgcgtgaaaatgacctgtcacgtagcacaccaaacccaggcctgcttagccagtgagctactggctcgcgtggccagtgctccaacgtcagcaagtcctggggtgctaatcaaatcatgcagctttgcctgttttatggccatttttaaaaatacagcaaatcctaggatattggtgccgccacagcaacagaaacctcaagcaagacttctgaacatttctcaatcaaaatagctaactttcccactattagagcctgccatgctgttctgacagcccccccccttaaataatgagtttgctccacccctgctatctccttactggagctgctgtcataacttcacaagaataaccccaccaacagcgtgaagcatattctcagcagactgaactgcactgacctcagtaacgctgtttaaaaatggccaaaattgtccagggacacgaagcttggtgtttggcatcatctctcaatattaaatatgacattttaggttagaacgagacttttaacttgtcctgctcctgagaccgcgggatgttatctgctctgctacagtaaaaccttctataagcaggtttgtcctcggttggtccacttagctaggacagtcccagacgtaactccccaagaaaacagaatgaagaaggtggagaacccgcatccaaatcaggggtgcacgtggagcagagctgctcatgagaacacctgtcctgtagaggcagcccatggccttcaacccctctgggctcccttcttatatactagaaacagttgttttgtgactcacaggggagggtgtgactgacagaacgtcatcacatccagggtggcttaaagatctagtttttaaaaattgtgtgtgtgtgtgtgcacgcgcacatgtgtttgtcctgtccctgtcccctgcagctggaggttgtaagctatgtgacatggttctgggaaccagattttagagagcagcaagttctcctcatgaggaaccatccctccagccccagttgcaggcaggaaagtttaaagtttgcagagtccgcggtatataccagcagagcagcgaatgcgtatgcatccccacgcttgctggcatcaagtcccggctatagggttctgtgcctttcttactgtgctccacaatgtgtgtatgttgagcacgtagtacagtttgtgggagccatggtggagccctggagcctctggaagcggagttacaaatggttgtgtgccaacaggtggatgctgggaatcaaacattgtcccactgcaagagcagctagagccattgctctagcccctgaacgcatttctttacctctatgaatggtctgtgtggtggtttgaccaggaatggcctctatagactcatgtgtttgagtgcttggccttagggagtggtgctattaggagatgtgtccttactggaggagatgtggccttgttggaggaagtgtgtcactggtgggctttgaggcctcctatacttagtctccagcctatgtgcaatcagcctcctaggtgcctacaaaagacagtctcctccttggctgcctttggatcaagatgtagaattctcagctgctctagcactctatctgcctggatgctgccagcttcctgccatgacagtaatagactaaacttctgaacctgtaagccagccccagttaaatgttgtccttataagagttgtcttgatcatggtgtctcttcacagcaatggaaacctaactaagacagtctgttagtttctgtttgggtgttcatttccttcttggctctctagcgatggcactggtaggcagactatatccttgtctgtctttgtcttgtcagtcttccttggcatgctgcctcagagctgtcctggtttgaagagacactcagaggagtactagctagtggagagatcttgttaataacacacagcggttctactcactgttagtgtttggaccactacgtgtatgcttcctaattacaggagatggcactgaattgcaggctctgcccattcgctgcttcagaaccggggcagacaccaagggggattgtctttcttccctctaattaaaacaaacaataattattattaatgataattatgttctgtgacatttccgaaaatagtgagtcatcatacccaagccgttgctctgagtaaaactgcagggctgggttcccatgagtctctggtctcattagtggatccgtacaagatgtggttttgtgggtgtttctggtacagtatgtattatgtatgttgatttgttggcattgcacttctgggcagcgactctatgcctgaagcctgagtaagcttacctaaccatgcctggcaggcgcactgctgtgacactcttgtgttcttgcatttagggacatacaatgggcttgtgcacctgagtcatgtcccttgtgggagtgctgagttggctggtttgtcctctgctggtctcttgcccttcacaactgactctagagctataaagtttagtaattaggcaaattcatgaacaaaatctgtgaataatgagattgactgtgcagagttctatacattctcttttgcttcttttcctgtgtgtgtgttgttctgtgctcagcacacatgtgtgtgcaggcacatgtgtagtcccgggtcccttcctccaccattctccaccttactctttgagtctctcaggcagacccagagcgcattctgttctctctacgatctcgctctgaactgacctcagggtctcttgtgtgcgtgacaagagcttaacctttgagccagcccctatgtggtaatccactcttaatcctaaatcgtcttgtgacttctggtctttgaatactgcacatcaataagaatgtaacatgcatctcaacatctgtttattctagcacagctcttttaaatcttttatacaaggcgcatgttgcccttctgtattcctttcattgtattgatgtttgcactgctacctgcccagtgctttccagtcagtgtgtgtgtatgtgtatcagtgtatctgtgtgtgtaaacatatgtgtgtatgtaaatatgtatgtatatgtgtatatgtgtacttatgtatgtatcagtgtgtacatatgtatatatgtatgcatgtatggatgcgtgtgtatgagtgtatctgtgtgtatacatatgtgtgtatgtatatgtgtgtgtatatatatatatatgtatctgtgtatctgtgtgtatgagtgtgcctgtgtgtctgtacatatgtgtatgtgtatatgtatacgtgtgtatatgtacataggtacatatgtatgcatgtatgtgtatgagtgaatctctgtgtgggtataaacatttgtgtgtatgtatatatgtgtatgtatgtatatgtatgtatgtatgtgggtatatgtgtctatgtatatgggtgtatatatgtgtatatatgtgtgtatgtatatatgtatgcatgcattatgtgtgtatcagtgtatctgtgtgtatgtatatgtatgtacatatgtgtgtatgtgtgtgtgcatgtttgtatatgcatgtatgtgtatgtttgagtatatgtgtttgtacatatgtatgtatatacatgtatttgtgtgtgcacatctgcattgcatgtacgctacctttagttttaacatgcattaacatgtgtcagaacatgctctaataccccaaactgcctcccaccattcttcagaaacaccctttcctgaccatcacaccttaacaatggcagattgctctacttttgtcttttccaagctatcctagaagtagaactgtgtggccattggcccctggaaaggggccccctcctcagctttgacctctggctttcagctgctgttgtgtaccccagtttgtttattttctttctaagtgctgagcccttgtttaaacattatgcatccacctcaatgcttctcagcccctgggttgcgacacttttggcaaacctctgtcttcaagaatatttacatatgatttgtaacagtagcaaaataagttatgaagcagcaacgaaagtaatatggttgggggttaacacatcataaggacctgtattaaaggattgcagcattaggaaggctaggaacccctgatcaacctcccacatgcatggggattgtttgcaattacagggaaattaagaagaagcctgctgtaagcatccacaggctttgtgtggatggaagttatcatctccctagaaaaattaggaatgtactgtctggatctaatgttaaatctaagatttcgatagataagaaactgccacctcttattccagattctcctgttccatatttgcatacaagagttccagttgctctggttgtcaccagcacttagtgttgcttcactttcctttttcttctgtacctcgtccacgcacagtgcacttgctgtgaaatatccttagtgtaagtgcaagccaagtcatctggacaggacagggccctgcactcttgaacttacagcagctgggattgcctgcacaagatcaaggcagtaaacattgtagcatagagtggggaggggtcaatgagttcccaccctccctgctgagttactgatggtgaatgtctgcagggagttggtttttggctcctggctggtcagccacactccaaagcagctcttctcaacctgtggacccctttgggagtcagatgaccctttcagaggagttgccttggaccaccatcaaacacagatatttgcactacaattcataacagtagtaaaattaaagatatgaagtagcagtgagaacgtatttatggttgggggtcgccacaacgtgaggtatttattgtactgaagggtcacagtgttaggaaggcctagaactgctgctccagatggtggttgtaccccacagtctagcaacagcacaattggtttaggtgaattcttgaaaagaaagactgacccagagccaggaggagggagtggagggtggatctgggaggaggtatggtaaggagtgtgatcaaatacctgtgtgcacaaatgtaattctcagagaattactaaaaatatttaatatgttctaattaatattcaaagtgttctaccataataaaatcttattaattgctttatgttgtgctgtgttgttttttaaacaaagtggtttctctatgacacagacattgcgagaggattgtgtaggagcagggtggaaggagtatatttattattcagttttgctgtgaacccaaacttgcttccgaaacctttatggggcttgctggagagatggctcagcagatacaggggtttgctgcataagcctggcaccctggaacccaagtacaagtgcgggaagagaattggcgtgtcctctaactgacatgcacacaaatatgttttgaaagtttactaattaaaagtattctttttctaaaatgtgaactctgctatttcataagtgtagctgtgcacatctccctggcacagtactgtggactgtcacgtgaaagctaaaaagagaggagaggcaagcccttgcgatataatcatctctgcccaaggaggccgaagtgcagctcttgcatcccacctagtctgtagccgctaatagtcatttttatagaccattctagaaggagctaatttacatcggcctggtagcatctaggagagctacacagggacacagattcccaggagtcctcaaatcagtgagaactgaggctgccttaatccacttgatgttggttagcttctcctggtttgctctggctctttgcccaccagcagccagcctccccacccccacccctaggctatgtgtgaaggcacaggcagcagggcacggcagggccacagactgatcctgacaccagatgaattgggagcagggtgggggtgggggattggggggatggggggttgggggatatgttcaggaaatctcgggttttttttatcgacattgtcgtcgttgttttctttcttcttggtctgagttttacaggctccctctgccatcaccatggaaggaaagcccaagctactggacttcagagccattgctctgcatccccagacaccttgattgtgttttgaaaacgtagaagagaaactctagatgaggtttgcacattttataagccgacccagcactgggggtgacatccactggtttatttaaatcctgacttgacagttcacctgttttttgttgttttttttttaaccttttatcaacctaaggtctttctcacaacactttggttaataacacctttgatatggttaatctaaagctaattatgagaaaacaaacacttgatgtgatcggccaactcgaattgagagcagctttcctctagatattgattctggacagaccataagccaagaggggagaaaaacaactcccagctgcagattcagccggaacattgtgttcacgcagcttcatcttctggtccccccccccccccggggttccagacagcatgatggcgttttctaaagcaatcccggatctttcacatcttcttcagtatagattaagacagatcagattttttgttttaaagtgagaaatagaagtggagatttctggagtgatctcacccagctgagcaggaaaaacacattggcgccatgaacatgttctttgctgactctccacgctttattttgttttcaatgtaaagtatcaacaaacagaagaaaaagaacactcacttgaaagtatcagaaaataagaggtgtagcgaattgtatcccagcagcaaacaagcctgcgctgctgatttttctttccctccctgtgatttaaagccttgcaactcacaatctaattaacatcgaactgagttgcaagtacagtggcctgtttggttcaataataatacatttatatgaaaggttaatgaaacgaattttctctgtatccaattcattaaaaattgctctacaatcaagggttgtaatggaatagagattaaatattcatgttcataaattgtctgtgtcatttctgattttccttcatttcggcctccatggtttgaattttacaactagaacaatcgcccccccccccgcacccccttctgcaaaatgctgatttagaggctaattgcatgtcattaattctttcatcaaagacattgtgtggaccagagaaagagcatagtagccagggttggtcggccctgtgcgctcagtgttgggggacaacttttgtgtgcagtggtcatccaaagacctcctctcatggtaccgaatagcagaggtatactccagtaaagcaaagacacacggccacaggactgggaagtaaatgagtgacataggaagttaaaaggggatctgtttatgctataaaaggagaatttatagccatgggctatttttaaaatctaagggcaacacagaaagacatagattaaatctaagtcaaaaggtaaactgttctcaaatgtttggattaagtgattgtactcatgacttgcactcttcatcctatgtaataccgcacacatctgtcacatctgatgtgtctgaagtgcactcatgacctggtacacagcagtttacctcttagctcacttgaaccaacaggagggtgtgggggtcaggttctagttaggctcagagacatttggaactgaaccagagcggaatgtaggaagtaaagacgtgaagtctgtcgtcattcctaggggtgctcatgggctgaggagtttaccattgccagtgttcagatgacgccagctgaaaattttcctttagctctctggatggctacttaagcaaaccacactcgagtaatcctaacagttttagcaacaagtggtaaacgctttagttataagataggtttttgttactactgaaatatagtgagcatccccgagagttagcatttggtgcagctggcaatgatgtagcatttatgcccctccagctttacaatggggcatctctgctacaccgtaggtccccacgtgtgcaatggggagatgtcaagaggctctgagggtgacggtgtgtctgacatttaccactgcctcataggttcagctccccatgacaggggcacagtgctccctatgaaggaaccagaatgtgccctttctcaaatgaagcgacaggaagagaaagaggagcagacaggctcccagatgccatgccagcttcctcctgcggtggttaacagccacgactctctgcacactctgaccttggccttggttggggcttgcagcaggctcctggggtagctgctgttatctccctagactcagtaattcaaattacttttaacctggtaaaatagatttcatctgtaagccttatagcaacaagcgcttcttcaattacttggcttcccagttgcttaaacctctttggaacaagggaacaggtacataaagcagggattgaactgggtagtgtttcaaaacattcaaggttcatttggtttattgtatgtatgtggctgttctgcctgtgtgagtgcatgcataccgtgtgtttgcctggtgcctatggtggctggacgagggtgttggatcccctggaagtggagttaagagggttgtgagccaccatgtgggtactgaaccaggttcctctgcaagaacaagtatccttaatgtctgaaccgtctctccagactcaaataacacacacacacaaaagcccactttattttatagaacatgtaaataaaaagtattacacaattagattaacagagccactcaaaccctgcttgcccaggcccaaagtctgtctgtctcaaggaacatctatctgtacagttataattgccactctaacatctcggatttggatttaatttacacttttataatcaatgcatttcatgccatacgtataaaatgcagtatattttatatataaccctttcaaaaagggaaaagaggtcctcaaaaaaaaaatccatgatagcgttggaactagaaaatgattatatacccggcccccataactcgtgagtcctcacctgtgctctgaccgtccacatcccctaatgccactcctccatcttctttttacatgttacatgttgtacacacgcacacttgcctacatatgcagagaacatgggtgtttccttttgagattaggtgacctcgcttcttaatatgcacttggaatccatccatttccctgcagatctcctgatttcattaaaaaaaaaaaaagatttattctatgtatgtgaatacactgtcactctcttcaaacacagcattacagactgttgtgagctaccatgtggtggctgggatttgaactcaggatccctggcagagtagtcagtgctcttaactgatgatccatctctccagtcccccgccaccccccccccccgatttcatttttaaaaagaaagatgcatagtattatttttaacatgcgtcacctttctgtgaccagctcatccgttacggagccatttgttggtttgatttcccagctattcggaacagagcagcattgaacacgtgtgtggagtgtgtgcacaagagtctgtggagtgtgatggccgagtcatatggtacaacttatttttagctttttgggggagtctccacactgatttccagagctggcgagccggtttgcagtcatacaacactgaatatgaggcgcccctctgggcacaccctctccagcacttgcagctgttgttggttgctttattgatctttaccactctgactgtggcaaaatgaaatctcaaagctgttttgatttccatgtccctaattgctagggacaacaaatagcatttggaagatatttcttagccagttttactacttcttttgagaactctctgttccaattgatcctttgttgatttttgttgttgcggttttgttttgtttttgacttttttttaaagtactttatatattctggatattaatcctctgtcagatgtgtagctggcaaagattctctcccctcagtgagcttcctcttaaccgattgattgcttcttctctctctcttttttttttaaagatttatttattttatgtatatgagtacactgtagctgtctccagatacaccagaagaggacatcagatcccattacagatggttgtgagccatgtgtaaccattacatgtggttgctgagaattgaactcaggacctctggaagagcagtcagtgctcttaaccactgagccatctctccagccccctgattgtttcatgtgtagaaactgttgaattttatcaattcccacttgccaattgttggctttaattttggggcaaagagagtcatattcaggaagcctctttctgtatttccctcatgcaggacaaccgcccctgctttcttccggcagtttccatggttcagggttaggtcttaatccatttggggctagattttgtgcagcaggatagctataggtctaattgggtgtacctctttcctcttcatgtggacatccagtctgttaagtgccatttgttgaagatggtttctttcctccagcttgtgtttccagtgcctttgtcaaatagtaagtggctgaagttatgtgtacttgcgtatgggtctgtgagtctgttccactggcttgcatatctgtctttgcaagggtgccatcttgtttcttttcctctggctctgtaatatatcaggtctggaaggtggagccctccagcatggttctgtttgctgaagactgttttggatattgagggtcttttgtgattctatatgaattttgagatagacttatttttctgtttctgtgaagaatcaaaaggagattttgattgagattgcattgagtctatctcttggtagaatggtcattcttacaatattttacatcactccatgagcatgggatgtctttccattctctagtatctccctctctttattaaaaggtttaaaaatgtaaggatggtaaaagttctttacctccttggtcaggtttattcttagatattttattctctttggggctattatgatctctttatgtttgttggtgatgtatagaagagctattgatctgagcaggttggttctgtatcctgccatattgctgaatttgttaattgtttctagacgtttcctcgtagaatttttcaggacctctaacatagagtttcatgtcatctgcaaataagaatagcttgaccacttctttttgtttgtgtctctttaccactctcttgctgcattgctccagctagcccttcaagctccatatggaagaggcgtatggattgcagctctgctgccttcatgtttctagcatgggtgcttcaaaggtttctccactaggatggtgttggctctgggtttttcttacatagcttttgctgcgttgagccattcccccctcctcctctctgtgacttttatcgtgatgccatgttggattttgtcagaagcctttcctccatctattgagtgatgatcatgagagttttgtctttaagtccatttatgtggtctgttacatttattgccttgggtaggttgaagcatgcttgcatttcagggataaagtcaacataatcaggatagataaaatatatgtctgtgtccagttttcaagcactgagaaggtttgaaactggctagtagctttttttttgtctttgtgtctttgcctggttttgttgttaagagtgatattggcttcatagagggagttttggagtgttctttcctctgtctctcctccctccctccttctccccctcttgcccttcctcctgcctctgcctcccaagtgctgggattaagggggtgtgtcatccccctcccctcccctgccccgcttccctttcttttctcccctactccctcccttccttctttccttccttctttccttccttccttccttctttcatgctttaagaataggctgcacatctttgaaagtctagtagaagtctgctatgtgtccacctgagcctgcatgtgttttacctagaggactttttactttttattctcaatcttgtttgtctgtttaggttgttgatctctttttggtttaagtttggttgtttggctgaatctagaaaatttccagtttaatagagtatgggttttcttttttacaatattattttataaaattctgagtttcttgctatcttttgtaatgtttccctgtttatttctgattctgttaaacttgggtcttctctttctctgagttagtttggccaatggtctattgatgtcatttatcttaaagaaccaaagaaccaactcttagattcattgagttttatatataatttatgtatgtaatatatataatttatgcaatatatataatttatttgtgtccttgctgacttctgaaatctaagcactcagagctcaacatttctctcagaggacagcttgcattgtgtcccagaggttttgctgtgttgtgttttttttctgtctctatttcttctttgacccattcatcatccagtaatgagttatttaatctccataagtttgtgcatttactagagatttctttgctgtcaattttaagtcttattgcattatggtcagttggaatacatggaattatttcaatctttctgaatttgtaaagatttgcttcatgccccaggatgcagcatttcaggaagcttccgtttgctgctgtgtagaatgtatatttaatggtatttaggtagaatagtctctagatgtctgtctcacccatctgatgtataatttcattatgatgtttctccccttacttttctgcagataacctgtccagctggaccctggacattgatcgtcagggtctggctggctgagtggagagcctgatgctgtgcagggtgggggctggcagggcagctccttgtggaagcctagagattgattgcagagagtgcaggtggttgtggctagaccaggccagggccctgggcgtgggtcctaggctacgtctgcatgttgtggacgggatgtggcaggtagggccaggtgggctcacccatgggatgacttgtattttaatacttaaatatatactggaattccatgtatgctcttagtctggaatcatgcgttcttgttaagccttcaaagatggctgttctattctgtgtctggtgctgtgctgagttctctgctctgtcacagtaaactacaatctcattttcatcatcatcagcttaagttttattgtggcatatcactcacagaagtctaaagaattaattttcttctgtagtgacttgttgctgggaaaagatctgggagggccccacttgatgggcacctaacgtgaagcatgttgttcagacatcctgcctcatcctgtgtgcactgtggaacactaagtgacagtacctggagggagtggggaactgaggaaggcccctgaaccttctctctgcatctgaggaaaagaatctaagaagccgtggaaggcacaccgtccagtgtcaccatctcatctcattttgggttcaaagaaaatgaaacaagcagagtctctagcactgccacgtcacttgagaccatattgcaccttcaaatggtgtgtgtgtgcatgcatgtgcatacatgtgtgtatgtgcatgtatttaaacatgtgttcacacacatgtgtatgtatgtgcatgtatgtgaaaatatgttggtcacatgtgtgtgcatgtgtgtgtgaacatgtgtatacaaatgtgtgtgtgtgtatgcatatagttaggcatgccttgggtcagaatacaaccttgagagtctgtctttgctgtctaccttgagtatctgttgctcacagctgcatctgttactgaggttggttttcctctgcagggtaagccaaataaaacctgcttttcatcatttcacttgaaaaactgtgaagtcattcatctcttagtgaaataattgatgattgagttttgttttaagcatacaaggacttttcaaaattaaaaatatttaagatttttgtttcttctaatacataccagaaaccagtaactccagatattctttatctccctcccttagcaggagctcttattatatagatacccaacacatttatatgtatcaagcatttattatttatttttcattttgagataggatctcattctggcgcccaggcttgtctgaagcacactgtgcagatctggttggcctcaaacattaagctattctcctgtcacagcctccctgggtcctgggatttcccacttgtgtcaccacacccaagctgcatgtgtatatattatataatccagggcatatttgtaggtaagcgtttcttcaagacctatagaacgatggttatttccaggtggaatgtatgactggaatcccctgaaatgtaacatgggagggtaatgaaaaaaaaatgtctgcaaacacattgaagatgggaacagtggccaaggctagagggagggagggaggagagtgcgctcacgggtgggttaccttacacacctgcattttcacagctactgttggttcaaatccacagagacaaaatagcccacgagcatcatttgcttaggggttagctctcagtagaaagccagagtagtcttacttcttcagattacctcagaatgctgctacacagtgcagtaagtgggtttacgtggaaacaggagcgtcgcctgctctcaagttctccgagtactcgtgtgatagaaaatgatagaattatattttcagcacttgtttgagagtctgaaacttcatttagatctcatgaatatcatttatgaaaatggtcaagtgtgtttaacagaacaaagataattcatgttgtaagagtggatagaatttagaagccacttatttagagacagatgtacaaaaactgagcacattaataatgttattttaaaatggatttatttatctcattattttattgtatatgcatgggtgttttgccttcatatatgcctgtacattgcagagacattccattctttcaggattgttctctgtgtactcgaaaagcaactctacgtcacaacactgacttcaaatcatggtttaagttctaagtttagggtctggggaaaataacttagttggcaaactgtttacgtggaatgctccagagccttaatccacaagaaaagaatccacatgaagagctgggtccacgtaaagaagagggcgtgacggccctggctgtggtcacagctgtggcaggggctgacatatagttgtgcccaatgaagctaatggaggtgggggggggcgagaaagacagagacagagagagagagacagagagacagacagacagagagagacagagagagacagagaggagacagagagatagacagagaggagagacagagagtcagagagagaggagacagagagagaggagacagagagaggagacagacagagaggagacagacagagagacagagagagagagagacagagagagatagagggacagagaggagacaggagacagagagacagagaggagacagagaggagacagagagacagagagacagagagacagagagacagagagacacatcgtcccaggaaacactgtgggtggttcctgaggaacagcaccttaggctgatgcacgcttgcgcttgcacacacacatacacacacatacacatacacacacacacatacacacatacacacacacatacacacacacacacacatacacacacacatacacacacacacacacacaagttggaacacacacacaaacagaatttaaagagaattctatagttaaacattttccagttctctgataatttcttcagttagctgactgtcatctagtcaactttgttcacattgtttttttgttttgttttgttttgtttttaaccagttttaaactaacccatgaaaggatacaaagaactataatcttggttgttttgaaacaaagtacatgtattttaggtaactatttgaaaccatgtttaaaaccccacaaagcatgtaacgataggtaaagtgagaaaaaggaggcagaagtatagtcacaagtagtttgaagccagggctacatcatgagatcctgattcaagcaggaagaacaatccttcaaccccaccccaccccccaaacaaataaaacgacaaatatgcatgtatccaaactgagtttttaaacaaagatgtatccatgatcattattttttgtcaagttgaacaaactagagtcactgagaagagggacactcaaatgaaggcttgcctctttcagaaaggcctatgggacatctgcgagcaggctcttaagggcagttccatccctaggcaggtggacctgagctacacaaataaggtagctgggccagcaagagccagtgaacagtgagtagcatccgccatggtctcttctgttcctgtgtattcccagctttcgtccctgccttctgttgatgagggaatgtaattcatgcgccaaataaaaccttttcttccccaggttgtttttggtcagtgttctgtcacacaacagagaagaagcaaccagagcatgatgtgacagggcacatgatgggactgacaggtcacatgatgggacagggcatatgtgacagaaattgtatttcactctctgttgttaatgtgccatactaggcaccttggtaagatatcagaaaatcttcaaataggctatggagggtgtctcagatttgccttggtgccaaggatatagtcttgacctatttttccttcttcccatgtctctcaagtgctaggattacaggctaccagtctggttaagaatgagaacttttgtggggctaccacattgactttttgtggtgcacagtgggtgagcactataccaactgagctatagctcccacccaagaactgtgtttcacatcattgagaagcaatatgaggaccactgccaatgaatagaacagagtcagtgggtctgagaaacaaaagaaaaattcaagtgtgagttcttgaaagaaatacaatttgtgatgtgtagaagaaatgagttcttagttatccaccctttatcctggttttgagccacaggcttctcactcatagccctgataaagagtccctgtgggcacgctggatggtagtgtaataaacaggaacgtttgttcttcccccaggcatacttccgacagggtgttgccctccagtaccttggacgtcacgcggatgccctggcagcctttgcatctgggctggctcaagaccccaaaagtctccagctcctggtgggaatggtggaagctgccatgaagtctcccatgagaggtaggtgggatgtggatcttcaggtgtgactggaaagctggcatgcagccttccaggactagggacctgctggggtctgcgggctggtgatgaactgtctaacgagggcagatgagctcatgtctttatattttaggattattcaaatcattcccactgttaaattagttttaaggttttaaaccatagtacctccaacaataagctgattttcttgtatgaataaatatagcctttaaaaataataaaataagagaagacgttaagctaggctttcctccctccctcctctctcttcctctctccttctttttctttccttcctttgtcctcccttccttccttccacgcaaaacacaggagtcagttcaatgggattaagagagaatttattctggagccaaatatgagtaaccatggcctctggaacacacagtttagattgcccccttccatgtttcccagtgtggatggagttctgtggagttgtctagtaagagaacaaagaacattataaatgaaaaattgcagtcagttatcaccttggtaggaataccagagaggtaggttgcagcaggatgtgagattcttagctatggtctcagaagctgcctggtgacttctttaaccagtccatacattggtggcgggtagggtttttttttaagttagtacattgtaaaggtttttagtctctttatcaggatgtccggttaggcacagaggtggtcagggagtggttccttatggagctgaatgtaacctaggagaaattgtgactggcctctcaaccttgcatcgtcccagcttcccttgggaattcccagccacacttccattctttcttcctgagagagtctcacgctgtagcccaggttaccatgatcttactgtgttgtccaggttggcctgggactcgcagcaatcctcctgtctcagttttctgatggtgggattacatgtgtgagctaccatgtctgccttgttctttcttgtatttcttaaagctagtgtgtgtgtagccatgggcagcatctcacatctacagaggaacacaaagaggctgagtgttgccctctaaaggagaggaaaagtaaggtagaaacttttctctcttgctttattctgatggaacttctgagaaaactgagaacacacggagatggtcccggacaaggctggaggaattctacagccctgagccaactgtctttactgcagtgcagtggttttattctcgtttattctgtggtcctaggaggtctcactcaggatctgaagagtactgggcaagcactgtagcactcactgagctttgacacatgagcactggggaagtttttgatgaaacccacacaccagcttgtcacttgacgtgaaggcggatctgtggcctgtagtcatcttaggccagtagctaatgtcaagcagaactctgtcttcgccatataaatggtctgaggttgctttttgttttgttttgttttgttttgttttgttttgttttgttttgacagggtttctctgtatagccctggctgtcctagaactcactttgtagaccaggctggcctcgaactcagagacccgcctgcctctgcctcctgagtgctgggattaaaggcgtgtgccaccacactaaatggtctgagttttaatggcgattctagataatgaacctgaaagtcttgccgacagtatcatttcgtccagatttacgtgtttgcagcattaggcactttaattcactgcctgtcattgtacttagctcaaatatgtgccagataaaactctgatgaaccagacagtgctcctgcctctgagcggttagctctctagagaaggtgttttcctgaagttggacatttcatgtcttcaggggaaagaggcaagaaacttttcttcaagtcatctttgcttcagggactaaaggctttccccagggccagcctccctgtcaataaacggtgattcagagcaaaccacttggggctccaggacttctacaggaacatggtgaacaaatcaacacccatcttctttaccatttcctagagttttgttttgttttttaattttcttttatttatccctccatgaaggatatgcatggaacttcttcaaggattgataacaccttttaaagaatgtacacggaacacttttatttagtccatggagacaacactggttcatcctgaggcagccctgtggctacccgaggatgctgcaccaaatgtgttgatatccacagaatggcacctgtttggctttgaagcaatttgttgagaaaaatgtgtttttagttttttttggtttttgttttttaaatcttccctgtggggtcagatcagctgtcgtcctcagggtccctgcttcccatcttgcagtggagaaaagcctgcttcttacatcttgcgcgcgctcgactcgaccagcaagaacgacgctgcaacaggatccttctgcacacgtttattgggagagcttgattgcagaggcgaaaagactttttgcccagagctggtgctgcttttataggcctaggagaggcgtgtctcataccctgattggttatgcactaagcctcatttgcatgttcctcatctgattggctactctctctcagtacctcactgagcctcattatcatacctcatttgcatgtctcacatccgattggttatactctcagtaccttacagaacctcattatcatgcctgggccaggcagtgtttttgcaaaaaactttactgcatatgtacacattggctgtttgtccaatcttatgcatggtggccagcagtagtcagtgccactcagcaacggcacatgtggcttcccacatctccccctgtttgttttaataaaatgaggctggactaggcctgtgcaattatgcccatccgccgtggctcctgttttaggtcgttcctctaatgtcacagccttacccgtcatagggtaaccctatcgccaccgggccccatgtcttaggttggactgtgcacgaggaaagttgcccgtctctggataccgcagtgctgtgtgacaataactgctaaatgacctagggcgaactctgcaaaagaggccagccaaaaattgaattagtggggaaatcatgatcaccctattgatgagcaagggctgatcaatgatcgttgagtctctctcatctaatctcatgctgactaattcttgagcatagataaccaaatttcaggggaggagccgttttcaatagctaaaagtgcctgagttacaatcaccttgtcacgtttttgttgggttctgaatttgcataccaaccagagcatgaacgccagtccacagcatatggcagcaccaaacaaaatcactcccacccattccttaaagtaagaaaaagcagaggtaaaccaagaggtaaagtctccgagggtcactggttccactctggtcccattaaggttcaggatctgcatctgcagtctcgtctgcaacctctccagctcctgcgaccagttccctttcaggtaatttgataggtctgtacttttaataaaagaattattaatatacttattgggagtaatgcacacatgcgatgtggatgccacacaactcatttgtatgacatccatcatccgttccatattatgttgtaaaatatccactctctgattcactaacattaaccctgaggcgatatgagaatccaccttttgcagggtaagcaatgcttcagaggatttttctgctatctgacttatggtgtcagcagtatcaatttgatgggccattgcagttcctgcggtaactgctgatgccgcggacactacaatggctgtaacaatggcagctgtgattccaaaacctctcttttgccgaataagactcgttattgggaacttctctggatctgcctcaacaggcacagggacaaagattggtagatgaaccactaaggctaagaatttggttccattccagcattgcgtcaaaaaacaagtaacatttgtacaatctaaccattctgtattattttgaaattcagccaatataaagaaaaatggaggattgacacaaacttctactggagaagtagtcatattagttgtcacattatctaaatgagtagaggtattggaaagagtggcagaaacattcaatatctcatgaaaggttccagtcagcaatgcaaaggctgacagactggtactagcacctgcctcattgcttaaaatccattggtaatatggccaaatattttctttccctgtagcatctcctttatcgttcattatagcaaaatctagtgggggtgacaaaacaaaaccctttgctatttctttccgaggaaaaatttttgattgacaaggtgaaaaaactataggaaatgcgaggtccggatgacaccaaggcatgctgcgtatagcagtagcattgccaacaggccatcgtgatcttttgggaatggtcacctttccctttatcataatagtggtgatgtttataggtgaaattatattattttcaacatcacctgagcctgattgcgctccttgagcaacttgcgttaaagcattaaacaacactccagagctcaccttattttggctaatgggatctgcccaattagagataatctttttctttaaaaatatacagggtgtaaaaggtttatccacattatgcacaaagcatagtgtataattcaaatgaaaactagtactattatacacccgtggctcttgaggagtttgtcgtgcacaaggcgcatccaaataacattccgttgcaaaaaataaaggcaaggtagaagaattggaatgtaccggtaaaggtactggccatgatcttactatggcccacaaaggtatacttatcccggtctcaatcatcaggagcaggagaatcatcttggggttcatcttgctctttcacggtccttgtcagtcgcgtcgggacccaaagtggattttcttcaccctgtgggaaaatacaaatagctccccgggatctgattaaaataggatccgggccataccatttattatcaaggacatttttccatttgaccatttcattgggcgattgaggccattgtccgtgcctttcagctggtgatcttccagcatcatccaattttaaaaaattaagagtaaatattgtaagggatagagccatctttggcgtcatagcctctattccccctttctgtttttgcaaatattgtttcagagtgcgatgggctctctcaattatgccttggccctgtggattatagggcaatccagtaatatgttttacttgcatttgtttgcaaaattggctaaatttagaagaagtatatgcaggaccattatctgtctttaacactaggggcttgccccatgcagcccaagcctctaagcagtgagatatgacatgaactgctttttcccctgtcaagggagaggcatgtaggacaccagaactggtatacatattgtaatttcccaaaagatgggatatgcgttacgtccatttgccaaacatctaggggtcgcaatccgcgaggattaacacccacggaaggtgcattaacaaattctacacatttaccacaccgtaggacaatatctcgggcttcttttcttgtgagcttaaacttttgtcgtaatgtagaggcagggacatgataaagctgatgaaaattttttgcactttctatagaactttgtgataggaaaaccatgtctctggtggctgagtcagcaattgcatttcccttaaccataggtccaggtaatgatgtatgtgctctaatatgttgaatataaaagggatgctcacgcatcagaatacaattttgtattttcatcaaaatttcagatacaggactggactgtttaaaatttccggcagtctctaatgctagaaccgcattaactacataaacagaatcagagacaatatttatgggcataggaaatcttttaaagacttctaaaaccaccaaacattctaccaattgaggggctcctggtgtaaattgcaaccttacagccttttcattgattacataacttccaactcctgttttggatccatctgtataaatatcaatggctccctttataggggtattagccgttacctttggaaatattactggatgcaataacataaaatgtaataacggatgtttaggataatgattatcaattaaaccagaataactgcatctaagaatggcccattcatctatagtagcacacaatatttgcatttgtgcgacagtatacgggacaattatgctatcaggcatttttccaaagtgagtgattgaagtttttattcctttgtgggccatatttgctaccatggtgggataatgctctatagttttattaggggatatatgtggatgtatccatactaaaggaccattttgccataacacagcagttggcagattgatggtgcataatatgcataggcacaaaggttcttgctcatttatacgagttaactgtgctgtttggatcgccttttccactttcctaagaacatcagaagcctcaggtgttaattgtctcaatgaggtaatatgtgagtctccttctaaaatttgaaataaaggttttaattccgaagtagggatccttaaataaggtctaatccaatttatatctcctaataatttttgaaaatcatttagtgtctttagatggtcttttctaatactaatcttttgtggggtgacacatcgtaaagtaatagtggctcctagaaaatgactaacattagactgctgtaccttttctggtgcaatactcaaaccattattttttaaagtttcattaagcaagccataagcttgctgtatactttcttcttcaggtccacagattacaatgtcatccatatagtgacaaatttttaaggaggggaaaccatccctaaccggttgtaaagcttttcctacatataactgacatatggtagggctatttgccattccttggggtaatacccgccattggtaccttttatcaggttccatatgattaatagaaggcaaggtgaatgcaaatctaggtttatctttcttatttaatggaattgaaaagaaacaatccttaatatctactactataattctccaatccttaggtagagctgagagtagggggagccctctttgtacaggacccataacttgcatttgtgcattaatggctcttaggtcatgtaacaatctccatttacctgactttttctttacaacaaaaatgggggtattccagggtgattgagtgggctccacatgccccagatctaattgttcttgtactaattctttagctgcttttaacttctcagagggtaaaggccattgaggcacctacaccatgtcctccgtatgctacgggatgggcaaaggctcttcagtggcccctagaaaaaacccagccctttcttgtctgcctttacagtggctttaactggtaaaattctaccttgcaaaatttttccaagacctagtccaggtatatatcccattcctttcatcatttccttgcttttctgagagtaatcattagtcaatataaagttcatagctgataacacatctctcccccacaagtttacaggcaaagggagtacgtatggttgaaaaagccctgtccttccttttttatctttccattgtaaggattttgcacttatagttggggtagcctcatatcctaatccttgtaagctatgtgacgattgattaacaggccaagaagcaggccaccacttactagatataatgcttttatctgctcctgtatccattataccttgaaaggtttttccttctatttgtaaagatatgtactttattttcaaacatactctttctaccctttatacattgcttttgcatattacctgttttcttatgttgtttagaataactccaaccttgggtttccaattttaagctaactttctgttacaagcaaaaggctgcctgcccctttaaaagctccatttgcaatcagccttcagcagggctttttcagctgtacttgactcccagccactgtgcagctaacttgtcattttttgctgtgcagactgagactgcttttttatttttcaacatgaaacacagaacaacaatcattcaatcatccaagcaaaaacaaacacgagttgacagacatatagacaatttggtgcaccaaaaaacagaaaatagaacacagatatcctattcgaagctaaaaatatttccataggagccagagaggaagcaggacgtctcccgttttctgtctgtccctaggagggctctgaaatagcttattttcattttttctccttcttctaggaattctgcacagtggctgcttctaatagttactcctctttccctgagagctatctttaagcctttgatgaaggctgcctctttagtcctcgagaggagggtaaattgacttaattttttgctcttcattttttatattatcctttatatctttatattatcctttgtatctttacattttatattatcctttgtgtctttatattttagcttcctttctttttttctttttatatttcttaagttacttatttttctgcgcgcgtcttctttttcctttctctctgtttctgatatgccttcctggtactcctacaaagtcgctgcccttccttaacagctggtcccacacaaacccagcaacaattaccagacccactgcgtaagaaagcatacctctcagagacttaccttaatttctttatacttactggtaccaccgttcctcagctgaagagttctgaatccacgcagttgaatccttctcagcagtctgttttgcaggaacctttattaacaccgctccccagctgaagagttctgaatccacaccggatccttctcagcagtctgttttacgggaacctttattaaccgctccttccccgcgatgcagttctgaatcctccctgtagcagggggtcttcgctcgtgcctgaagatgtttcttgtcccgggttttcggcaccacttcttgcgcgcgctcgactcgaccagcaagaacgacgctgcaacaggatccttctgcacacgtttattgggagagcttgattgcagaggcgaaaagactttttgcccagagctggtgctgcttttataggcctaggagaggcgtgtctcataccctgattggttatgcactaagcctcatttgcatgttcctcatctgattggctactctctctcagtacctcactgagcctcattatcatacctcatttgcatgtctcacatccgattggttatactctcagtaccttacagaacctcattatcatgcctgggccaggcagtgtttttgcaaaaaactttactgcatatgtacacattggctgtttgtccaatcttatgcatggtggccagcagtagtcagtgccactcagcaacggcacatgtggcttcccacacttacaggtgtctggagcccttccatgttttcctcttccctccctcatgagccccgcttgctctagcatctcctttccccctcgctctgccctagtgggcctcttctgagcatcctttcttcggtctgtggagctgtaaggtgtggtcctgcgcatgcgcaccttcctgcatcccagaagccctgctctgtggtgtgtggcggcgactctcggaaccatcactatttgctccttgtgctttgcagacatcgttatcatcctgcgtttctctaaatttctgacactgaggcaaacagatttgatctgttgtgtcctcttgtcttattttgtttgttgaatcaggatgtcattcatcccagtgcggtctcaaacccacagggtagctaaggcaggcctgaaaatcctaaacctcccacctcccaaggtatgtgccatgttgcctggcctgttttgtaattctgaaatacaacagaaaaacaaacaaacaacccccccccacacacacacacatacaaaaaccctaagaacctccctagctcaggtgcttctgttaaaatacatggcataaaaaaatgcctataattttatgtttaatttttatgggtgttttgtttgcatccgcgtatgtccgagtatcacatgtatgcagtgcccttggaggccagaggagggtactgggtcctctggacctgaagttatagatgattgtcagctgccacgtgaatattgagaacagaacctgtgtcctctggaagagcagcaactgcttgtaacccctcagccatccctccagctccaggttgtttgtttgtttgtttgtttgtttgtttgttttgttttttaaggctagatttcatcttagggcagggaatatggctcagcattataacacacttgcctaacgcatactgagtctgagttcaatctcaggactgcaaagagaaagagttcctttttctaagggaggatcagcctgtattaatataattttattcctatataaatatactatctctgtctgtgttaaaattaatttgatttttattcttgttctctattctcctaaccaaactatctgatttactttatttttatcatttcacccatgcgcacaaaccagttgtgagtaaactttcttgtggatatggctacatcataatacatgcatctctctatggtcatgtcacaatacatgtatctctatggtcatgtcataatacatgtatctatctatagtcacatcacaatacatctatttctctatagtcaggtcatgatacatgcatctctctatggttacatcacaatacatgtatctgccttaagccactaaccaaatattgaactaaaagtgaatacaaattgagagggcatcttgatcttttgtcatctgtgcagaacgaggccgaggtcaccaacagccattctccaaggattgctgaggactcctgtgtgtttctctcttctcttctgctagttcagtcatctaaagatggtcgcctttgtgagctgtcacctgttgcgatcctatcaactctggacagatccatggagactgctttagccagtgcccatggaggatggctggcaaatgcttgggcttttctcactcagttcgaaggcctccccttcattctgtgtctgtgtctgccccctgtgaacaccctccctctgtggctcttttagacccagtcccttttcacaagagccctgctttggaaatgttacataaggaacatggattttcttcacaagaaagggatctggtcccagagatgccgtctactagcctactgactctgagatgccattgcttcctctgccccgcctttctgtgaggtgggaaggatgatgctcatcccataatgttccaggaaccacaggagtgaggcaggccctgcaggccttctcctctgcagatgcgattcttcctttcctggtgctcacagggtacccaggttcccctttccttcatgtaccctcactggaagtcacactccggtctcagcatcagaaacctgacttcactgacaacactgtgatttccagcatgccatttcctccgtgaagcgctggccttaggaccacttagggtccctggtacatcgacagttctcagatctccagctggggactgcaccctccacttctagattgggcagactcagatgcagcagatgctctcacacagtccctccttattgctcaattcacttatggatattaggctgtgtagatcaagtgtctggggaatccccagttcagaagtgttctagtgtggagagctgtgcctctcagagctggcaagtgtggcaagcctcttagcagagggcgaccaacccgacctcctatcagcctctgctgcattctcacaggctcccagagtgtcaggaagtgcgactttattcttcttaaattcccaaggactttacatttcaaaaacctacagcaggggctcggtcagtgttgcaaagggcctttatattcctatggaatcggtttgccgctggttatttcatgtattatacataaattctagaaagaaaaacatctgaatagctacaggctgccaaaattctgttctgtctaatctgctaaaaatcacaaaattagtccctctgatgatagcacaagtttatcttagaacaggaattagagcaacagacttggaaactgtctcagagattatctttagatttttaaaaagtgtcttacaatctctttcatcaaaagaaacacagttggctggatacagtggcctgatcctgtggtcctggctacttgggaggttaagatgggaaaatggctcacagccaggaatttgagaccagcctgggcaacatagaaaaaccctaactcaagcttctccctcccctctcaacccaactgctgactggagattctggctagtgatctaagagatataatctcagcttaagcagataagtttttaaaaggaaattacacacagtgaagtgggtgctctgtatctttagatatacgcagagatgtacacatgtacataggtaggtgtctgtgtgcgcacatagccatgtgcatgtgcacatatacacgtgtgcgtaaccatagccacagccgttgcccttgcacttggccgtgtgaggtcagttttgaaggacagacatgttctttcagccgttgctcactgtctttcccactaagccacatcagctcccgctgctacctaaaatgcctggtcagctcaaaccagcctgttggggatctctctagcccttgtgtctgtctcgtcctggctccctgtctaagatacccctttcccttaaggcgcctcccactcagaataaaagcagcaaagagtttaaaagctatcctttaacaagccaagctccaccccctgaagcttgagcaccctgggtaacgtggctctcaaatcactttacattttgcttggcagtggtatttagtgtatttagtgcttaatgtacttatagtttctttttgtccactttgaatggggatttccttttttctttataatttccctcccatctacccccaaacttgcccaagtagaggtttctctttccttcttgggggtttctggacagctcctccccatggtcctctgttacagtgttatctctgctgctgtctcagggctgcaccgttgctgtgggaaagcctgtcttgttctgaagcttgggcctatgcctgcctccgtcatttcaggacaggcggctgagcaccttccccgtctgtcaggaataactattttctgccttccactataaaagctgaagcatccagtcccaatgttcccactcacctttgcagccgagacccaagctttgaatcagaaactacagatctagtgaagagaggggtcacatagaatttattgtaatggatggcaacatccttttctgatagttgtgctccgtgacagggctctgccaggggctggagactgcatctccacagtccactgcataactcagtggatttctacttaaaagctgccaagttctctgtagcttgcaaccaaatcttcctgctttggccacccagtggcctggagccctgctgtggactctgactttgcctctgaccccatccgattaaccttagctgaatcagataaatgcccagatctttgtttgaaaatggtggtactgctggtgtctcatctctggtttgctaggtggaagtgaggtgctcactgctgaacaccactgtctgccggccaggcctggcccacagcagggtgcgggatcttgctcttgccattctggggtctgcccctcttctgtgtagcagttcctgctctctgctgctgcttgtgctctctgtgtttaaccccattggccagttactgctcactagcacgctgctgcttgcatcttgacaggagtaaaaatgttctttgttctctgtttactgatctgattgaagggaaaatgctttaggcaccagtgagcttcagggtttccctggcgatgttgactcaggcgagagagctccttagcagagaactgaaaagtcataaattgtggcctttggccaggaggtgaggtttaaagagaccagcatggctgcaggcttggtgcatggattattggaaccactactgtgagggaggtttccagaccatgagaggcatagtcagaactctttattatctctaaagaaaatagggaagggtggggcaggagcttgtcatccttatccaacaccccccaaatggaactgaccccacatggcttaatgacctctgacctacacccctgactgttgccactggaagataaaatgggctaaaaatgggctaaacattaattttaccaccttaaagctcaccctggtacaggggatggttttcttctggcgtggcttgctggtattttggtgtgtgtgtgtgtgtgtgtgtgtgtgtgtgtgtcagaagtagccttgagaatggttggcattttgtggataccctttactgtatcttctaggagagattgcacgcaggttgcttttgatgataggcgtgttcaagactcactcaccagtgagacagagaatgggattttatcagaggtcttcagtgtactacttggctactcaaaataaaacatagctgacagaaaaaacacatctcttgcctcaaaggggataagagagagtttatctgggatccagatatgagttagggtggcctaggaatacagatttagcttaccccaaattccatgttccaataaggtagcaatttcattaacttttctgtggtgacagaacaaagaaaactcatgaatcaagacactttctgaattcactaccactgcatcctgaaggcaggggatgggagaaccctgtcagagacctaagatgccgcctgacacaccaccctcagcttttggttggtgaaaaatctgtagttttactatttgttccaaaagagaatggctgtttactagactaaagatggtccaagactgattgcagtgaggctctggaccttccatgttccaacacctgcagtgaccacaattttaatgagccagtcagcctccaaaggtgcagctgctttctcggaattctcattcacagtaggcaacagacttatctgggaaatattcctactgagcaaacgtggaacaattctaaaacaaattgataccgaaactgtacattacaagccacagatgaagatgtgtttagatacaggagtatctgaaccagagtatcagctggaaagtggagggtggtacccagcggagggtgcccagaagtgtggccttgtaatgctctgaggagtgagacagaccaggacctttcaggagatgtgttgcattgtgagccatgaaagccagaagagaggatgagtgtggccacacccacaggggaaggaactgggagatgggtgggtatcactggttgtaggccatcatgtggtgggaggttccagcctggagagcttgtgcatgaaccagaccgcagacatgtttctaacgcataaaggaaagaccgctgtgcctaccaatcttcattctcttgttttctttttcttcagacaccctggagcccacttaccagcagcttcagaaaatgaaactggacaagagtccctttgtggtcgtgtctgtggttgggcaggagctcctgacagccggccaccatggggcctccgtggttgtcttagaagctgccctgaagattggcacttgcagcctcaaactgagaggctctgtcttctccgccctgagcagtgcacactggtctcttggcaacacagagaagagcactgggtacatgcagcaagacttggatgtagccaagaccttaggtatgtgtcccacctgcatgcaacagaacatttagcttcagggccacaggtttcgaggatcctcgtacagtaagggtccaaggctcccaggaggccttgcaatgtgatgagcatgttcataatcttcttcatggccttccagcttacggttttaaggtcccagttgctgggtctgtgggtgactcaacttcattttaatattggcctctaagagaacccaccaaggtttgtcaaatacacagcacaggctgggtgtggcgggccacgctgagaggcagaagcaggtggatctctgtgagttccaggccagccagagatgtacagtgagagtgtgtcttagacgaaacaaaggagaagtgggtgaggggtgggcacagcatatgcgaggttcagaacctgcactgtggagacagatgatggtgtgatgtcactgccacctactaactgggggcttggcactttgtttcttggtgttttggtggcaaggtcacagtatgtagcccaggccaacctttttcctgtgagcctcttgcctccttgcaggggagaataggaggcatggctgtgactgtggccgctgctgtactgatgattatccagggactttcaggttacaggaaggagggctgtggggatctgccatcagatactcatagagaagtgatgtatgagaggaggcccggagtcaaatggctgaaccagcaagctgataattgctcagaaccaaaggtcatctgcaaagcgaggaggacacccccaacagcagctggtttgtgtctcggtctgcaccctcccatccgagacccctctgcccctgtgcacgtgtgtgttacagtaataacatttgtccacagagttaggttctgggatcttatctcctggtatggagtctaaaggaaagtaacttaaatcctagctagtaaatttgtggcttttagcagaagcatatatgttataaataatgctgtaacttaaagaatttttctccttaaatccaaatcaggtgaccagacaggagaatgccgagctcatgggaacctaggctctgcattcttttccaaggggaattaccgagaggccctcacaaaccacaggcatcagctggtgctcgccatgaagctcaaggaccgggaggtaggaaactcacttgcaaaccaatgcagagcccctttatctgtgcaggaagcgtgcggggcgccttaacatctccggaagttcagtcattgcgactgtcatgcctgatcaggtactgaatgtcaattgcatagtccttgggtatgtacaaagagagaaggtcttgactctgacgtcaggagcaagcagcctgctcaggtgtgtcgttctacgtcccttcaagtgtgccatgaaactcacagggagactggcagggaactgcgtctggtgacacgctagctcacacgagctttgtttgtgatctagtgttacgattgtccctccgtcattttgtttccttgtttgagagaagcctgatgaatttacgggaagagccaaatgtcacagtgaagaccgtacttgcagtatcaactgtgactttctttgaaagttgatatctagcatggctggcacagtgagaaagccttcctgtctgctcttgggcagagggtgggcttgagtttcaggtgtacccagccctgagtcgtagctgcacttcctggctatggggccaccttcctttcttctgttctattcggggcatggtgactgatcttccctgtcctgctttatgactgcacagttgtgtagggtcatgtataacatatgtgaagtgctggtgtagtgcctggaatcccatggctcccttccattaaagcagttttataaattatggcagctgggcggtggtggcacacgcctttaataccagcacttgggaggcagaggcaggcggatttctgagtttcaggccagcctggtcttcagagtgagttccaggacagccagggctacacagagaaaccctgtctcgaaaaaaccaaaaaaacaaaaacaaacaacaacaacaacaaaaaagggtcaaagtgtggggaaggataagtttataagtcagttcatatgttcagttatatttgcttgttggagatttacaatgggatgttattacaattatatcatttaagcaacagccagtaacttcaggtttctggggtatcattgggtacccatgctaaaaagaaccaggggttttaaaacagcatttgaaatacatgcagagagcctgtagtcccagctcctggcaagatagagcaggaggatggatccagttagaagcaagagactgtcctggacagcacagtgagaccctgtaccaagtggggaaagctgtcactgaggcagctcaggagggactgcaagcctgacaactggagttccatccctcagactacttggtagaaggaaagaacctactgtccccctccaccctccctccaagttatcctctgatctacaatacacacacacacacacacacacacacacacacacacacacacacacacgcaccaataagcagatacctttagccccagcaagtagcattgctgagaactctgaactgggctggagcacatgaagactgtatttcatttcacttctcttttattttaaggaaatgtgagagggctggattaaaaaggtgcttgcctctgtgcatggctggccatttgctctcgtaggaaggtgtttggaggctttgtcagcactttcatcctcccctgcttatcatccgttcagaaagcccggcttattatgtttattcctagtttattttgagaccaggtctcactttgtagatgctgccctggttaggctggagctctgtgtagaccacactggactcttctcctgccccatccacctgagagccagggctacagaaaggcgtgtgctgcaactcccagcggaaaacggggcttgcaaagacaaatgtaccagtggtattaagaagtaagagctggccaggtcctgaagggcaacacaactgtctacaaatatgccaagaccttcatttacctgttctatctcacctgtgaggtgtttgctttggcccagctttgggagggtggagacactcactgtggtctcctccgtgctgtggtttttctgtctctgggcttatctatcgcctgggattatatatagtgtgtgaactatcaatgtgcagtgtgttcttgggaaatgatcgatatgagagcagagggggccccgagtgacaccagtgcttgctccctctctccaactctctgaccgtgtagtggccacctgcgcaggcatctgccaccttcctggtctgtggcatgtccactgctgtagtagctgcagatctgcctgtcaggagcccatggcccagcctatccgcagaagacagtcccttacagggctagctttaaacacatttccttctgtcccgctgtgaaggatggaatgtatctagctgccatgacccttgtggagcacacccccccatccttcatttttcctccaccaggaatagaacttgggctctccctgagcctcttggacactgcatcctcttccaagttgaaccccaccattcacttcccctccgagttaaagatgttgacgttgtaacaactttagcagtcctcttctggtttgaactcattctgacgcctcttgctacaggtccagactcctgcttggtgtcactcgagagcatgccttctgttcccaggctaatgtggacctttgtgtctctcttgtttgcctctggagttttagaatggcttccatgttctttactattagaaatgtactattagattcttggccccttctttgaatttttttttttttttttttgctcataactctgcttgtggatctgacacatagtagtgctcaccaattcttcctttccttttgctaaaaacatttgagatggactttctcagccctgaccgtagtttcctgttgtatccaagaactcaggatttgttcgttccacatgactgaccatgttcccttcctgcttcatctccacattggtgggcactgtgccatctctgcgcctccatcggcttgacttccaggccccaggtctgagcgaggtcgtacagtgttttccttatagtgagttaacacaacactcaaacctgctgtcattccctgctattaatttgacacttgggttgttccaggatcatggatgctgtggacatagcgtctctcttagcttctcctcctcttcacatgacggtagggagtgacaccaggaccctgcccatgccagacaactattccaatactgagtgctctttctagcccactctgaatctttttttttcttttttaatgctgttgtttatcttatatatgataaagtaaatgtctttattcctatgttgttgaaaactacccagtaataatcctggagttcactgtgtcagaccttggaggagtgggcaaagggcagcagcacaatagtgtatgttgtgtttaggttggaagttctaataggcaagtctgcagctcctccagaagccccaggtacaggcggggctcggtgtgagcatgcgcacagagcgcccacccctccaccccacccccgccccagccaggtgtttagtgcactgagatgtgaagactctgcttagcaaccagcagtgagtcctgtctcaatcgatgctaggtcgctgtgagctaagacagggactggtcatcgtctcaaggggtcttcaggaaatggctgagatgctgggatatctgttgcattatgctgacatgataagagtttcatttctttaaagataatatttgttttgaacaattacgtagaaatgcatggaggtaaccaagcttttgcccaccatactgttactatttcggacacactctgttagccatatgcagttctgtttgtgtcgattcaaatcaaagctgaaaccccttttgtaagattgttttttaaccttctccactgacctttttctcctgaatgtaaagtcttcttcataatgatcccaccctcctgcccgtctcatgcttccatatttaggggttgcaggtgttttggaattatagaatgtgaggcagtgccacagtggctaagccggtgaaagctgtgttctgttttatctttcccttgggctgcgttacaacacacccgcttctctgggaaatgcttcttgagtcttctaacactcaggcaaattgccctcaagaagtctgttccagtctcaccaacaatggggcctgggttttgcttcctcacccactccaacacgaggcattaatattagaatgtaaaactctgctgtgtaagtttaaaaagtagcatcccgtctgtgtttgttcagagacagggtttcactgtgtggccctgttggcccggagcttgctgtgtagactaggctggcctcgaactcacgagcttctgcctcggttgctgtgtcaagggcgtgtcattctgtttgtgtggctttggtcagtcggatgaattgttttctattgttccatatacaacttcactctctggagataacgaggtctcgctctgtggctcaggctggcctggaactcacatctgtagcctaggccgccctggaacttgtgatctccctgcctcagtgtcccaagtgctgggattacaggtgtgtgcctccaggtctggttcctgtctgagtctctgtttcctgtatgggttttggatgttttgtaagggctggagtgtctatcaccccactgcatctggaaactgtgtgttaagtattgttaacgtgtgacacgttcactcacacctgcttcgaccagctcccacttctgctcctttggaagatgttatactccactctgcctgctttagcacttcaggatcacttgttacactctggagaatcttccctttggatttctgtttgagctctatacatgctaggtgtgggaaaatgattactacagggagtcgcccatgcaagaaccagccctgctccttcatttattctttatacttcttgctcacatacattgagacaggtcttcccgcatcttcatcgagcctgtggatgtggtcccctgtgccgtctggcataccagcacaggaaaaggaggagtccgaattcataaatagccaagtgtaattttctcatagcagtttcaccagcccaggactttggttgatcctgtgagttctccagaaatgcagacctcctgccagtgatggcagtttgtcctgccagcttaggcaacttttatcctttgactgcctcactgattagaatttgaagtgctctgagtggtggccacacccgccagcatcaaaagctcagcctgtgatctgggctagctcactctatttgatgttttgtcgctcatgcctctggtgtgtgacagcactccatgggcacctgtgctgggacaggctctcctcaacactcttccagttggtcttctttgctcctctcatagacagtttgtttctatatccacaccacataggcaatgataccatgtatctgtataaagtctaagagctacatttgagagaaaacatgataattcactctctagggttatctcctcttgtgtcaattttcttgcaaattttctttacccattcccctgttgaagacacatccatagttcccataacttggctgtcataatgtatccttttaaatgtaacattgtctcggtgacatttagttgcatgttatatgttctgttgcattatttttatattgacataacaccctctgaagcaaaggcaaccccagtaaaccctggggactggagataacccaccacatcctgctacctcgtgcgtgcatctgagctctgggaaactttaggattttaccaaacagtaagatggcaacttgaaagccattcatctgctcacctttagaagcaatggggtttccttttatgcaattactctcagatacttaataggggaggtgataccttcgccacaggatttttcattgagagtaaccttctgtctcttttaatggcttcaaaattaatttcaggtgcccacagagaccttcctgtgagtgaatattaattgtcaggagggtccataaattacattatattaaatgttctcgagtcaggaaatctgatatgcaaatgcacaaatgcctccaaaggtcttcccggcctcatttctctccagagcactgtgtttctctatccatctgatttgccccccaggaccccactttggctccgtgcacctgcctcagccttcagcctctgcctgctgctgaaccgctcttggtttttcactgaggccacctccctgtcatgctcatgactcttctggtgactggattctcttatttctgcagctggaatctgtctttcctcgctatcattctctttaagaaactctatgagttgagaagaaggggtgttcactccagggtctgttaacatggcccaagatacagaaatggttgagtatgagtttaggtatcccacaaccttgaacttaaattttgcccctgtcgataattgctgtgtggccccgagacagtccaactctttaaatggatggatggtcattcgagttgtttcattttctggggctttaacagcttttctttgaatcttctggtgaacaacccttatttcttaggtctttgctgacacgtgtttagaatgatagatttttgctagttatctgaagtggttgtaatgaggtgtgtcatacgcaatttaagggattcctaaacttcaacaaaaaatagttaaaagtgagtaggggcacaggcatctgagcaagtaactttggatactgtcacgtgtagttaggatgctgttgtgagattaaatgttatttcataaaagctgccttcagagcacagagcttgcagctctaggattctgaaaggattctgctgctgtcctaggggtccttggggatccttgggggtcactgtctcctcctggctttatcatctgtgtgtgcaccgtatgtaactatggaatagcagtgcctactctcgggtaacatgggtttatctcaaatatttaagagaagtaggcactgcttcgaagaggcattttcttttgctgggtggctttgtatacgtatctcctgtcacactggagcgtgcaaacgtcccggtttctgaaagttctagttttctaagttcaccctgattctggtttcttctctgtgtgacaatttcttacacacttttctcacctgcccttctaaaatttagttcagaccgtgaagttacctgttcataaagctttgctaggttcagttgcctctggggggaatctaaatactttcataaccatccccacggcctttccactgttctctctgtagcccctgtgggtccgcttgccataagtttgtccttctgcacattagctcattctggttcccctgtgtggaagctcctctttcgaccctgttcagtttgcctgaacatctctggatccccaatgctctttccctgttctcattgtttctatctgacattgtgtgaactgctgatgaggtccaatttagcgttcactttgcggcctgcttctggaaatgtatgtgtctctcaaggtcactcggctttaccacttcagtatctgcacttagatctgtggccttgctcggtttggggcagagaacaaagtcaggtttcttcccatggatccagcccttgagaccctgcagtgcgtgctgctgtccccattatgtccttctgtcatcatgcagacagcacagaccttctaatgagtctcatctctgacacggccattctcatggctttgttgtaggctgagattgtgctggcatccccctctttctctcctacatgtggatgtgatgtattcctgaaccagcttgccagcccactttctctagacatccaattgcagctatgattagaatagatctcagctttatatatttattggacagtggggctatagcccattttctgtgcacttaaatataactgtgtatatataaaatacctagttgtgtatttcttttctttttctcattttcaatgccaagaaaatatttttgtagttttgtttagcaattcttatttgtatgtatttatgtgcatttatggggcacgtaggacgtgtttgattcatgcacatgaagtacatgctcaagtaagagtagtcagtaatactgtctccatgcgcattgcctttctgtaaagctttttatttcacttttaactatgtgcatgtgtctgcatgggaggttgtgcaccttcgtgcagcatctttggagatgaggatgtctgatcctctggagctcagataacacagttgtgagctgcctatcatggatgctgggaacccagcttaaggcctccgcaagtgcagcatgtgtgagccatccctccagccccctatattatcatctctatgtactgagaatcttctgcttcttttcctctacctattttttttaaagatttatttattattatacataagtacactgtagctgtcttgagacacaccagaagagagcaccagatctcattgcagatggttgtgagccgccatgtgggtgctgggatttgaactcaggacctttggaagagcagtcagtgctcttacctgctgagccacctcaccagccctcctctgcctattttaaaacccacagcatgctggacacaatacacttacccctgtgcactctggaacaccggggctgattcctgttatcttagtggtgtgtggcttttctctgtccccctgctttcctacctgttctgagaccacgactatacagtgctttgctgtgatggaggacctgcggtgcttgtcttcccttggctgttgtgctccatctaacaagatgtcctttctccccacccacatggcacaggtgatttcatactttatggccgtgtctctctacattagaaaaatctattggtcaacttgggttgacagtgttgaaggggactcaggtatccaggcatctcctgaggcatcgagatcattttatttcatataaaccagcaaaggaattttaatttttttcaaggcatcttatctgttttacacaatgcagtatgtcttgaacactgtgccaggtactcttgcctctttgataatagccatctgtcctagaactggtggatcgccgtgaagggacaccatgaccacggtgactctttaaaaaaaaaaaaaaaaagctctctaactcttttcagctttcttgactgcagcatgcttctttctctgtgtctggttccactccctctgagcatcacatcctgggcaggcaccccatggctctgacctgggtctccagggtagtattagggttccgtttcacagcttcaagcaatggtttctcccagtctctgtgcaaggacacccctggagcatgcccggcctcagcagctttccttagccatggagggagattcctcaaccccttttttgtatccctcactctaaaaccagaaccaagtgacctaagccaccaaggtcttccgcttgctggggctgggacttggcctccttgcaaattcatttgcatcagctttctgggtttgctggtttccttcactgtttaagctcccttttattttatttttccacagctgtaagctcagctgggtggggtcctgccctgaggtcactgctctctttattccatacgggcggcgtcaggacttcctttaggagttttatctccttgagcgctggactcagctccatcacacttcctgatgctccttttctctccagacggtacacttttcactttcccttgctcagactgctccttttcatcacagatctgcatgagagggtccactaatcaccaagcaacagaatcaatgctcggctgctctgaaatctcctctacctacgctgttaatccaaaaactctatcacttagcctcaggcatgtttttcagacaagggcaaaaaagcaaccacattcttcatcaaaatgtcaggagaatagtctctcggccacttactaatattcttctctgaaatttcgtgagttgggccccacatctcaaattgcgctgggcactgacttccatgtcactgctcagatggccctctaagccccacttattgtgttcaactgctttcctaatctaaagtgcccatgtccacattctccaaacaggcaagactgtctcagcattaccctgctccttggtaccatctgttgtcttagtcatagttctattgttatgaagagacaccgtaaccagggcagttgtttaaaagaaagcatttagttggggctggcttacagtgtcagaggtttagttcgttgtcatcatggtgggaagcatggtggtagacaggtagactgtgctggagaagtagctgagagttctacatctagattcacaggtagcaagaagagagagagagagagagagagagagagagagagagagagagagagagagagactgagactgactgagactggcttgagcctttgaaacctccaaagcccagtcctagtgacaaactttctctgacaaggccacaccccctccaacaaagccactcccccaacagtgccactccctaaacattcaatggcctatggaggccattcttttgtcttgtttttatttttgagacagggtttctctgtgtgaccatggttgtcctgaaacttgttctgtagaccaggctggcctccaactcagagatccacttgcctctgcctcccgagggctgggattaaaggtgtgcaccactaccacccaaattatggggccatattcctagcatgtctgtggtgacaaccatagtcattctgtttcatatgcctttatggttgctgatgcttgatgtgttttcatatgccttaaaccatttatgtcttctatacatgtatccaggggctagagagatgacactcagctgtcaaagtatttgaaaagaacccacatggtagctctggaccccccacctggtacccagaaggaaagagctgcagctcacatatactaactgtcgtatccattgggtcagcacacaccacatgttgtgcctttgctgtgcagattaggaggcgaccattgctctcatccttggaggctctaccctcctgttccaggccaaagctggtgatggaggctcgtaggctggagaatctaggcagtggcaggagccttaaagcttcctcaactcgcaacttccaagcaagttttagaaactagagcaagttttagaaactagaaaacacaactatatctgattcactccccttcctttttgcagttatctctgctgttaagagactaaattctaaaactcacatcagtgagggttccttttacaggctcagcacgctactcacaaaggatcttgtaaagtgaaatacgactcttcatgattatgaaagcgaggtgaattatgactgccagaggctcccggcacctgtgggtttgccaggccaggagaaaacggagcttctgggtctgcgtcagccgcaggaagttacttagatgtctcccagggacccccctccaccactgcactgtctccagtgctgtttccacacagtgtgtattatataatctgtactagtggtagtgtgaaatccattaaaaggtctgtggtatgtgtgttgtgtgtgcatacatgtgtgtaagacagaaagaatgtgtttgggggtctttattttacttctagtagttgagggagtagattaaaatgtaaaaaacattccgtttgagcctagagctctgtcctcacggggagtattgagttcacaggggaaggcttggcaaccttctctctgtgtctcacagacctttgagaaatgatcaggacagttacacagtaactcaggtcacctgagacagcaggacttgaaggagaggccgttggacccagtgccgagggtgaggtctttacattataaatcagctgagtcagacctcttaggcccgaggccagttatcaaaacttctcttcagcccgctgataaaacagtgatgacatcaaaggaaagagcatgtgcagcaagtttgcatgaggctgctgcaaagcagtgtgcttgcaaagcaggccgcctgcagacagtccacttccccctataaaactctgcatcatcaccaccaccatcactaccaccatcctcaccatcaccataaccatcactaccaccatcctcaccatcaccatgcctcctatcatatttctccccgtcctcttgtagccaccatgtcttagctgatggaattctcgcttgctcagacagtggccttctcctagggtggcttcccacagtgaatgctatagaataaggccattggctgagcataaattcaaggtcactaagagtttaaggtcatcctcagctacctggcaagttcaagtctagcctgggctacatcagacttggcctcaaaagaaactctggtatttctaaatctcttaaagtagtcccttacttatttattgagacagagtctcactttgtggctcttgctgtcctctaacttgctatgtggctcaaattgccatcaaacacacagagattaccagcctctacctcccaagttcagtaactgatagcactacacacacacacacacacacacacacacacacacacacacacccctctagacatataaacaacaatttcttcactacagaataccatttccagcaggagagctgcagtgcctcccttcacacatgagaggaaagtacgtttcttgtaagaggagcattgagcataaatgtgcatgtctgtcaggaatggtcgaggctcggcacagtaggatggccgcattgctggagtcaaaaaacattccgccctcctacacctgggcgaggtttctggttccttcggtgccttgagatcctgtgagaaaacaggaagagcacatcagtaagatggctttagcaggctgtagcacaaactgcacaccggttttattgtttggagcaaatcatgacgtaaagtcattctgtccttgttgaaagtgcaatgcacacacagctagaaggcctccagagctcgcagagcagaccatggttgtctggaaagctgctttagaaacaggggttacagaactgagctcggtgtccccgcagagctgtgtctcccgtcctgtggattagtaaatgtgtactctgccgaaatggactttaagagccctctaaatagaattcagggttctttctctctccccctaataaaaaagtttgtttatttatttgtttattttcttaattatgactgggaacataacttagtttgcagagtcttgttgggtgcaaaaagtcctgagctcgctctctggggcggtgcacacgggcatccgggcactcacaccagcatcctggcactcagaaggcagacacaggtgctcgggtatcttcgcctttatggtgagtttgaagctactctgttttaaatatcatacaaacattttgactggcgtagaaatcaaacacatttatcgggagtgttgcatttataggccttctcttcctgtgctgggggctgaggccgtgcacacgccagtcagacgcttcaccatcgcttctcagtattggtatcattgactgctgggagccatagctaccctactgtactctaagcatcaggagtcagtcctcttcagagcagcctgagtccattaaccacggtgggcccatcccccacacagcctttctccggtctgtcaagtgaccggggttgttcacgcaccacagcctcctatgcttctgtttcagtcttgtgggcactcttaataaataaaaactccctcatagatccttctgtcttatatttgtctatcactaaaatcggttctccatagaaatgtcttaagttagatctagataatgttctgtagatgaactaggaacggaagctactgcttctccggctgacacagtccttcatgtctcagttgcaaagaggaagtgactggaggacacacagctactgagcaggaggaggaagagttgtgtgtgtatcgtcacaaagcatatctgtgtttcaaatcgggttctgttaggacccatgtgtttaagtgaacttctgctgaaatccgatgtgttatggagagtggatgaataattccccaaatggattttctgtgaatttcgcaaactaagcatgcctttctaagttctgctcactccattgtttccagctgttcaggagtccaggccacaggaaggacgagggctgtcctgaggagccagggccaggcaaagtttccttggtttttggttcctcttgtacctcccctcgttctcaatgctactccaccccattagatccctcggggctccggcagcttagattttctgttgcttgagcatccctctgatttgtggattctttgcagtgtttatggttttttgttttttggtttttttttttgttttgttttttttttttttttgttttttttgcttttgcagtggccttatcagctcttctcacagggtggccagagtgtggcctgctttgtcactgccaccttgagattcactgaggcttgaattctgtcttgaagcttttaccccattgcaacattctcaggcatcatctcttaaacgcttttctatcccatggtttttgtcctctcagtctctcagaattgagactgtttctaaccttatttctgtttcctccccctcctagatcacacacttctctctcttgtccagctcttgtatgggtgtttggcttgcacacacatccacatgtgccattgaacatcaaaccagagtcttctcaaagagtagactgtgctctgaaccacttagccatctctctagcacctattatttatttttaattatgtgtatatgtgtgaacatgtgtgtgtgtctctggatatgtacacatgggtacaggtaatttggaggccagagatgcagcatccctgcagctggattaaaaagggttgtgaaattcttggcatggctgctccaaacccagttcaagtcctctagaaggacagtgcgcactcttggctgatgagccgtctatctctcgagtcctgaaattgtcttaaagtacattttatttcttattgtcttattttattatattaacttttattttatctgttgagtgttcgtcttcatgtctgtgcaccacatgcttgcatagtacctgcaaaaggcagaggagggcatcagacactgaaactggagccgcagatgccaattatccaccatctgggtgcttggaaatcaaacccaggccctctcagccaccaagccggctctcttgccccatcttaatgaggttttagttgaacattttcatatcacttacttcacatcccaccgccaagttcatggatctgtttccgttttctttccatttctcctggttctgttgtgctggttcctttcatactgactaccgaccatgatacctaaacagtgctcagcatatcttagtgatgtggtctctcctgggatgggggcagcttcattgatatctgaaaggcatttagagaaggtcatcttaatggagagagataaaccctgggatgatcctaacacctgtttctgcccattctctcagttcagctttgctctttggcttggtcctcactctaagcctgcggcgctaccattagaagcttttatttttatctgtggtcccagaagaacaccgagagcaacattatcagtgtgtgtggttcttgtcttccccgtcgtcacaggtgggcactgcctctgaagtctcacagtgagacgcagtgagggtggcgcagagtcagaatgcagcttccatggtgcagacactgtaagtcatggcttccttagtagctttgagctagttctatctgctggtgtgggggctgctgagcagctctgggaagagtctgtacttcttggcagccacctcacgctcacctttctcactggatgactgcacacctagtttttgcctctgccaagggtctctgctcgtctatcctgcccctaatgcccatgaagctcactggtgcctgaaggtggctgttgaattatacagctctgttctacttgttcctgggagccagtttcctctgctatgaagcagtgtgttgtgtgtgttttataaatgttttgattcctgatgctatttatttagtactacatctgtggaccagatgaagatcacagactgtgcttagccttcatgttacagcagtgacagccaaggctctgacagatccaccagaggacacacagacagctactgactgttcggtcaatggcttccagcttgtctatttgtcttaccactgcttcactgaaaatggagtatttgtggactttcctcgttacctgagattataaactatagttttttatgatctcaaataactcgaccttgccttgatttgtttgcgttgttttctgatggacttcattcagtgagaagagagctcttgtgcagggtctcggcagagatggaagtcccacccctggtgagcagtgtgggcatgagacttggaatccatctttagcccattgtcagcgatgacttgagtctggaggggatgacacatagcacagcacactttctgcctgtctgagaggctgtgatcatagcacagcacaccttccacctgtctgagaggctgtgatcatagcacagcacaccttctgcctgtctgtgaggctgtgatcatagcacagcacaccttctgcctgtctgtgaggctgtgaccatagcacagcacaccttccgcctgtctgagaggctgtgatcatagcacagcacaccttctgcctgtctgtctgtgaggctgtgaccatagcacagcacaccttctgcctgtctgtctgtgaggctgtgaccatagcacagcacaccttccacctgtctctgaggctgtgatcataacagcacaccttctgcctgtctgtctgtggggctgtgattcatagcacagcacaccttccccgtgtctgtctgtgaggctgtaagggatacccatgatctatagtctttaccccaccaacagctggaacagtgtggcagcttgctgcatgtggcagctatgtcttgagcttcacctgcagtttatgttgagagtatttgactatttcctaccagtaaaatcaactgcttttgaatcactttatgaatgatgtttacgaagtggagctgactctggcttacgtatccttggaggagctgttggcagtggcttttctggcaatgttttttgactgagagtgtctcctgtggcacaggattgtgtgaagttgtacctgggtagtatatcttttagcctgttaaaacaggtgatggaaacagatgaatagaaaatgacattaatggagaataaatgttactcaatgtttgacctctgtactccaaaagctactttaaaatttatgggttaagaagtttcaatggtggagtgtgatctgcattcactaacagtcggcaaaaccacagggtttctctgagttctcagctccaggagacacaccatagatgttagacaatgtctcatccagagactgctatgtaatagcattgccagggctgtaatttcctgtgctgtgactttcctcatgtctgaacttttgttttagaaagtaactctcaagggtcacatttggaatttcttcttcttcttcttctttttcttcttttttttaatgcaattttaggattcaaacgtttcctcaacccgagtgcgtgagtgcatgaatgtgtgtctgtctgtctttttctgtttgttgcctctcaacccccccaaattaaaggtctatcaaatgaagacagtgagtaaacaagagacaattcaatcgttgttgggtatggcatttaactgtcactcctgcaggtagtagccctgctcatcctgactgttggctatgcgcctcctttagatacgcatttcttcatctcagtgaaacatctttagaatcacactgcttctccaaacccttcctgtctagccagagcttctaaaacccacatcacagaactctatgtgaaaaaggacttcaagtagatttggcaagttgtaaatgaaagtccttgtcacatccgaagctgtagtattgtgtcatagaagtcagtagtggggcactgtgctgaaagtcaaagcttatccccagacactgttgttaagtgtagctaagtaggtctgctgaggacagccagtgtacagaaataactttaatgaacaaggctggggacagtgttgggagaccatgagacttgaaaggagaaattaaaagtagaataaaggattaagagagcaaagcagtgtgcttctagttggaccaagctccctgggggaccctgaattcaaattctttttaacatgcatttgaattttagcttccagaggcccctgatgcccctgagatccagccactcgcaatggctccttcatctcttggcccttcagaagcctccagttacagccttgaatttaaaaatagcaaggaaataagggaaaatcataaacctggctataataaaattagtgcttgcgcgaaaggctatattgccagggaacagcttttagaagcccaggtgctgccaaaaggccgctgggtgttggcagtcacctaaactttactggccagctcactgcaacctgaacgaggcattttattaaaggtatagcagcttccctccacgttcatgagtgttaaccgttgtttttaagtaataaaaatgggtcagaaaaaggactgccacaagaagtaaatgtgtgacttcccttacctaagtggaagtcagaaatgagtagaaacagtgcacctctcaggcagaccatgacagagtagggcccaaggaacaacggacctatgtgcaaatgagcaacagcagcaggacaccatacccattaatctgcaaagggaacagtatgaatcagatgtgaggtctggcaaggatccttgcacttccaattaaatgtgccggtagaagatctggaattctcattagtacttgaaaggagagctgattctctttcagaatcaaatattttcgaactcgtgtgtcacagagcccgctctggttcagtggtctccctgtgaagtatgcattaccatggcaattggctctcctctccaatacatcattaacacagatgagcctcacagtgagtctttctccgatgtgtctcagcgacctggctgagaaacagtctccctaacctcatgaatcaatctcgagaaagatacagtatgtctcctccacgctgtctctgcagctgagtttggggccctcttctgtgacctagctggcaaaccgtccccctgacctcatgaatcagccctgagaaggatgcttgtccctgcagctgaggttgggggcctctcctgggccactgcaggcagcagcttgtattgtattctccacagtgtccttgtttctacaagtgttgggaagaatgagccagatgttgtcagtcctgttcttgtgaggatcacccaagtgagaacactggttaaatctaaagctttcatttctctgagctgccccactccccaggctcagcacacctgtgcaatgctctgaccccagcacacctgtgctcccactccctgaccccagcacacctgtgtacccactccctgaccccagcacacctgtgctcctactccctgaccccagcacatctgtgtacccactccctgaccccagcacacctgtgctcccattctctgaccccagcacacctgtgcacccactccctgaccccagcacacctgtgcacccactccctgaccccagcacacctgtgcacccactccctgaccccagcacacctgtgctcccactccctgaccccagcacacctgtgcacccacttcctgaccccagcacacctgtgctcccattctctgaccccagcacacctgtgcacccactccctgaccccagcacacctgtgcacccactccctgaccccagcacacctgtgctcccactccctgaccccagcacacctgtgcacccacttcctgaccccagcacactgtgctcctactccctgaccccagcacacctgtgtacccacttcctgaccccagcacacctgtgcacccactccctgaccccagcacacctgtgctcccactccctgaccccagcacgcctgtgctcctactccctgaccccagcacacctgtgctcctactccctgaccccagcacacctgtgtacccacttcctgacccccagcacacctgtgcaattctctgaccccagcacacctgtgcacccacttcctgaccccagcacactgtgcacccactccctgaccccagcacacctgtgcacccactccctgaccccagcacacctgtgcacccactccctgaccccagcacacctgtgctcccactccctgaccccagcacacctgtgtaattcccagacctcagcacacaggaccttgatttccctgtgcagtatgctgagtgtggatatagtgccagtggtgtcatctttatggcatgcatgcttcagcatgcccattaagataagatacctgacattgaactgtgaaaatgtcatggaagggtttcctggaagctgaccagcatgggttccggaggacatgctctctgtcctgaatcattcctatggaatgtgagagtaagtcatttcagagacattgcaaaagcaatgactgaaaccttgaacaaagactcttgagctggtaaactctctaactgatgcccatggtactgaaatgcttaggaaagcccacttctgtggtggtaccttggggtgaggttctgcattgtgactggctgataaggcttaggccaggtttctcctctgtcctgcatgccagtctgtcagacatccaggcttcatgtttactttttcttctagtttgttttattcacaaaaaagaattagtcacaggcgaaggaccatcgaaaggcttgggtcctcctcccaaacttcacagtcggtagcttggctcagcttcagcactgcaacagtgcgctttgcattggcacagccctgcctttattgtcctgggtgactgtgtttaaaatgggatagatttctgcagctgataatgcgtcgtcttcatcgatacgccaaggctattgatatgcctgctggaggagaagcactgcaggaaatcggaatagaaatggaaccgcattttcttcttgctggaacctgtgcttctgtctagctaggtagctagagacaacagaaattagaagtatagagccctttgtaggtcatgcgatccagtgtttagcacagtccctgtcggtctctgtgtgcaccaagctacatgttgcagtttcctcagatatgtgccatcctcgaagtgtagtgtactggatgtcttctgactttgaacgtaaaagcagtgtcataggaagggatctgctcagtactaaaatgccaattgctcatcaatacctgaagagtggcaatccccaaatcttcctacacacaaaacttaggtcctggagctggtgtctgccatgtggccgttgtcgcagtaccatccccgaatttgtggagccactgaatgaacaccagtgcttactagtcgtgtttcctgttgccatagcaaccacaaaccctcatttgcttgaaacagcacacatccatttaacagctttgatgcatgctgggcttggtgcatttattaagtaagtgtagcctctgcagctagaggccttctcatcttacctagcctcctcctcggccaggcctcccctggggtggccatgcctgtgtcaggcccgtccagcagcaggtctccctggccatgctctcttgagccaggcaaaagagcaaatagtcactaacctgctttcagtccctcaggttatggattccatcaagccacatccccagaggaaggagagacactgccattgccaccctactccagggtgtggcggctccttaacctgataagtgggtgtggtcgacactttcacgtacgctgctctcagtttaattccttttgagaaactaataaagcaaatggtggctagaattgcaggacttcattgataaatatactattgttttgaaacaatcatcttataggtaaaaatagaatgtgatcatttaaaatgttcaatggactgttcaatgctgttattcctgaagaaagtgaaggttctgaaaccactcacagcatgggtcaccctgcatttagctctggaacttccagccatatttcagacttttttttttcttatacaactctgtgtatgtcatgggcaccttcagttcaggaagtctgaatcccaggtctttgtctccagcccttgtcagaggacatggaactgctccattctccatagcaatgccatgaaggatccgtgtgattggtctttgtgtgtctcatacacatacctgtgtatttggatgatatcatgtatagactatgaatcagtctgtttacccacccacccacctacccacctatccacctacccacccacccacctatccacctacccacccacccacctacccacctatctacctacccacccacccacctacccatacccactcacccacctatctacctacctacctacctacctacctatccacctacctactcacccacctacccacctctccacctacctatcactctacctacccacccacctatccacctatccacccacccacctatccacctatccacccacccatccaccattatcttttaaatccttttctttttccttcccagaagctgtgtggtcaccctcctcctcctctcctgaacacactaagccagcagttttcaacctatgaccccctctgaggaaggtgtcaaatgacctttgcgtggaggtcacatatcaaataccctgcatgtcagacatttacattatgattcataacagtagcaaaattacagttatgagtaacaatggaataattttgtggttgggcgtcaccgcacatgagggactgtattaaagggtcaaggtgttgggaaggttgagagccactgcactagacactctcatttacactcatttagtgttagttcccaactgttgagtttttctccttcctcttcctcttttctccttccttcttcctcttcactctctattcttgatcactgagacctgagagcagagtttcaaagtgaaagtttaaccatgatatctccctgtatcagatccacgggaccagacccactggagcccacaaatcggtctgaactcattaaccacaactgtctacgacccagtactgaattctctctccactctccgttacaacaatagtgtttctggatccagatctaccttacacagcctcctactccctttttcttgagataacattaggtcaagctccatctagacagagagacagacagacccacctggccttctgctcacctcacaactctctgacttctaagtcattctcagactcctgagctggccatgcctgtagggaaagccttgcttgtccactgccacttgggatttgtgggctgtcacatctgacatcgaagcatctgttgtgcaatggagaggtgctgcccctctgctcctccccggctctcagcaggtaacagtcattcctggatccttcacacagtttccccccaccccaccccaccactccctgcagccccagcacacgtttttcactttagggaggaagcctcatatttgattgtgtcagagatcaacctgttgaagcagagactgagtggtattatgggctgacttgctaacttactaacttacttacttactttcttacttacttactgagatacgtgtatcatgaacacattgctttgaaagctgtaactttaattttgccttcttagcgtgcagaaaactccgtctcgtttattagccaagaaccatcatttgcataaagtctaatttacaaagtcagcggaaataagcgtttgtgtcaggtacaaatggatgtagctgttgaagccgcagggcttctctgtggactgatgaccctggtctccaccctgcctggaagcacagcggttggctggacattagcccagaccttgtttccaagtcttcctggtctcctcgtccttgttatcgagttgcagagacagtggggtgagggtggtggtggggaccgcatgtctaaagtgccaagctcttccgtctgctcttcacaacatctgtgttgatcctgtatcatgtcagttcagacgggagtctcctgtcaaatgtttcttttgaaaacttttattatttttttttgtgtgtatttatgtggttagtgaatatgtgtgtatatgtgcatgtgtatatgtgtatgcatatatatgcatatgtgtgtgtctttctgtctgtatgtgtgtctgtgtatgtgagtgtctatgtgtatgtatttctgtgtgtttatctctgtgtgtataatatatacatgtatatatacacatgtatgtatgtttatgtgtctgtatatgtatgtgtgtctgtgtgcatatgtgtctctctgtatttgtgtctgtgtgtatgtatgggtgtatatctgtgtgtatatgtctgtatctgtatgtgtataatgtttgtgtatgcatgcgtgtgtatatgtgtatgcatgtgtatgtgtgtaaatgtgtgtgtctttctgtctgtgtgtgtgtctgtgtatatgtgcgtgtatgtctatgtgtgtatatatgtgtgtgcatgtatatctctgtgtgtatgcttgtgtatatgtgtgtatgtgtgtgtatatgtgtttatatgtgtatgtgtgtgtatatatgtatgtgtatgtatatctctgtgcgtatgcctgtgtatatctgtgtatacatgtgtgtgcatatgtgtttatatgcgtgtgtgtgtgtacctgtggaggccagaagagcctttggatcacctggagctgcaggctgctgtgagctgggtgctgggtgctgggtgctaggaatccagtcaaggccctctgccagagcatcaagagcctttgcccaccgttacattgttccagctccctgtcaaatgtctctgaaacagactcttaaagcattaaatcacaaaagcccttaaggatcaactgacccagggtctcgtggcctgggctcagagagcagggataaagagttcttgattaatccctctctcctcccctttcctccccttcttctgtgtggcatgcttttagggatgggacccaggactgtgcagggctgggcagtgctctaccgtacctagcccttaatggtaaagggcttctgtgggcctagtgggcgtgtgatagctgaggttaagcactgagcttagtaggctcctctctgtaggcattcatggagctccaggtcagaagggagagatgagccaagggctgctcagatatctgaattatctttatgtggactgcatattaacatcagttagaaaagtctacttgcaatagcatgtcggcggaaagagtacgttgttcaagaatgaaagacccacaacgtgaggactcccccacgttctgactcaggagaggcgacaccccaaaatcaccaacgagaaaacggtcttgttgcaaattgcaagaggatttttattcaagagcgctctcgggcccacggtcatacaccacacaggggtagaggactgtggcgcgccgagtagctggataagggggtatttaaaggaagaaaccacaactcaaggaagtggggagggctttgttggaagataccaaagataccagttaagagtcacaaggaagtgtaaagttacaagagtcacaaggaatacctggtaattgttaactttcaagacagcttctaagagcccctaacaatagcacatttgcattgcaggttctggtaatggccagggtgactttctttgaatgagcactctttgaacccaggaagcgggtggggagaggaatgtcgctatctcttttatgattagcatacctttacaaaggccacattcccaagcctgggcctaaaggcctagaattctgtttttacgttgttatactttcaagaccactgaaatagttgggcatgatggccacgcctataatgttagtactctggaggctgaggcaagggaatttgacagtagcctgggctacatagaaaattccaggctagcctgagctgcatagcaagacctgttacaaagagaaaaacaatcttatgaaaatacctttctactacctgaagaataacaaccataccgtgggatgtggcttgtgagactgtaggagctgagcttgtcagtgagccagggcagatgactgccaggcaccgtcctcactgcaactcctcacagcactgggcccctccgttgatcgagctagtggtctgcatcctactagaatgccatcctgtcatgacagcttttgtgtccttaggcctatactgtgtccctcgcaattactacatagctttgcacacagtaggggctcaagaactatgacttgacagaggtgattgtcactgggaaaaatgaacagtctgaataagcctaggccggtaaggcaggtgcagtcaccccctctcctccgtggccatgaggggctcagaggatccagcaggatgggaggcccctgcaaagtcctctgtgagaaagcagagaagagtcatcgtgatcgtgcacagtaaacatggttgtgcacatttcctgagcaaggaggaaatagattagaaaacaaggttcctgaaataggagcaggctatggtggaggaggaagagaaggaggcttcaccctcttggaattgcagctagggtgacttgagcaggcaaggcagccctgtgttgtggcctgatggtggcccttgtcttgaacctaggaaccctaggcagggctccgagtcccggtgaacaagtcaggccggggcagagtcctttctgggcactgtctttcaggcttgagggcgtttctattatgttatttggttttcgggtttggggaagcttttccttttatttactaagtccatcagggtaaaaatgcattcttcctttgtcttttagaaataatagaaaggccaggttgaagataccgaactatcacgataattctagttctcttcacaaagaaatggatttttttttctctcccagatttcaggtttctttctgtcataaacttatcaggaagaatgaaagaaagacatttgccccagctcctctctgtgtagggaagacacactcctgttccattagcgaagaagctgcacagtaactccctaaagaatgactactaagtgtgtcccctgagacacagcctggtctccaggacagaaccacggaggctggcttcctctgcttctgtgtttgctttgttaaagcctcatgtttggtccccagacaaagcacaggctctctgagttcctggagaatgtacgtctcccacccctgctcctgccttttctctgaagtggccgcacagagaacctgcctccaccgaaacggcagaattgtgaagacattttccctgataaatgcgtagacagtggatctgaaacgagtggcaggagcctcgggagtgaaaggtccgggcttcgaacaactttctgtctctgcccccagcgtctccttctgccctttcctctctttgcagttttccctgagagaaatcatgtgaccatgccgccacagttctgagtgccaaatagctaagtgtcttcaaaatgcagcgtaacacttttaaaggcaaatagtgaggctgtttcattgggcattcccacgactgctcttctcagtgggttctagacatcacacataaatgtgactggctgctccttctttccccacaaaagtcatatgaaaccctttgagtggccttccatgtttgatgctctgtccatcgaacacacagcacattgttttttgtttttgtttttgttttttgttttttccgagacagggtttctctgtgtagccctggctgtcctggaactcactttgtagaccaggctggcctcgaactcagaaatccgcctgcctctgcctcccaagtgctgggatttttattttcttagaaatgtgataggatttgctttgaggatatctgtaacagtctatgctagctttttttttttttaaatagtgtttatattttatagacacagtcgtttcttgtagttttgtgccatacctaggtattttctgaactgacatcaattaccatattgtcagtattccaagtccaagatgaaaattacaaaatgttaatttgacatcattattgcagctgctgtcaaattgtccctttatggtttagtaacactgttttcccctttgcacacacagtttgctcttgcatcttcaaagttgtaagtgcatcccaccgattggttgaccgacttcttgagcgggtgagctcctgttggaagccttgctttatggcgctgtcccagtgagaagccgcttttctggcattcgccagcttcgggtcacatgcaactacttctcttcctgccgtctctgctgggagtttgtgaagttgtttattctgttacagcttgtttgactttcacataggccttatagtctaatacaattgagaaaaagagaaaatttatgaccttgtccctgctccagcctgtgcattcttatcctctggatggttctttggtttccgctggtagtgaggaagggcacaggactaactcccgaccattgaggtcccttgtccttgtttcaggagctccttggctcgacccgagcaccttcagcctttgttcacatcttccttccttccttccttccttccttccttccttccttccttccttccttccttccttccttttcttccttttggtttttgagataggtcttctctgtgtagccctggctgtcctggaactcactctgtagaccaggctggcctcggaactcaaaaatctgcctgcctctgcctcccaagtgctaggattaaaggcgtgcaccaccactgcctgggcctgttccagcacagctgcctgcagggccaagatgctgataagcaatgtctattacttagggcatacgctgacccatcaggcatactatatacataatattggtttctaacaggatgaacagagagttcagaggacaagggtctgttctttggggacaactttggagactttctactgaatagttttccatggacatggcaaaataaataaatgaatgaataaataaataagattcttccacagacagtgtgtaaaagctgactctacccccctcccctccccaagattagttgtggagcgaggcaaggttggtaccctgcacagagtctttcttttgccttcattctctgtgtgaaccctcctctccagcacacattgttcaggtaccacctcgggaaagcttgcgcctcctcacctgcgagtctccctttaccaacaaagtgagcctcatctcttgaaaatatgacctacatttagcacggacacttctggttagccagtcttcctctattaaaactctctttagtcacgttgaacatattcataagcgcctctaatttgctcatatatcagacagaaaagatgaggttacagctgcagtaataactctgaaggcgagggcatgtttaatatctgcgctggctgttgtttgcggctcatctgagctctgttcattgttctcatggagacccagcctggaactcactgccatcttgaacatcgccagcagctgctgtacaaagggaaagggtggcaggtagagctccggccctgacggccactggctgcgaaaacctcacctccatcacactgggcagtggtaagcggctcattctccacgccttgtctttttgactcgctcgctcgtgagcaacgccccggaacttgcatgaatcacgtgtgcttcacctggatcgccacctttcaggggaggggtgggagaagagcccctcccgagagctccagtcaggaaacttaagtgttaaaccaatcaagagcgtattgtctgtgtcttggtgtgggcgcccatgtgctttacgaattaaacactcagactcatgatggggacaagggaggcgaattgattaaaatacatcacaaacatgcacaaaacagtcaaacactaattttaaaaagagaaaaatatttcagaccgcgcagctgtttgtcccaggcattggaagcagtgttggcacacgagagcgagcaagcgagctagcaagcgaggaggcttcttgctttctcctcagggaggctctcctcagccttcctcacgtccccaccccagctcactgtggctccctatcaggccatggccccactggtggctctatgccatgctctggttttgagtgccttccatgttggtttctaggccctgggggtgggatgacaatgctgttgttttcgaccaagtggaatgagggcccatccatctctcttcagcgtcaacaccaggtctttgcctttctatggtgtagaccccttcttcaatcacttttgatccatttccatttcatcagcccctaaggatgcctggctaccacctttgcacagcactgtgggccctgtttgcagaggatttcttccttggccttttctgtacctgttgcttgttttttgagacacaacagtagggttttctcactgggttgccaatgccgatctctaactggtgggttccgtcctgctgtcttcccaccccagccttgcagtgactgattgcaggttcaccccatgcctggctcacttcctagctacctcctccctgccaaggctctctcgaatgcttgcttacaaaaaacttgagttcttcacattatttccccactgcatcctttctttgtatgatccaacttattttcaggatcaaaaaaagtgtttaccccaaccacagtcactttcctttcttattatatccagtggcctgttggacacagtgcgtagctgctcctgagtaagctatgcagacccggacacattgcttttagcccagaactgatttgtctttgttgattataggtatcacctaataccagtacggacccagtcactcaggcaggaaacagggtctctctttccaatgcctcctctcctgcccttttacctcagtattgtcctcttgctcgtccaccttatggagttatttcctcatcacgcatgcctttgagcgttcagtaatggactcgtatgtgttggtcatggtgtgccaggtggtgtgagtgcagttgtgagtaagactaaagaggcccagtctccatggggcttttgtttgtacatcaaaggcagctagcacttaaatgtgagaagtcggtgcactccaagccattgcatcacagtgacatcgccacttattggtgctcctagtaaattgcaggcttagtttttgtgaaatgtgaacaaatcctaaaacatcctattattgaagtcgaggaccaggaagtggcatactgtgactacttccgctatttcaaatgctgctcctcttgactggccacacttggagatgaatttgtggtttttataaaaccatagctcagttgcaccatgaacaacttcccttggaggagagaggtatgcatggatctggacttgccaagtgagccgactgactatatcacacctgtcccagtaggtaggctctgcccaagaaggttggatcttttgtgtcctctgaacagaaatgcaagtctttgtcttgatgtccacatctttaaaagatctcatcagtgctaatggtggtacgggggaggaggatcagtccatgggaactgctcctctggttttcagccgcctcactttggtgtgtgtttctggggagacaacatggcaccaccggcagttatgggtttcattgcaacagttacagcataactatcagtctgtcccttgtagaaatgcccagaactatagcgttttcccttcccctggccctgcagccattctgaacccagaatattccaggggtggctggccacagtggtgattgcaggcggacctcgtcttgctgctgtcctggttttcccaaagctcacattcaccagcagccgtagctcctcccggacacggctgagtgctgttgcaaacctgttggagctgctctatcaaatgagttggagcagaagctagaaatgaattgactgtgtgctgtcctggggctgccctggggacactgctctagagtgtgtctccatgttgccattttatgtgcccaggttatgatgccaaatgattatgcggctattttgagtcatgtgcccctgcatacaatacaacttaattttctcatctaaatagagactgtcttatggatatctggtgttccaaaactctacagcgaatatctatagcctattgtatattttactcttagtcaaatggaatgtggaaaagaagccagttgattttgattcaagatttgttctaatgttcatcttacaacattctaatgtcttgaacatgccgggcagggccacagctcattagagagagtgcttgcctagcctacagttagttccatacaaaccagatgtgatgacacacagctgtaatcctcgcactcaggagccagatgcaggtggctcagaagtttaaggtcaccctagaccttagagaagcgtctgaactgcctctctgtggggcagtttctcgtgtttccatatcatcacatcgacactctatgcaccagaccgtgaattgtgcttcatatacttgaaatcacttttgccagatcataagttagttgctgtgaattgctatgaatttatttattagctcgtatatatattttttaattttcatttctccctacactgtcaggggaggatatgtagctcagggctctcattcttaaactataccatcttctaaacctagaggtggcacacagtttacgtgaagggacacagggcaagcacttgagggtttttaggccctgtgtttataacttacccactctgcctctgtatcaggtagatgatgcattgatggggtggctgtgcagtgggtgatccgtggatggggtggctgtgtggtgggtgatccgtggatggggtggctgtgtggtgggtgatctgtggatggggtggctgtgcggtaggtgatgtgtggatggggtggctgtgtagtgggtgatgtgtgggtggggtggctgtgtagtgggtgatgtgtgggtggggtggctgtgcggtgggtgatgtgtgtgtggggtggctgtgcggtgggtgatgtgtgggtggggtggctgtgcggtgggtgatgtgtgggtggggtggctgtgcagtgggtgattcgtggatgggtggctgtgtggtgggtgatctgtggatggggtggctactgcattagtttccttcagctttcttatattttgtgagttaggtttctagacaaactcaaaattgaataataggctcatggcctattttttattagttggagggacaaatatctaattaaaatctgtcatagccacgctgcctaagtgcaggatcatcctaagcagccttgtgatgtacccagtcctgtttcttatcagttgaggaccactcagctgggaactcagagagcggaataacttagacctgagcccacatcacttgtatctaagcaacagtctgcagcatccctaagctacaacattcacctctgtgctggtagttttttgtcaacttgacttccaacaagtctgtggggcaatttctggacagataattgatgtggaagggcctagtccactgtgagcagtgccatccttgggtagggggtcctgggtcaaagaaaagaaaccgagccaatcaggaggaacaagccagtaagtaacacgcctctgtggcctctgtttgagttcctgcctccaggttcttgcctttgcttccctcaatggattctgactcaggtaatgtaagccaagtctttcctccccaaactgctttcggtcatggtctttctcacaaaaataggaagtaatttaagacaacctccaactcggttggcataagtaaccctccagtggttcagatgacagagtagcacttgtagtggcaagtgtctctgcagtcgtggcacatacgtttaatcctagcacttgagaggcatgggcaggcagacctacgtgagttcaaggttaggctggtctgcagagaaagttccaggacagtcagaactaaagaaaccccgccttaactacccctcccccattatgtattagaatgtgtaaatggctccagcctagggtctgaagtatctgtggtagaaagcatgtgcttttaatagttaagtttgtctgtttcagttaagggctaacttctgattgattcttcacatgacagagtgtttaaacttgaatttgagttaaaacctttcactttgttaatgatattaacattgatataccttcacacaaacatgtgcacacatatgtgaatacacacacatgtgaatgcacacgcatgtgaatgcacacacatgtgcgtacaccacacagacatacagaatgaaaatacaaagagaataaggaaactaaatttacaatcttgagagaaaggcagcattttgaatcatgaaaagaagaagattaagaacaacaaaatggtctttttatgaatgtcttcattcagagcgttacacagagcaccctcacactgaagttagcttgtgaggcctctgggccatgactgtctggtggaattctagagacggcagagtggtgtgaactgcagaccacagtttacagtctccacagagagtatttctagagaacgtctacaactgtctcccgggacaaggctttgcaactctcagggccatcaggcaaccttctcttttatgtccagagtgaattccttagattcgtgctaattaaaaatgtgtctaagtatctgagagtctttgattcagtgacaagagaagtgtaaccctctctgagaaattgtgctctagtctcaaaaaggtggagtgactgtagggtctccaggcccgacctctgaggtaatgtctcagaattgagtcttcagtacaatagataaaatgtctttattcaggccgtcaagctgaggcacatccatgctcttgctctgctgggtggctatttgctgtctagggctgcccacttctgtgagtgctcaggcagctagctgtaagggcgtgcagcctgccccaagggaaaaggacagttggtgcagcctgttctggcaccatcctggtagaggctctgccctcctgtccctgccctcaagaaattcatcagctccccagagactgtaaggcattatctcactcagccctctggctccaagtaggaattcacttaagttatctctgcagaggagaatgtcttcatgttcaacctgcatgattaaaaattagttttaaattaaaaaaaaaaaaaaaagaaacattacccatgggggatttagcaatacctgttcctaaggtggacagggctggagggtcacttggtgcttcgagaaataactgtgatgatacggataattggagcttacatggagtgagtgttctccgtgccagatatggaaacaagggctttatcttttcacttacttaatccccagagctgcctggcggggtagatcctgttctcgccctcggtttgcaaatgaggggaagcagggtcaaatcctccatggaacacagatttgaaccctgggctgccattgtcctgatctctatgtatctctgccttcttccctgtcttgctatcctgcttctctttgggggataagttattaggatacataaagaattatagacaaatctggaggcttatggaattaaaataatcccctagtcttgcctatcatgaattaccatgtgcagtctccctaattggaagcaatcacaccataaagctagagcaaaagcaaccagtggcgtggctgtgccccacccccttcgccagtgccccacgcatctttacatttagcccgtccttcccacgatgagaagcaggaggagtggaagcagtaggaaacagacctgtaagcacactctggtttgaattaagtgtggtcctctgcgcaccgcctcgagaacagatcctgcagcctgagaaggtgggggggttgtttccctccccatgtgcgtgtcagcagaaggcccacagtgtggcttcaatgttttatttatggaggacggagctgtaaccaacactggggtcatgttccagaccctttcttccctttttactaactcctgaaacaaagtgacctgcttatgtcactggcggagatggcagcagatacggctcgtgttttgactgctgagtctggcatccctgagccttgcaagcatctcattttaaattttaatgtctcccttaatttaggagcacctctggaactaactcatttttccatgtcgaaccagagcctgagaaagttgtggagattaaagtgacttcagcccccagcctggcccctgatctcagggctggctgctgcagtaagagctgtcagggagatagatgggggcgctaaggtttcctgcaggtttcagccgtgtgtgggtaccacatgtgttgtgttgagcgaatacaaatacaagaacacatgctgttcccattagggacacttcagacccttctgtccccagcttcactgcaggattgaaggggtcatttatcacaggccatttactgatcctgactgggctttaggcccttgtacatataagcagtgaacagtgtgtccaggcccttccagagggccgtcacacgatgatgctgctgtttcccagcgatccacaagttcatttgcagtgaagcagccactgactagttacttctgcaggactctgcagacctgagcgtgtgtctactctgctgaggctctcaggtgacaagtggcagtgtaacacacccattgtggggggtgcctcacccattgctgatgcctgtagacggctaacccctctgtcgtcctacatacatggagttgttgtccttctgcgacctgttcatttcctctgttgacagggtctcgccctcccatctttgtccagataaaacattcgttttataaggccttcatcacccagtcctttccatttctcctcgaacagtctcaggaagctttcaccacaccaccctccatccatgtgtatggcctgagggcagcactttgttgccctctgtcctgctgtcctgcaagcttggggcctcaggaatgagcagccagccttggtgcctcctgacctgagcaggagctcctggacagctccccccgaagaacccctcaggccagccccagatgccttacatcagcatcctggtgccagagtcccacactgccttgctttgagaaagctcacacaaggagggctggccaacagatagactgcctcatctgtcccctttcaggaactgtcaccagagataccccttgctgaatgttgaccctggaagcctagcagatacccaggggcccgactcttcatgctgtaagagcgctggcctcttggctctctatgcatcctgcttagctggaagtgttcatgctcagcctagtgctgctggtgttgaccaccgcctcccacaccacactgttgcatccaagggctgtcatttccttcctggccaggcactgggctgagcagtctgcttcctttcaaagaagcatttccactgaagtcgggcgcagtgtagcccaccatcctgtctgatttttctcatctgtgataattggtctttctgcttcttgccattttatcatgaggccagtaacacagtgagaaaagcaggagctctgaggtcagtggaatgaagactgaaccgcagcgattaccagattgccgttttgcctgttgttgggctctgccgatcctgttttccttctctgagtgtagggagagtttctgtgtctcagtgccgaggggatttggcggataacttagggtggaaggtgccaagcacctcagtcatttccgagtgctgcatgtgctcgtcgtgggcacaaacacaggaaacaagtagccctgtgaggcattccatgggaggtcacatgacgagccttgcaggagcctacaaaggcctcccgggcacagcaccccagcacgcttgctgactgtcacaatccatttcagacctgtgactagagaacctgccttctataactcacccggtctttcatttggcagaggcgagtataggtagtgtaaggaaggcgtagtgtatgcccttggagatgaagatttcctgccactaaagctagcaaactgtactaggaacggaattcagtatttacttccagcttcatggaagagatgaatttaaacccatcttccaggtatgggacgttggacagagcttaagagtacaagttgcccttgcagatgaccagagttcagtcctcatcataggggatctggtggcctcttctgacaagctgggacccaagttccatccccaggacctacatacaaaagccaggattgggactggaggaatgactcagtagcaaagagtagttagctaagagggcctgagttcagttcccagcacatatctcaggcagctggcaacaaccacctgtaactccagctttctgggatctgatgctcttttctgacctctgtgggtacctgcactcacacacacacacacacacacacacacacacacacacacacgtctctttaaaagctaggcactgtgccagcacttacattcccagtggtggggtgatagaaatgggggaatctgaggctcctgatagcctgcttagcctaattggagagttccaggccactggctcctggggattgatggctgagatggtcttgtgacctccatatacattcacatgaggggcataagcacccacccatacacatgggaatctgcacacacctacacacaccaaacctaagaataggtatgtaattattaataagagctatatcatctttgaactggttctggttttatgttaaatatagtctgattttttttttcctgtcctctgtgtggttttggttttggttttggttgtatgggtcgatttgtttgtttgcttgtttctctgttttgtgcactccacactgcccatgtggccaaggatgaccttggactccttatccctctgcctctgcttcccgaaccctgagattatagacagctataagattttttaagcccatcagaacctgttaacataattactcggctttatggctcttccaatgaaaatttgtttctaaacattatccaggccctaaagggaagctcctatgaatgcaagcacagttttcaaggaacaactttgcacactgtgaaaacgaagcctgcaccggcgtcctctctgcgttctgtttagagcgctctaagggcgtctgaatgataactgtgttctctcttaatacatgatgttaccgctgagcttattttgcttgtaggcacggcacaggccccatcaagactaggcccctacgtagacctccttctaggtgcgtgtggttggccgctagatccctttcacttcactgagctgtgaaattgacacgaaattgtgccgttagcttgtttctgaggagtatgttgcacttggatattctcttcttgcttgcacggtacatgaaaaaagatgacaagattaaaatgtcccataaatgaacatgagcaagaaaatttagatgtaatttgtaatgaattaaaaacattgaataatgtataggaagagcaagcagagatgtgactgttccgagcaggcagctggtgcccgaggagggagcttcctctttcttggctgacgcctttcccagtttcatttgccttctctgtggcctgtggcaaggggacagtctcagggtcagatgaagtcctccaggagcacggcagagtgtctgtgtgtgtgctgtttgcttaggcatctcctctctgcagttaaataacacaccaacacaccgccagccctcctgagaggaaaccaagcatcgctccaccctgcctgcttgtttgagaggaggtgatcaagcctctcaggcccccttgcaagcctcttctccttccctgctgaagccttcgagcttctggctgtgattcttgtcatatttttgtttctcattttgccatctgacctgagaatctatctgacaataattgacatcttaccccctgtaaagtaagtatatataattgtcaaccgtcttttattcagtgctaaaacatgaattccccaggacagagccttctcttcttcttgtatagtctgcttctctagtgatggccacacaatagatgttaaataaacatttcttgaatgagcagctaagagacagcatgggcctacgtgctccctctccctctccccctctccccctctccccctctctccccctctctccccctctccccttctccccctctccccctctctctccctctcaccccctttccccctctccctctccctctctctccctgcatctcttctgcacccaggtcctcctcctcaacactgccgtcctctctgtgtcttggccacaccctccatatggccgtgagttcacatccctccaaatccagcctggaggtgcctatgtgtggatggagctgggcctttgctgtctgcctctctggagtgcgtcacttggtagatcggagcatcaaagctgaagaagaagagccctgcccaagaggggaagggcttgctatgttttctatagttaaagatctgtcttaatttccaacctatcgctaaccaacatttttataaaacagaaataaagggaaaaattgaagactcaaatatataagccctctctattagattagatacaaaattactttccagttacattttgaggttgctactcttgaatttctgatatagttatatatttgttacatgaaacacttgccactctgtaacaggtgaagagtctctgttgtttggggagtggtgtaccaggtgacatcagctctgtcctgttactagtactcctcgcctgtcaccatgttactggtcactgaggttaagtaaaatggaaattggtctcgtttaattggcaccagaaattggctaaaggggaaatcatctggagtgggaatcagcaaacacacagcacacctgttcctgtgcacacatgttcctgtgcacatacgttcctatgcacacatgttcctatgcactatctcaggcagaacaagtgtgaacagctggtggtgtgactgcacggtgccaggtcactgccttcagttgaccacagcccataggatttgcatactcgtcctcaagctaactgaaccagctcacatttcattttcctcaaagagattaagtacatgtttttagaaaaagaaaaatctaagggctgggtttttaaagatttttgtgagaattttccccactattttatactcatctcacatgtatcaaattcattttgatcttgtctttctaaagctccccattcagccataccccaccccccatgttcaaccattacctccccccatgttcagccattactcccccattttcagccattccactgccccccccattcagccattaccctagcacccccaagttcagctattaccccacccatccctaatgttcagtcattaccctgccctgccccccatgttcagccattactctcccattcagccattattccccccattcagccattacccccactcagccattaccccccatgttcagccattatacccccatgttcagccattatacccccacgtttagccattacctcccccaatgttcagtcattcccctgtgcccctgtattcggccattaccctagcaccccccatgttcagctattatcccacccatcccccattttcagtcattacccccatgttcagccgttatcccccatgttcagccattaccccggactcagccattacccccacttagccattacctccactcagccattactccccatgttcagccatgatacccccatgttcagccattacctccccccatttcagtcattcccctttcctccccatattcagccattatcttagcacccccatgctcagctattacctcactcatcccccatgttcagttattatcctgccccgcccgcccccattttcagccattccttccccatgttcagccattacccccaagttcagccattaccccctgttttgtcacatattcactttccatatattttttactttgcttttgagagtaaaaacttaacccctaagaacttcagtttgtttttactaactaggaatagtcttttatataaccatagtacagtataattttcaaattcagaatttttaaagtacattatactagggagcccattcagggcctaatggttcattcagagactcataactgctcactacaaataaggagtctcttacataaccgtagtacaattatcaaattcatgatttttaaatgcattactggggaacaaattcagggcctaatggttcattcagagactcataactgtccagcgtgcagagggtaagtggccatgagtgtggcgtaaggctatactggcgtctccccaccaaagctcagggaatatcctgcaatagggagtaggaaagagtgttagagtcaggggatggggaggagtgctgtgggctctgactcggcatcacatgatcagcacgtgatcagcagatgatcggcacatgatcctcatgagatcgtcacatgatcatcccatgattgtaacatggtcctcacaggattctcacataatcctcatgtggttgtcacatgtttatcacatgctcctcacacaattgtcacatgatcatcacatgatcatcgtatggttactgcacacatgtaaccactgcagctgtggtcacgtgcacaagccagccggggactggggaggagctctcaaggccacactcctgcctgaggagcaattcaattggcagttgacagctgctgggagatgagagcccattttccttagagatgttgtcactagcatgttgcctgtgccccagtgggtggcctgccacatatgggcagcatcaattaggctcagcagattatgaatttttttctagaggaacatgaagtttggagggagatgtggtaggggaattgaaagggcctctggagtagtggtgaatataataaaagaatattgtatacatatgtgaaaatttcaaataataaatgtttttaaagcaagaagtaaaatatggaaaaatatcatggtttcccagatgtctgtaaatattacactagtgatgtgtggtgacatccgcaatgaccaaaaaagtgttgttgctgttgctgttgctgttgctgctgctgctgctgctgttgttgtcgctgttgttgttgttgctgctgttgttgttgctgctgttcttgttgttgttgctgctgctgttgttattgtatactgggcaggtactctgcacttcagtcaagttcaggaaagttacactgaatcagctgtgctttgtgtagtcacaactgtcactcacattcatcaaatgccccagtaacatatttgcagcacaagatacatttccagattgtatttgcatttagctttcatgtctcctctccattctgtgaattaaacagttctttagccttccttgatgaccccgcatgctttcatagagcctgcttctggttgggttcacttgtctgagtttcttcggggttacatttcaggaataccatggcagaagtggtgttggatcttggtgcatgtcatcagaatgggagttttgttgtcacagaggagaacctggtacatggttcaggtccagtctgcttacttgacagagtagacactaacataacacgtcgggaaggccatgctggggcttgcatgtgatgtgtccccacaggctgctgtgtttgaatacttggtctcaaactgatggcaatgttgagagaggtggtagaagcattggaaagtgaggcagagctggctgaagaaggtgatcaggcctgggcctcagttttagtcctggctttctgttcctaggctctgacttgtgagaaacctttgtgtaacttgtagggagatgctttgagagcagatgtgagcgtctccttattaatcagtgtgcatttgttagttggtatttactaaaactaaactctcccccccccaaccgtgtagtcctgtttgttacgtcaaggatccttactttattctctgatgttgcttttggaatgggaggccttccggtggctcctgtgtccctgtgaacaagtctccactgttcttcaaatatttctttattccctgatgcaaaaagatgttccaggtccatgggctggttcccctgtctaggctctggaagctaatccagagtcaaatctctgggtatatatgtatgtatgatacagacatgcatagctgcagatgaagagatgcctgttactatgtatgcacttccagatatactatatgctatgtatacacttccagatatactatatgctatgtatacacttcagatatactatatactatgtatacacttcagatatactatatactatgtatacacttcagatatactatatactatgtatacacttcagatatactatatactatgtatacacttcagatatactatatactatgtatacacttctagatatacacacctaatctgtatttataggttgttccttccctttttgagacacggcctcaccatgtagccctggctagcctataaccctttctgtatttaattacacttaaaactaggcatgaaaaactaagtccctacaggtgcctctgttagagttccctcccagctccgtcctctgctcccactgtgagaaatctgctgtttcatcatctcaatgcactttcttggtcctgtaatatacacaaagtagcttgagaagtactaatttagaagactataaaaacaaactccccagctggagttcagcattgtttagggttgtttgtgtgtttgtctgagaacaagtcatcaaaaatcccaggttccagggcttcgtggcccagctcccactcgacagaatgattgtgctgctcattcaaagcacaggcagactcattttcctgtcttctagcaatcagaggtccaggatacagccaagcagcccacggtgctgtggctcacaccgtgaccaacagttgtgcacccttgaatgtcagtggcacctgggaagagcaggaacctagggaagggaaacttcttcctcagggttacaggttagagaggccctgtcgggttcccgggctctgggggctcaagctgatcagtttcattggcgaacctcatgtttgcaaacatgtcttagcttttattccctgctcctcagacattgcagcaacagcctactggagtttctgaaggagaaacttgctgggagcagccctgtctcctttccagggcgttctggcctcctgcttgtccatgtcagggcttctgcagtcagataatcttggcatcttagttacttttcctgtgaagagatactgtgactaaggcaacttagttggagctggcttacagtttcagagggttagtccatgaccatcatgtgggaggtatggccgcctgcaggcagacctggtgccagaacagcagctgagtgcttattcctgatccacaagcaagagacaggggcgaggatgtggagaaggatgggccagaaaggggaggaggaggggggagaggaggaagagaaagagagagacagagacagagacggggagagcacactaactggaatggagaataggctttggaaaactcaaagcccaccctggtgaccatgcctcctcctacaaggtcataacctcctgatccttcccaaaccattctgccctggaactgagcctatgggagccaatctgaaagcatcatggttgctttggttttaccttaatcctggccattgtggtgttgagcagtatctgtaccaggtgagacatacttaagtcattttcttccagtttctgtctgtgttggttacttttctcattcctgcaagctcggaggatagatttattctcaccacagtgtaacagagtatcagtccatcacaacaaagcaagcatgatggcaggagcatgtccgggcacacagcaagagcttcctagctgcatggcttctcacagggcacaactagaagcagagatctgggactagaagtgggaccaagctataaccctcaatattcagctatagtcacctgtgtcaccagctgtaccatgtctcaaagcttccacagcctcccagacagcaccaccagccgcagaccaagtgtttaaactcgcgagcatgaaggggtgcttcacattctgacccgaacaccaccttttcctaggcgttaggttagtgtcatctctgatttcatggccaggagtgatcaactattgatattttatccagcttttttttttttaatatggtggtgtgatctcttcagttttatataaatttctggcttaaaaattcactactaacatcttaagttcccgatagccactcagctctcagcttctggtgtctgtactggacatatagctcagccatcacccatgtgctactgtacagccctgtgcctagcagaaagcaaacttgggagagcaaagggagaggaaagcagacgcctgttccagtcaggacagaatgagcacacactggtttctccactgcagacggctgctgtagtggccaatctctgtgaagaaatggtttttagatgatgggcaggtaggaatgtgggggtggggggagggtaccggctccatctgcaggctctctgccccacagggttggcagagctttactgaactgaaaaaccataggtcgcacctgagggaatttgaagtatccagaatttgtgggtcagggatgggtaagggcagcagcagcaattccctttggtaatgtatgtgtggtccctttaggctctcaggaatgttaaatgagagtctcatggacccaggcagagaagcatggccgtggagaaggatgggtcctggcagatgagcaggcactggagctaccaggggccacgccaagaggtccaggatggcctggagactctggggggttgtgctttaggagtgatgctaattttctctgcagaaggcgatgtaggaccaattctaacaaacttaaaacttggcttgaaatcaacacccttgtctgcacaaaaattcagatggtagaatccatatacaaacccttcagaatatctgttataaatacagccgaggatttaaaccaaaacttaatacaaagaagaaagaaatgggaggcataagaagaaaccaaattaacttctagactagaaaagcatatagttcgagaagtggaaatgtatcagctgggcacagtaacagattagacacagaaaaatcagggacccacgagatgcaaacgagaggcagggtggagaggccaaggaggacgagagatgtgggaggagtctgttgggcttggccatgtgtcctaacagacacgcagacatttgaagcaataataattaaaggatttcctaggtatgataaaatacaaacccaggatgcccgtgaactctgcctgttactttgtgactgtttctttgtgcctcttgaagcaaagaattcaggcaagggacacaaattaagcaggcacttattaagcaaaataagacacactccagagaaagatgggagtaggttggcctgaaaagtgagtggtagcctgcaggactaggtatggtggatttgaagacgtgaaaagtgagtggtagcctgcaggactaggtatggtggatttgaagacgtttctatggcttccccatctcaggatgccactgttgagctcctgcaacgggtcccacttttgtgtcatccaacaccattgtgctcgccctgtggttgagaggcccctgtgttttccccttccctgcctattaggacattggtcggtgggcatatgtggtctttgggacaatgccctggtgcttaatttctggtatggtaggaggaacctaactgcagcttcaaagatgctgagccacaaaggcattgcattaggagacaaagttatcaaggtataactatagtgtgtccctggttgtctcctggctgactccctgcctacacacccagacatgataaatagagtaactataccaagtaatcaaactgacgaggacacacaataaagagaatttttgatgagcagcctgagaggaacaaagatgagaaaaacagccgactcttcagaaactgcgcaagccagaggcagtggatggcacctttgaagtgttagaaaaaactgtcaacctcacattcaatagctagcaaaagtatctggcaaactcaatatctagcaaaaacgcataaaatatacttttaagacgatgaaataatgacattgtcaaacaaaggttagaaattgtttctttcagaattgcattcaagaagtgttaaaggaattttctcaggggggaggagaggaatagagagaggttcctgtccacgcaaagggatgggggttactcaggatgtatatatatggataagtactcatggcgttgtcccctcttccatttatgtacaagacattcaactgtgtaaagcagaaatacacagtattgggaagcgtatggttgacaagaatgtattacagtaaggacgtaaaggagaggggtgaatggaagatggggtcgtgaggttctaatggtgcacagcagtcagcgaggaacttaggtcacggtagtaaaagagccatggtgggcatctccatgtatctctcccacagacacggaacgtggtttgcatggtggccgtggccatggccacgcattgaggatgcagagtcagtgctgtgcttgtggtgcgtaggaggtgcttagatgccgcagtaggactgaattctgaaggccctgactgagaccgtgtgggaggagcagctaaaagccagcagaagagactcaggaagtaggtgaggtgcggagtgttgtggggagccatttctaggttcccactaaggaaagactgagcaagtaagcgcatggcccgtagcttcatcagaactctgtgggtgttcatcaccttgccggggctccgtccatcccttcctggatgaagaaccttccgagtgttcagaggcctcgagcagtcagcatctttcaggatgattctagaagctttctgatttcccatcctgaccgggcgctgacaatttaaaaagctaagtgcgatctttcagatttgcctgtgtacttaagaatcggccaccacagcccccaatccttagagctttcattaatatgaactgaacatctggatgtgaccagccccttggtcacccaaagctctgccatccattctctaggaaacaaactgtaccccctctcctggcatcatttgcagatttctgtctgtgttatgctgctcctgaagccccattctaaaaccagtgggcatgccagagatgcaggcagatctggcctgagtgccaaggagggctaagcccaacatgcaggcaggtccactatgagtgtcagacgggagggatctaccaggaatcagaccttatgtgtatgtgggaggagccacggatcttaacctgcaccccaccccccaaggtgcataccctggagctatcctaagaggcaactatacatacaggcatgggactcagtggagagtttgtgggcggcctgtggagaggatgttgcctccctctaactaactgttgggcatctggtgttgaccggaggcaccagatctggtgttggtcagcaggcagtaggtgaggaatgggatggatctaattgcatctttcctggaaggttgctcaggttttctccagtcacacttaatggcatgtctgtctctgccccagtgttttgagatgatgcctccaacagtgtctcactctgtggccagcgcagcctcagtgccaccgtccccttccctactctgagtgctgggattacaaacatgccactgaccaggctgaaaatgtctttatttcaaactccactcctgcctcatggtagctcaaggcctcactcatagccatgcttcacctcgatcataaaaattagtctggagacgacagttaagacttaaagcctttattactgttgagcctcagaggaaggtagttcttcctgtgggttactgagtgaaggcagccgaccaggcaccagtgccaagatgagcccttcattcctcccttgacctcttgatcttttagaggtgagagagagggcgagggagggagggggaagaggggagagagagggaaagagaataatatgagaataactggaaactcagttccagccagactaagaaaagtgctgtcaggctggttcatccgtgtctgtgagcgtggtctcccctccactggctgctcgtaccccacacggtccttttctaaccgagcaggattaaccctcttaattctgtctatcacaagagcccatgtctgggagctctcagaacagcccgctcctcagagccagtgtgcaggatcacagctcgggttggaggttcacatctgtaagatcacgctccaccggaggaactcacccggccggcattgtaactccactttagaagcaaggtctgttttctcaggtgcttccttactgcatctctgagtccagaggttttttgttcactgcccgtggatagcacttgagggcagtgaactgtgtagggctccagtcccaaggtgaagctagccccgtgcagagcaggcctgtgccttgacagcgctttctgcctggcagtcttagtggattccccattgtcgtttagccagtgatgtattgggctgtagagtggatgttagttatggtcctttgttttctggtaacaaatataactcatggctctgatgttattgccagtgaatttataatgcctgaatgatctttgggacatacacgcatgcatgtacacacgcgcgcgcacacacacacattcagctgagaaaccaactcaagttgtctttcttttaaatcaccactttatactatttttcactattccactaactttgtaatggacagatattaacaaatttactaaacaatatggcagcatcctaaaagaatgcataaatagctcaataataacacgtgcatattttgttatatgtagagatgtctccctaaagtgaataacaatggatatatttaaaatataaacaaaattaagtggtaatatggggccccacttaaaatcagtaaagtgggggtctagagatgtggtccagtggttagagcacctgctgtgctaatatgaggagtggaggttaaatacttagtgaccataaaaaagcctggctgtggggctggagaggtggctcagcaggtaaaagcactgactactcttccaaaggtcctgagttcagttcccagcaaccacatggtggctgacaaccatccataacaagatctgaccccctcttctggtgtgtctaaaggcagctacagtgtacttatgtataattataaatacatctttaaaaaacaaaaagcctggctgtgctggcatacccctccccccagccctcccccagccccagtgcttgggggcaaaggtaggcaaatcctgggggtttggtggccagtctctactccaaatgataaactccctgggagaccctgcctcaaaaaataagcttgaccatggttaaagatacacaaggtctctctccagcttccttatgctcacacagtgcacacgctgagaacattatcgatgaaattaaatgtggcattaataattacaagtaaaattagcaatgtaattcaaaattaaaatttaaaaacaaaaggcataacccacctaacccgattgagacgctctagctagcaatgctgtgctgttgggtttgtccagcctgctgtctggtgttgatccctgattcccccacccccagcctctcactgatcactcaggcccatggggtcctggttgtgctcaagtaagcttgatttgaagagacagaaatgtctgaggtgcctgtcaagagcaaagggttttattcagaaggttcaagcaccctggatggctgttccagtatgacccagcatgaccagtggcctctcctgtccagcaccccaggctgctgctgctgccgagggctgtaggctctgttagccaaccccatgcccagtggccacccctcccacctctgaatatgttctctcagctttagctctgcttcaatctgtcccttcctttttaattttttttcctgttcatcagtttaaatttctgaaaacagattaatcttcctgtttgaaatcttgttttgccttctaaaagtaggaaatggtttattgagttaatgtgctgctcctgcaggcaagtgtccagcctgggtcccacagctgtgatatcgggggacccccgtggcactcacagagctagctgtggctctcagcaagggtgacagggagaagcagccttctgagaaggagccgtgggcaggcatgctccaccacagctctgtctgatacaagaccatcgcctgcgtggcccaggtcagggtttggagagaatgactcttgtcctcagttctgccatagatccatcttcagagatgctcacccactgaagcctgatgtctggtcagcagcaaatattaaatcacccataggttgctctttgtctcctacaaatccacattccccactcatttcccccccttatccaagcctcagtaattgcgtggttagatgtataaacgatccgatgcttaactttgattctttacaacaaataaataccttcctcctagacactggtttccatggattttcctaatgactgtgcttggcctattaggactgagctcttgacggctcccccatcagccatgtgtacgctgctcacattccacagtgtcccttgggacttgtaaagggaacagagcagagctgttcccagctgtgatcctcagccatcagcccttcccgccgagggttgtcttgtgactccacaaggactcacagatgcaagctgcacatctgacttgtgcagacatccaggcttaacatctcaacctctggatgcataactcccccctaacacccgccttcatttcaaaactagcagcaacaaaaccacaggccagaaggttccgatctcccgagtttccttgtcccggtattaaagcatttgtcatactacactgacattgacttgggtgtctctctctgccagtcagtccttgtggcatgagaggcacgttgagaggaaacctagacatgttagtgtatctacctgtgtgtagacagatgctcacacagtatgctgatcatccataaagtgcttacattttttaccggacaagtgtcttacgtaggcatacatgtctctcttcctttgattttttttttaattgtcaaaaattcacgtacttagttgaacaatgagtctggactttctattaggtcatctctcttagctgaggaagattaaaatccaggggctggaatcatcagagtgtaatagtttatagtctgggaagctctcccctgccttggagacaactcacacttgacttatgctcaggcccctcccatctggcagtccaggggatacttccaaggcaaaatatctcatttctgctaacccccacccaggccttctctgggcccccaaacattggtgttgtgtgggaatagcccctgggcaggtctgtcttggcacgtcctgtgccacgcaggcatctgactggctcaggggtttctggggtcccctgagggtatggagccatgactggaaggatggagtcatgtgacccacgctcttcaggttagagaacaaattcctgggcagggattgcaaactcaggctcatagaaccctggatgtgtgagggaacttgggtactccaaggatcagtggagctggaagaaaagtggaattgcaggcctcgtggatgtgcatatacaccacatggctgtgaccgcccactctgctggcaggtggctttgggctgtggcctgaggtgtggctgtgtatggagaggcatcactccagtctaaaggaaataatgatggaatgttgtgtgtaccattcgtgaggtggcagtcagtctgacgggagcgacccatgtgtgctttaccatcaggctccatttcttcctcacatcgagttttgtaagattcttagaaacttaactgtatccatttagaaagctatctctctgcagtttccgttttggagtttagagtatggcactggcgtgggtgtcaaatccacattaaatcttggccaccgtacaattgtatttctaagtatggaatacctcttgtcatcgagcaccaagacattcccagtgaaatctcttggggacgttcaggttctgatcacccagaagtcccactgctgtggctatgcgtgtggagtcacacagtgaatcaaggccggagctccggaggcagttctaatgcaggcacttggagctcatcactgtgcacgttagatgaggctctgcatatggatttcagtcagagtggacggaagcctctcaacatcaccgtttcctctcttgagaagcagcacttcctgtagggcctttgttcgcttcatcctctgcagcaaggcttttcccacttagaactctgcatgaagtcccttctcgggcgaaggagtctaccgtgggaatagcactgagctggctcacaaacattacatgttcagcgaaagaaggaaggacagaagagcaagcaggtgagccaggatgctgtgccaatgtcagctctggactctgcctgtgggacacacctgccgagttctgtgtcacgtgctctgatgcacctgccatgttctgtgtcatgtgctatgaatgtacctgctgtgttccgtgtcatgtgcactggatgtacctgccctgttctgtgtcatgtgccctggatgtacctgctgtgttctgtgtcatgtactctggatgtacctgccgtgttccctgtcaagtgctctggacacatctgccgtgttccgtgtcatgtgctctggacacaactgccgtgctccttgccatgttgagagcatctgatagagaggctctccagactcagacatacttcttccccaagttaggctgtaaggatgtattaggcaaatgtatttatttatttttgtcaggaaagctcatgcctgcccttcattatgaatggaattctttcattgtcttaggccaaaggtccattttaaaacacggatctatgcatattttaaaatcaaatgcaaatatgcatgcataatttgttcccatttcctaggtttaatattcatgttaagaggctgaacagggcttggactgattatctgggggccttgtttctgccagtccctattcgggtcaatctccaacactgacaatcaagtttgacaggttcctttcacagtggaagagactcgacagatgtcgtcctgtgtatgtctgaggacgatgagcctaatagcaagtagacaggcccagaacattccttatcgccaagcacacagtgcaggcctcagaagtggtacctgctggatctcagacagtaaagtgtgtcacacacaggtacactgtgaagactgtctcctcagtcactgagggctaacagttactgtggggttttgtttttgttttctctttgttactgaagagtggggacccgagattgatcacctccttcggatcatgtagatctttctatcacccacagcgaaggcccagggctacacttggggttctctgctgaaagtatgcgggtgacgtgtgctgttccccccacctgccccccacatctgctcatctgagctctcagccccagaatgtctgttttcattcagacgcccagtctttccacaaaatttggagctggttttcagccctccgtgtcaaactgcagctgtgcatatctgcattctagagtagccatgttagcttcatgtacacagccaacattggtgctgtaagaagtgtgtgtgccattgggagacatgggtagcaggggagagcaggtatggaggctgaagcaggagtgttacggcaggacagacacatagcctccatcatccttcttcagtagactgagatatggtcctttccctcctgtacctatagggcattggtgtagacatagaggctcgtccaccagagtagggcgagaagtgccttggcagatgctgggtgtcgggcaacttttcacagagtaggtagcctttgaaccgggccctcacaggtcatcggggatcccaggaaacacaggacactgggcacacagtccacatccaccagccttgcatccaagttctagcagctgaccatgatccttctgcaaccagcagtgttctcaggagtcacaccattgccacctgctgtacacacctgatgattcttacacggggtgcagtccaccacagcagccttcctgcaggtcaacactaccccagccccacctgggtgtgccatgtctcgggatagagattcaggttaacagtaggtctcagagctagctgcattaaaccttggctctcctcggcttcacagacttacgtcttactgtgctgcctgcccgagcatagctatgccagccacgctcctgagaagatggcagagttcccttgcctagttctgctgtctgcacctgtgtcaggcagacgactgctgtggtggtgacagatgcccaagaaagtctcattaagggaagacgacttatcttggctcatgggttcactccatcatggtggggaggttacatcagctctaagcagctccagccacggcaggcacggtgtcctcctggcaggtttcctccttctcccccttacactccatctcagcacccaacctgtgggaaggtgctgcccatgaagagggccgcacttaatcctctcacacatcaaaggtgagcactaacaacctcctcagtgcctctcacccacaccagctcctcagtggagatcaaccattacagtgctttagtctgacccctcctctcctggggtgagcaggaccttggagtttcccaacaggccatgccaaaattgtgctaaagagatgaccccatgggtaaagaatgattgctgagttcagatgcaagtatccctgtaaaaagcagggtgtggccacatacctgtaacccccatgctgggagtggggacaggaaggtctctggggctggctggccaccaccctagctgcggactgattgagagaccctgactcaagggagagaagcagagatcaatcaagcaggacctcagtcaatatcctcctggcgtctgcacatgcacagtcaggcttgtatacacgtgcacacacacacatgcacacacacagatacacacatatacacacacacaggattgtatacacatgcacacacaggcttgtatacacacacacacaggcttgtatatacacacatgcacaggcttatatgcatgcacacacacaggttagtatgcacacacaaacaaatcatgcatatgctggcacttttggggtgtgtgtgtgtgtgtgtgtgtgtgtggttagtgtaccattgtagcatctgccctgctggaatctccctctccctgttggatacaaaggaacagtagctacagtgtccatgtgtaggatctccagatgacaggatgtctgttgccaagggaagtctccgttgatggccatcaaaatactgaagctctgagatttataatcacaaggggctgagtgttacccagactggggagcaggtttcccctgggcacagtctccaaatgagagctcatgccgccttcacaatgcctctggcatcccacaggagccagcgaggctgtgcctggactcctgactcaccagacagagcaacgaatgcgtgctgttttaagtggctctgtctgtggacgtgttgttacgcagcaatagataactaacacagtgtctcggcggggctgaacaagacactgcagtctgagctcctgctctgcataagtgcctggcatctggtaacgagatgtgtgactgtgctttactaaacatttcgtccctcacgcctaacactcctaaggaaacgagaaagttttagttccccgaaaagaactgagtcagcaccttgattgtcaaactcctgaagcaggtgtcccagataaaggacaccagatgtgtcacagcagctggagtagggaaagtctgaaatcacaaagattatgtcgagtgcagctctgtgcgcaggagagaacaaagggaaaatgaaaatcaggtttcctaggggaggtggggggagcgtctgtagtgtggtgatgggggagcttcaggaggcacccccacttcctgtagacagagacggttggcatggttactgacggaatacacatagaacattttttaacccctcccccccgtttccgtgtggctcgatctcttactcgagccccagatgggggtcgggggtcccagttcacaatcagtcctctgagctgcctacctcccctgacctcaggatagctgtgggatggaataagctccctcttacatcaaggaagaggactaaaaattattctgtaaacatcttctgagtgtttgcaacttgttgcctgctcctctgatcttctctacagtagctctctgtgtctggtgcttttcccatcactggttaaccaaatagtcccaggctaaaagcagcccagctgcatgctcgggagcccatggccagtggtcccctgggatagagctcaaatctactgagtccaggactgtgcagagcatcagtgtgctctgagccccccacccccagccttccagggaagctccaaggtcagtttcttcataaaagaggccatttgcattgttaaaaaaaaaaaaaaacatttattgatattggcccagaagccagggcggcccacctgtgaaggtctcagtgtgacccaggcagctgcatgggctgcataaacctctctgtcctctctgccacgagcttagggttttctcccaagagcgtcctcacccgacttgttaggagtctggatcagatttattttccctgtcagttaaaaaaaagtaaaagacaatttaaaaactctcacacaacaggtagcagtggggaggaaaatgtcagacagcagactgaatcagctggtgaagaaaggcttttattaggaatgaggaaacacacactgaacactcgcgcgcacacacacacacacacgcacacgcacacgcacacgcacacacacgcacagcaaggggtggggcttgggaagctgaagtccaatcacaccttgagactggagatctcagggtcccttgagagtctccctccctaatttaggattggtcagtttaaataaagacagggaggctgatggaccccctactttggggtaattctattctggccttaacattttcagatttgctcacaggtcgggaaactgtattgattggagaaaaaacccgccaggaatctggtctctggtcaggagtatgcaagagaagctggaagtctgccatctttgtatctagctgtggcctttccttctgcctgtctgcttatccctcactctatgaagcaataaaattgtggatgttgccagtctcacatctttctagtattctctgtagtcagctgggtatgaggcccagcttgcctctgctacaccacagccaaagccaaagtcacttccagtagaacccccacccccacctgtgactgtatgtgtttcccagctcatacggttggaacactgtgggtggcagctcacaggacatcgtcttctgtgaaaagggtggcagaaaaatggtttccttgacttggatgttggggacgtttttatcaaaaaatgaactagcaagcctgacatcttaaagacaacggcatttgttatcactgcaaagttgtaaggagaagttggaatgggggcaggggatatctgtgcctgccagtatgagtgaacctgatagcttcctggtatttaaagatttttctgaatgagatggtggtgggtgggcaagcagggtgactgtgtagtgatgagtgtgtgcacaggtaaggtctgcaggcagtgcatagtgtcggacactccagagcatgaagcaagttagcttaattctgaagggcacactctgtccactgatggtacttctctgtgtccaatgtatcgcctgactttatcattttatctcatatattcttttttgctgttgagttttggttttgagacaggctgtcgtggaggccactgtgaccattaacttgctgtgtagtcagcgatggccttgaactcctgcctccacctcccaagtgtgggagtgcatatctattactgttgatttcgatgtagagtaagaaatctcctgatgatagtaggaggttatatatgatcccatttctctccgtcactgtaattccttctcactacgtggaatccatgcgttagacgtgactttgcagaactggttttgtaaatccatggcgagatgtttaatttcatgtctgaatttattattagatcatgtacggtttttcccagccttagtatgttaaccctcaattttaacagcgcaaaactatagacttcctttccccatcggtgtgggtgttgaaatgttccccctcctaatggccttccttagctcccacaatgcaacttcaactgacataatacctttacctctggacctttggggagcactcgacctaaacctgagtagtcatgaatccagttcagtgggatcatatatgcagaggcaaagcaaacacagtccactcactgagaacgtcaacttctaagctacacagagaaggaggctggcctcgaggaattcccaccccagatgttcattgcaagctctttccttccaggcattctcccactctctaacctccgctcactgaacccaggcaaggtgtaatctatcggtcctccctaaccccagatcatcagggcctcttccacatcattgtggtagccctgttcgggctgtctgtcagctctgcagacttcccccatcctctcagggaccgtgtctctctcttgctgagcacctctctgccttactgctgttctggtgctggggaggcagcagtgagccatgatgctgcccttggatctcaggcaggtgtgcccctggtgcctcacccaccctctgccatgtgtcaagggcttaaccaaccccatgtgttgaatggttggctgtctctggtcgggactgtctttatctggcgtcctcttagccagaactcagtcacttcaagtccctcgtgagatgacccatcccttctgcttatgaaactgcagcaccacttaaggcaaaatgcggctctcgggtcttaaatgatttaacagagaaagcactaaccaggatccatctactaccaggggcacactaagcagatctgtgcatgagggctaaatttccctccaagctctaaggtctgggcggcgtgatgaactagactctcacactggctcagcacaaattctgtaattatcattggagtttattagagttgaaaggtcattagaaagtggatgtatatcttcccttctccctagaattaaacagtggaggatctggagctacggggaggctgtaacctgcttagactcacagaggatgagtagagggaaattaaaatccgcttttatgaaagaagtcccaaggggctcagatttgttaaccaaaccgaggtgcccctcccttctccagacgctgtttatcctcctccagcctgtgatccgtgccgtctgttacttagcagttattaaggaatatctctgccggcccaggacaattagaatactgtgagaatagtctctgcaggccagttcccagggtttcgggagacccctgaagcaaatgctttattcatttgtcgcagatcccagaatctaacacacacccctccccgctcccgcttaggggtctgtgccactgtatcaggcctcatctgctcctcggatccttaaaccatcccatggatcagtggggaggaaatcgacgtcatagcacaaaaatcaatgagctacttcttctgggggattattctcacctgagcttgctcggaactgcaataaatgagtctgtggtttgcaaagggaacgtccgcggtgggggtggggtgaagcatccttccctcgcctaggacatcccacctccatctcagagccggccttctttacaggggcttctttgtgcctatttatctaccccgtacactctgttgttcatgtaatatcatagttggtgattccagtttaattcatgccagtcagctggtcactcacaggcctggcttttttcctgcgttaatctcttcctcctggatgccactccatgaagcaccactttattaaaatgtaatagcctgaccccggagtgtggggagcttggccaggttgtcaggtgtaaatccttcaagatttcaggtgcgtgtcgggttttgtgttgttttgtcacatgtgttaattactgtgcggtacccctgagaccccaggctctgtgcaaggtcgaacatttacatttgaaaaaaatgttcaaatggataagtaaatgaaaatgaatgaagttgcccttcctcctccatgttaggataaaagaattcctctctctctctctctctctctctctccatctccatcttctctggaaaggtgaagcctctctgttctgtctcagcatgagagaggcagggggtgggaagtgctgtggacagtatttcacaggctcttggaagggatgaggccggcagtgagctaccccgtgctttccctgaggtcatattttacctggaacacatattagtttttggtgtttggtgtgaaatccgagagactaaataaataataaacagtgagagagagagagagacagggagactgtgagtcactgcagagcctcctgttcccgggagcccttgtcattagacacttaatcttctccgaatgagcacagatgcgtggctctgttttcaagtggtccctgtagcgtctagcatttatgagtccttaataaatttttatcataattaatatcccaaatggtttggggttttcccctgggggatggtagaaccgagacttagaaatctgtgggaatgataaagtattgttttatgagtttctatttccctgtgcctgagggcatcttgatttactagcttgcattcagtatcatgagccccacactctgtctgtcggggcttactatcatagagtgttgtgccaggacaccgatgattgtcttagacacacgaagcaggatcatccgtaggctgaagctgcgtggtcggcgatcaagattccttggtcatctggaagtttgaggacaggtcaacttctccttcggggtcagtgtcagctcaaagcccttgcacgtacagggccggggacagctgaggctgtcggtgtacttctctgccctgttccacagatgggctgggtcccctagaattattagcccagtggctggcacccacaacagtatataggacctttcagcactgcacagacggtttgcacaccctctgtctctgtccatcagcaaatgctctgttgtccagcaaggggtgggacaggagagagagagaagggtcaacagaaaggatcttatgaaagagttggtcattgagagggactgtgaagaatggttgaaattttaatgagcaaggccactctaagggagctggggcagtggtggcgcacgcctttggtcctagcacttaggaggcagaggcaggcagttctctgagttcaaggccagcctggtctacagagtgccttgaactgtgaatgttacataaggtttgcataaaatagctactgtctgttcacatgttaccttaatgtgacagataacagcattcatcaaatatttgctttgtgccaggactgaaatactgtcgtcttatatcttccaacagacttgcagggtaggtctttttcctcatctaaaaaaaaaaaaaaaaaaaaaaaaagttctggaggtgatgtctctcaggaaagactctgcaaaaggaaagggggataggtcctagctgggacctttattgccagagggtgtgtgtgtgccaaggcaaatatgggaggacgttaaaatacattcaaatgggccacggctaactgttacattagttttctgcatttttaagtgcttaaaaagataaagagcaagaagaaggccagacataagttactgagtagcacgctcgggcagtgtgcgaattggaggaggagctacaacactcgcattggtcaagtccctcctcaccagtgaggaagctgcctgacctctggccagcagcacctctaagttcaccatcttttataacttttataactatataactttatgctctccctgtgactgctgtgatctcctacatctcaggagccggcagaatccttccgcctctcccgcttctcctgtctttaagctacagccacacagctaggactccagtgactaacgcacccagggactgtgtgacacctttgagctctgaaatcagcgcagcctggtgtccccaccccatcactgaggacagggctgtcagcctcactgagctcagctcattctgtgaaatggactcacgtctcttcacatgttggatgtggtgtttacacatgacatgggtgttgctgagcacacagtaggtgttattgacaggttgtctcacttggcgtgtggctctgtacagtatcagtgctacaccagctgtgtcctgagaatttctcattatgtgtccatttcctgtacactagacccaggatgtttctggtcaagcctcactcctctttcctgtgggtggtgagcacatggccaggcccttctgcctggctcccatctcctctatggtgttagctccaattgcagctgtgtctggaccacagagaagctcacatctcttgcttcccttgcactgagctttctcagtacctggaaaaagttcccagcctgccttgcttctgctcctcacctctgcccccctccccgtccctgtcccctccctaggtggggtaagtattcttcctttgttctcacccgtcttccgccttcctcaaactcccaccttgcccttggtacaatccaagcaaccaccattcgtcagtgcctagtggcagatagcagatgctcatcaagaatcaattgggtcactgctgcgatgagttttgggactgacataactgccctggttgtcacgcactgtgtctatccccaaagtgagatggcactgtccaaccccgtgtgcctgggttgccagcgagccaagccagtgagtgttcattctcccccagggcagatgcccaagaggtaggtaagccagagcaaccaagacttttaaagaaatctatatccgttttcaaagtacaatgaaaacattgtggtctggatagtcatgctgccccttagtgacagcatttaaagatatgtatacatgcgaacacacacacacacacacacacacacacacacacacacatctatacagtcatgccagagtttggacttctcatatgctctctgatcagtgtgactccggatgctccgttggcttcgtatctgaccctgtgtatttctctagtgggcgggcatgtttgcagttagagctgctggtgtctgtagagatgatcctgggatcgctttttttatatataaaaagatttgggggaaatggccatacaagcgcccgaggactttagtgtggatccccagcaccggtataaaaggccaggcagggcaacgctcactatcctgtaaatgcagttccaagaagacaggtgcttggggctgggtgatccgctagtctggagctgattggtgagcacaggctcagtgagagactgtctcaaaaaccaaggagagcaattcaggaaagcacgcagtgttgacctctgactttcacacgcacgcacaccactgcaggaacatgcaggagtgcacgtgagagcacacacgcagacacatgtgtacacacatacagattgcaagtacaggatgtatgtgtgtgtgtgtctatgtatgtttgtgtgtgtgtgtgactgtgtatgtatcaagccactcttttttatttaacattattttcacgtctccaacaaggaatggactgttgatttaccaggaatgttttctttatctgatctttactaccttcgaggccctgcccactttgcacctggttgtggctgtgaccccagttcaacacaatgatgacaaggggagatgcttgcttctgcttccaggccaggctgtggccaacccccatagttgcagtctctgcatttcccttcctgccgggtcagtactgacagtggagcggtgcccacctcactccattcagcattgcccatctctgtaccttcttggactctcgtgggagctaaaatctgcaagcgaagattgtgctgctaatatcagttagcactatcccgatcaccagaataaataaatgtgttgacttaagtatcccaagtgactgcacggtgggcccgcaatgtggctgtcctgtcgattgtttggcagcagagtcgtgtcccataagtgtcatgacagtttcctatgacagtcccttctagcctttgcactactttgcacacactttgtttgtgtgtggcagtggtaggcacctgggaaacacagctttctcctacgagccatttttggtgatgtggctcaagaggcggcacaggacagggccctgaagccaagaatcctgctgaaaatgactgggttggagtctagaaagaaaatgcccccaccaggacattcccgggactttaggttgttctgtgcagttctgtgcggtagctttgaggcttccctggctcctgcagcgccgccgagaccactgcacaggtgtggttgaattaccccttacacttcagtatttgaaaggtgaactggagtcttacccccttttctgcatttttccatatttggggtttttcagaatattttcagtgaaaatattctgcttattcctggccctttacccacggcaattttttttctccaggaaaatgttctgccatctaatttctttgtggtattttccatgttttgacataagtaaattaaatttttataaacttatctttgattccccccccttgtggtttctattgttttcaggcttaagaaacccttctcagttcagatattaagtagaatacatttacctatagttttatttttcacctctaacttttgtttctttgtttcctttttagtctacctgacattgttttagagctgtgtgactttctgacgacatttttatttccatttaatgagcaatgctttatttctttatggctcttatacccaaagcttttaaagacacctctggaattatttgaaacaaacaagcctgtatttaagcatggttctagcccagggctgatgaaatggctcagaaggtaaagacgctcacctcatgcctgatggccttgagtttgactcccagaacccgcgtgacagagagaacagagtcctgaaagcggccctccacttccacgtgtgtcatggcaggcaggcacacgcacacactaagtaaataaatgttatctttaaagtataaaacaaatgttatttttaaaacaaaaccatgcctgagaggaggagtggagcagacagagaacaggctggcgatgtctggcttgtaggtggacagcggagcccaattgggcagcagagccggactgagcagctctgtggaagggaaggccttccttgccgcttatatttcgatccacatctctcatcctgaacaaaaactcaattcaaaatgggccaaaggtcttaatttaaaagctcaaactgcagaggaaagcagagggggtgcatttcaagacacaggcgcaggccagagcctcctggtcacgacacagcacaggaaacaatcccagggatcaatgggattccgttaaggtaaagatgtctgcacagcaaaggaacctatcgtcatcagactggagacagcgggagagtgggagacaagtctttgccagctgaacctgagacaggggcttgatagccagtgtgtgtgtgtgtgtgtgtgtgtgtgtgtgtgtgtgtgtgtgtgtgtgtgtatgtgtttctgcaataactaaacatacagaaaacaaaacagccaggtggtggtggcacataccattaatcccagcacttgggaggtagaggcaggaggatttctgaatttgaagccatcctggtctacaaagtaagttccaggacagccagggctatacagagaaaccctgtctcaaaacaagcaaacaaacaaacaaacaaaacaaaacagagagagaacgagagaaagaaaaaagaaaaaaaacccacacaacacaatctcatattcccaatcagacaacagtctaaggagctgaatgcttcacaacagtgagaatggtcactaaatatttttaaaaagcattcagcatcctgtcatcagggagaacaaaccacaactactgagagattccagccaggattccggtgaggatacggagagatggattcacactcctccgtggagggagtgtaaactcattcagccatcatgggaatggagagggtcctcagtaagctaaaaatagagctaacgtgttagccatttctgccaccacgtctgactgtcttggtgttctttaatgcaaaatgccagcctagaccctgcggactgatctctgaccgtggctggcgttcacacagaatgggctggttttcaagcacagtgggcattgttatgcagagtatttcattaacactccggtggtgaatgcatctcccctgctctcatccccaagcccctgaagtacatcctcgacattccccagcaggcttaatcaatgcgcttctctcaagtgcccaacctgtgttcaatgccccgttcagttctgtctggttccctgatggcacttgtgggtagttgaggaccaactgtccatcttgtaaaagggaaggcaagagacaaagcacaccagaggaatcacagccgatgtgctgggagggaggctctgggactgcggagatggttcagtcatcaagaatccatactgctctgcaggggactcggctccagttcccagcacccaagccgccatgctgggtgactcacagctgcctgtgacttcacttttaggagatccagggtcttctggatccatgggccctgcactgacacacacacacacacacacacacgcagaggcacaatttaaaaataaatgttttttaaaaagagaaactagagtcaaggttggaaatgtgcatcttttccgttgagttgtcagttcatcacaccaaagcctgaaagctaggattaataataatcaaagttttttttttaattaaagaactatttaaaggctagaaagatggcttagcacttaagaacacacatgattcttgcaaaagacctaggttcagttcccagcacccacacggcagccaattccagggtatttgatgtcttctcttgatctgtgtacacaccaagcacacacacagtacacaggtatgcatacatgcagtcaaaacactaatgcacataaaataaatcagtctaaagaatgtccttttagagaactctttaagtacagtcaagactccatgtccttgtgcgtggcattgtggttctcacgcctccacacttgccagcaaccctcctgaccagggttttagtcagtccctgtccctttccagcctttattttgtgttcctgctgagacctggattagttggactctcccatgctcatttcctgacttcctgttcccctacaatctgaccatggcaccctcatacaatccaaccatgtcgtccttgtaggctctgaccacaccactgatgccagttgaggtatccttacaagcttactaccctcctgcttcccttgatctcctccctccctccccctctccctctttcccccttcatccctctcttccttctcttcctgctttcccttccctcccccttctgttgcctccccctcttcctatttccccctcattccccctcccttcccctcttctgaactataacaggtaaagtccaccctgggtgtgatccagatgacagcgcgtagactcatcccacgggtttgctcctctcttgggagctgcagtggagcagggccacgcccaccacagggagccttccgttcccttccttctcacctcacctcgacaacaggtcctcctctgtctgtggcccagccattgccaccccctctcccaccactgacccagagaagatactctgctcccttaaagagtgtttcagaaagagacccccaaggcttccataaaactgatttctcacagtgcctgtctaatactgtggtacattgagtggaaatggccctgccattgtgggagttgacccagttcctcctttgtgtggggccccaagagctcacacttgccaaggtgcatttaagcacccttggattcatagcctggtgtgctggttggacgtccctccattgagttacttacaactgcagctgtaattgcagtgactggggcagctttctgtgggctgtcagatacatcaggggctaggatatatcccacaaacatagctaacactgcagagagcactacactaataatgtgatgcctgtgggctggctggctgacctgaacacttccaaacttaatttttataaccaggcagagggattaagaattttaagttgcccagaagacgttcaggaggactcctgcaagtggtgtgtttttctccagcttaataaaattccaagtctgtgtccactttgtgatacagtttggtgagtcattctcttgctgaaaagtaggagcacctgcctgctgagtggctgcaggtgcttcactgcggacagtggcttcactcacacccctgcctttggctgctattgcttctgcctcctccttctcctcctcctcctcctcctcctcctcttcttcctcttttattttatttttatttcactttgggccagttaattgatgctttttttttttttaatttggaaaaagtgggtgtaaacgtttctacctgtgtgaggctgtcagatcctctggaactggaattacagacaattcccatgtggttgctgggaattgaactcaggtcctttggaagagcagtcagtgctcttaaccgctgagccatctctaggggtaaacatttctaccttgtgggataccctgtggactagtgtgctcttttcagggtttacagtctgagtcgagataggcctcagtcgctaagtaagctcactgactttgtttagctgcacccacttcccccacattgaaaatgtgcagctgcacattgaaaagttcctgtccttggtggcaactctgacttatgaagcatagtcgcagagcccttggtgagcggtacacaccagacccagaaaccaatgctttcacagtcctggctctgctgcttgggcaccggtacagttattaagaaaaggaatagtgtccatcactaccttaacactagcagtgccgcagtggtaacggcgagctctgtctgatcaccccatgctcacgtgcatgaaacaaaggctaaagggcaaggatctcaaagatctagtaggagtccctcggactgggtgagggcagcaggcagcggggcagcaaggacaagcagggcagctgtgtctacccatgggccatggcattctcaccctggaggatgcagatcccggtgcatcctggatgtttgttgagcgactgctgttgtgtcagtcatcctgcaagactgagtgacagagatggccaagaccaccccagcacaaatgctgtgttccactgtgtctcgtgagaggttccttggcatgtctcatttcttactgtgtaaagttaaaaatactagtcgtttttaggccagccagggcttcagagagaggccctgcctcagagaggtacatttcctcggaaaggtagcactcaaaaaacaagcataccacccaaaaaaaaaaaaaaaaaaaaaaaaaaaaaaaaaaagttttaaagtaacatgatgaataatttgattaaacttgtggttagaaaaattatccagtcaggcagtggtggctcacacctttaatccttgtgctagggcagcagaggcaggtgaatctctgagtttgaagtcagcctggtctacaaagtgagttcggggacagccagggctacacagagaaaccctttctcaaaacccaaaacaaacagacaaaaggaaaaaaaaatgtatctaacaatataacctgtttaatgccattctacatactttatgataagctaaaataaaacaagattagagtctaaattaaaatcttaattaatctttactgacatgtctgtgctcaactttcagacctatgtacagtatcttatttctttagagatttccaaaaaatgaatatttatgtgtttgtatgccaagtatctcatgtgccagagaaataatgacaattgtcacaccgaggaaatgacggttttcagatgtttcagttggcataagaaagagggcaggacagtgctgatctggtacatttgctctttaaatgtgcaaagcagattagactaatataagcacatgacattaaaattagttaatttactctgttttgttggtgttcattacgtatcacaacagttcacgagactgaacacaccctctgagcctggcacaatcccaagccctttaaatgtgaggttatcattgtcccacgaagtgggcgccatttcctagtttttatgtaaggaaacagacagagggagctttgcaggggaatgtgtgtcctgtcagggtgagactgggacccaggaaacacactgttccatgcccaccctagatccctcagctggcagaattagcagttgtataaaaagttcaattaaagttgttaaggtttaactctgtcactgaatagcactgagtattttagagaatgaaacaatgtgttttaaatattaacatttcagacctcacttgttaacattatttttaaaaaatatttaaatttgccaggcagtggagacatacacctttaatctcagcactcaggaggcaggcagatctccaaattcaaggccagcctgatctacaaagcgagtatagtacaatagctagaccttcaatcattcagatcccacgttctttcgactactgtgttcaggtgacacctgaaaccagtagagtggatgacgtataaataaaacctcttccggctctaaaaccctctagtctcttgctccggcacgtgggttggaatcatcattccccctagggacagagggtgagtctgctatagtaagtgagcactcagagagatgaggtggtccgactttgctcctgagcatccagaaaccgttcgtttaatagggggctctacaactgttacaacccggcccctctagtgggagggcgtggtaatggtccttcacagatggaagcagaagttctcggttgtttaattccagaacacctctctgggtccttgagggtccttttccaccctatttacaggtctcctgtcatatcccagcatctgcacacaagctgtccctttccgggacactagtgtacatgtgtgttttccatctgtcttcctccacattcctccatctatcttaccccgccaaagccaggttttatgacacagtgtaaatactgcctttggagggcgatccattacatcctaacccttaccaaacagcgttttatagccactgaagagcagggtgtctggcagccatggcatgagactgaaaacatcacgctccagcgaactttgtcatgggaagctcctccgagaccgggctatctggtgtctaccccatctcactctagtccctagcagccgctgcagctctgggtgtcagccttgacggccaccacaagttgtgcagtccctcctagcgtagcctggctgcagaggcagctacagtgagaaagagggagcggaactcggaggtgacaccagaagtcaggtcctctctgctgtttcagaagttgtcggctctgagccgtggcccaaatgatgtgttacatcaagtttacacagggcatcaagttttctaaagatgaaatcattataaatcctggcagttttctggtgtaattaaaatgtctaacaggaaacccctgggaaaccagatgcagttttactgttcctagagccgacggtggcagtgtttcttgccagctttcgtatcttatgacctataaattgctcttaatagctaatctgtcatccaggcttctcacatcagaaagcttgtttccttattaatctgttcatttgcatctgcaaaggacatttacaaatccttcgtttgaaaacattgccgtagaatgctggccattataaataattcatcgcctgtgatagaagctcttacgcctaggtaatagatctttgtgacattatattattctttcaaccctaatataatttggataaaaataatttttatgaaagtcctctggctgccgggttaccatggagaggcagtaactattactaatgaccctgtgagctcagagcatagactcaaaccaactcttgtgctagcaaggcagtcagatctgcatactgtttatacaataattgggtgatattcctccaagctgaggtttggagtttgggacggtctgatttgaccgactgtgaataaacctgacaccagccatgggccgcgggcggcatgaaaatggctgttggtctcacacacctccgtctatgtggcccagcctagcttcctgtctctgaggctgtttgctctgtctcctctcctccaggaagtatgcgtagaagccagagcagggtgtgagagggagccactacgcttgatgtgaggctcaggtcagctcgctggccgaagccagggtggtggacacacgtttctatattctgtctggctattaaaagggaagcctgcggtctgaccatcagcttcccagtggcacgagagagggaagtgtggtactgctagcttgatgctttctttagaataaggccacaccagctgcctggtagaggtgctgaattctgtacaggttttgccatggaatagtcagtcattgggtgggttcatgggcactgatggagaaggtgacagtctttaagcactgagtgacaccctaggaggcctcgaccatcatcgaccccccccccataagaatcacattatcacctcaggtgctcaagtcttaatgtttcataaattagacgtacataccatttaagacacagcccaggagaacgcggttcagtctgcaggcttctcgtgccttggcttctattgattctcccgaagtaaacccatggctcggagaagcccggttgacctttgcctctagattcatacaagcttgtagagattagctaatgctgatttaggtgcccggttcttctcaaatgtggttttcctataaaaaggactaaagttccaatgcagaagtgtatgtcaccggcacggaactgggccgatagagttttcatagctgactctccccgggatgtctcctggagagtaacgttactcgtttatacccgagtattagtcaggattggcgggccatggggtaataagcaatcccagtatctcagaggcttaaagcagagcttcctttcgtgtgcccactctgtgtccactacagatgagccaggggtctcgtacacgctgtcatgcttcctacttgcggatcagttcagatggaacagttgtagcaacagaagaaaggatgtggtgatatgtcctgctctcacattgtctccgttttccaggagacaatcgtgtgcgttagccgaggcaggtacacagccacctccagtcagcttcacacgggctggggagagacgtcccaaggactgccctcggtcagtactaacacgggtgccatgttagttagcattgctctccttagcctgtggctctccctcctgccgtgtgccgggctctccgtgcagagcttgagccatggataccaggactggaattgccgcgtgtgtccctgcccagcggtattgttagtacttttaggatgtcacacctctgtgcacacagatttgtctcgtcacgtgtcaggtttgacatgatgatcatcagatgaagctgtgtgtggaaaagccttgtattgtccaccctaggtatagactcgcccaacctgcctctgtttgagctgtttctgtttcctgtaactacccacccacccccaaggggggaagttctatctatctatctatctatctatctatctatctatctatcaactgccttattttagagcagaaaactgaggaaatagggtttgcacactgtcacctcctacttccccttcattgacatcttctgtaaggtatatatctcataaatgatgagccggcgttgatgtattgttagctgaagttgacatttacagtagggctcactctgtgttgtaaatgtaaatgtcacatatccgctattgtatcacacagaacagtgtcagtgccctaaaacccccgttatgccaccactcactgtccccaggaacttcttcactctgaagcttgcctggtcctgaatgacgcaagcggaaaggagccgtctcaggctggcctctttcaccgatgcgtatatctctggtttcaccttttgtcttgtggctttacagacaaactcagcctcacatggcctcacaaacgccaccgtttcaacattaactgtttgaaagtctttggctgtgttattttggtttggaggtaaggccttgtgaactcaagcaatcaattctcgtgtgccggccacccgagggctggaaccacggggctgtgatttgggaggctgtaaagcctgaggaaatggagcctgactggaggaagcgggtcactggggcgggcctcactccacttcctgctcgctctctgcttcttgactccagatgcactgtgccctcaccgtggtgttctcctcaaacccacatcgcctcaaaccttaaggcaaaactaatcctcccttcagctccgcgtgtcaggtgttctttagtcacagccacaggacaagtgacgtagccatccctaaaacaagggcagctgttcaggcagacatttgcagagtggtaatctgggtacggtgctgcctgctgtttgtgagggaaaaggtgctgcctgtcaggatttagctgcttctgctgtcttggtagctgtggtggcagggttttgtgatatgtcacctggccctcttagcacatctctgaaattatgtgctaagtatgttggagataaaaagaaactaaaacctacaagtttaagcaccagccaaaccctgacctgggctttccaagccttacaaagtattaatatacatgtctcacaaggggagggggtacctggagttctgtgtactgtgattgcatgcattgtagcctcacagtctgccctatgtcctatcccagagcctgtccatgtgtctgtgttccttccctgggctttggtacctaactgaggccccaggtttatgagcactgaaccgcagggaatacctcacccacgtgggcttaggtagtaaaagggagaatcaatatttctgcgactaactgcaaatacaatccccatctccccaagtacatgcaattaatcaattggtaagcacaccaaatattccttaggtaaccgtgcaaactataaccactatgaaaaatgcacactgtaaggacaggaggaaatgtgtgcattgtcaggacagtgtttagtgttcatgtcaccagtgtggttctaatttggatagcttaaaccttattttagttctcaaactcaaaacccttgaaaatgggttgatgtgtgaataaatttctagctctagcttgagcctcatgaagcttgtcagggtgacggggtggctggccccagtgccagagcctgtagctcggagcggtgctttggcaaaaacacaactcatttatatcacatcgaaagagaaagccattgtcttcctctgccagatagtttgctagtgatgctttctggctgcattttagtattcaaatacagatgttcccagatgtgccctctgtgggaagcagctgctgcttttctggcacagaaactgcagagaggtcaatatacaaaggcagcacaaacctcagtacagacacagtgcctgtgtgcagtgggcctggcgttcccaggcggcagggggccctcgtaccccccttaataacctgaaactgtctcagatttacccttattcttcaggagtagaaacaaagacaagtgattaatttcaaacacacttggctgataaataccatcacatgttatttgcccggggactgtaaaacactagattttatttcctgcgaaactgataggaatatagatgttcggctgcgattactgacgttcacggcggctgctcctagtggctgcctggtaacagcccggccccaagtggcttggggtcatcagtgcccacacaccttggctgtgagttcacagagcactgcattatttactctggcacgatcgggcatgagcctgttggatcccagcccagcccttccaagtgtgtacagtgttgttattagcaccattttataaatccagaagacgagatgaagttaaatgactctggtgcttagccttgttcgattttttgtttgtttgtctgtgttttgttttgcccagtgctgagccatgaagcatgcgctgaacatcacatagtgctacctagatgtgcgctggtaggacatcaccacgagcagtactgcctggcagctctgcacactaaggggagaccggcagggaagggctgatattccattctccttccccacagcctggagggagcgcctggctgtccctctcctcgtgcccagagagctgcagtgaagcagctcctgcgtcttcctagcatttacagaaacgaagaagcagaagcgcacatctctgggccctcatttggagttgccataaaccagaagtttccaagcacagtggcacctggggtgctgtgcctgcctgagccttataaatctgtctgtgcagtgttcaagggctcattgcctccaaccagatctattcttcgaagctagctagtgaattatttatggattacacatttgacaggggcttggggctacatttgaaaacactcagctcccggcttgtcgctgtggaaggtagaaatgtctgtctggaaaccaaggctcagagatattcagtggctacgagtcccagaggtagagtactagaatagctgagctcagtgtgtctggtcctgtgctgcctggcttcccagggaggggcctgtgcatcctaccacaaggacagcaggccatagcaggtgagggtctaagcagtggcctcgagcgtggggttcagatagaaaggaagcctgcgcagaggaagggacagaaaagggagacaaaagaagctgaggccaggacctacagcaaatgaagaaaagattacatgggtgagtgttggtgcagttggagctgcagaaagctgtggtacagtagctggcatggcaccccccctgtcctctccccccccccagaggccaacactgtctcagtggcacgttgccttgtgacctcactgctgcctcggccagggtccaactgctacacctgaaattgcatctgctcacactcctttgttggaacacatgtgttgagaaaggcaacttaaaatagttcactttgcaaacacaccactcacaagcactgtaagaaaatggtcccagcccctgttagcaggaactgactgctacctcagaaagcaaagaaaacagggaaacacatcactcatgtctctgaaatattaataaaagacagaacacatctgataaaggaaggcccctcctctataggggtggcactgcagcacggccgccctttagccagaggccccgtgaccaggatcactccttcatgttccagaggtggaagcaacatgaagagagggggccacatgtcaattggctgcaggcaggcacgtaatgaagcagaggagggaagcatgcatgcttctaagcttgagaataaagggaagagaaggcctagtattaccttccttttatatatctgcaaaaacgtcttagagaccaacgctcaagtctggctgcacgcacccagtaggaggtgggaagcccatagcctctcctttgatgctctggttttccatctgctctgtgcctgtgtactatactagcacagagtcgttttcaactaaaacctctgatttcagtctggtttttttttccccctgtggtgggattgaacttgaggccttgcacctgctaagcgagtgttctactgccgagctacaccgctggtcccattaagaccttgaagatttgacatagatggctggtgggcagtgtgtggggtcgtggcaggtagtccttccctgtcctgagaggccgttgctcagagactccggaaggtaaaggaaagctggagtcccatgagcaggagaggcatgggccagccaagcagggctgccgttccggggtgttgactggattcctcctctgattatgatccaggtctaagccacaagtcacctgagggagtaggataggacagtggagggtcctggctcccgggattataagtcatggtgggaagtaaccccctcagtgcctgccattggctttgggagagtgacatgcagaggcacagagcgtcttgcatgtgggttctcgagcgagcgagcaccgggtgctctgggcacagggccacaggggtcctccagcaccccatgctgatcattcctcctcagtcgcaggggctaggggtactaacagggctgcagtaacagtgaatgttagggatttcagttgaaagctacaggaagcactgcctgtttctgtggggtcgacttcagcagcccctgcttaggaagccattgtctttcatttgcagttcgctgtgggatgtgctttctatcagttctgtgcggctctgtggcctcctgagaggaagacctctcagagctcgattgagggttccagacaagctctgaggttttagctgcagaaacaagccaaagctgtttttttctggcgtgttctcacttccctgccttgcctttcctttccaggcagcatcatcagcgctgagcagcctgggtcatgtgtacaccgccatcggcgactaccccaatgcgctggccagtcacaagcagtgcgtcctcctggccaagcagtccaaagatgacctttctgaagcccgagaactcgggaacatgggagctgtgtacatcgccatgggtgactttgagaacgccgtgcagtgccacgaacagcacctgcggatcgccaaggacctggggagcaagcgcgaggaggcccgcgcctacagcaacctgggcagcgcctaccactaccggaggaactttgacaaggccatgtcctaccacaactgtgtgctggagctggcacaggagctgatggagaagcccatcgagatgcgagcctacgctggcttgggccatgcagccaggtgcatgcaggacctggagagggcaaaacagtaccacgagcagcagctgggcattgcagaggacctcaaggaccgggcagcagagggccgtgcatcctccaatttgggtaagggcatgccgctgtgacgctgggccagcagcctaggctgcagatggctggagtaggcactgtcttttttgggagtttgtgtgtttttgctctaaagaattcattgtgtatctttccttcagccataccccctgaatctgcctactgcaaagcacattgtctcttctgtgctctgagaaagaaaaccctgcagtgaagggagacacacacacacacacacacacacacacacacacaccagtgcgtacacacacacacacacacacacaccagtgcgtacacacacacacattcacacacagacacacacatacactcacacatacacacagatgctcacatacacacacacagacacactcacacacacacacacacacacacacgtgtgcacacacacacacaccagtgcgtacacacacacacattcacacacagacacacacatacattcacacatacacacagatgctcacatacacacacacagacacactcacacacacagacatacacacacacacacacagcacatccagagagtagagcacctgtgtaacagagagaggagctcggggtgacaggaagctgtgagagatttaagggcctgcagaaaatacaacagggacgactttagttggtgaattagtccacagtgtgtctttcccctcataattacgtgtattcagaaataatgttgatagtctttgtatgaatgcaaaatcattttgtgaaagacctgcaatgaagacgtgccaacagttggtttggaattcaaatgctgtcaggacattttaatgtgagggctggcaagaggcccgtgagtaactggaaactaggcacttttgtgaagcctgtgacatgagatacacttgtgcttggaagtgtaggtggggttcattaggtgggaggaggggtaagaaggtggccacactggtacctgtgtgagcttcagaggccacaggagcatccccatctccactaacgccatgttagcatgcccctgccttcccctccacctcagctgctgctaacagcagtccttgtaaaacccatgctgtggccgtatgctgtagaggcctgcaccttctcaggtgggtctaatgagggccttgagaccagaacaagagtctaggcttgcaggaggacacagcgttgacatctactgagtccacacctgagaactgttcccttgagccacacacacccctggcctgtatttttgttggggctatattcctagttatcattggctgtatacaacttgtgggccccaggttcgtcgtgtctggaaaagtctgacaagagtcgaactaacaagttcctggctgtctgtgttcattctatcagtgatcggtatctactgacaccttactgtgtgattagtcctgtgtaattaatttgtttaaaggatggcggcactcccataagctttgtgtgtttgaagagctaataatatagttcgaaaacaatgtgcaggcagggcatcagcgcttgtctacttgcctctgtggctctgcctcttttcatatcttacactagtttatagactacatcatgcattcatatatgtgtgtgtgtgcgtatgtatatatatatatatatatatatatatatatatatatatatacttattatatcctgtttatagtccataaaaggccacatactgatgtgttgccatgaaactcctaggagggcaagcctgagggtaggacaccctgggaagcatattcacaaagtttatacccaggcagaacatccccagagttgaaatttggcccaaaatggagcggcgtttgtggtgaagaggatgtgaaagaaaagatgggttgccgcaggttggtgggtctgaggggtttagcatcagtgcctggccagaggatgggggcagaatagcatgcaggctggtcatggctgtgcttgagagcagaagcctggaagtaatgacatgagggagtaaggagaggtgtgcagcagggaagaggccccatccttagtggaggaggctgtgtgtcttgactaggcagattttcctttcacattgtgttagctttgggaagttgtgttttccagatcatctgagtcattcgatccaagatccaaagtccttggtaacttctttgtcattcttgtaacactggatggctatgtggggctgtgtccgctttaccactcatacggagtcaggctatacccattcctcatatgcagacggttttctagatcattctgattggaaatttaccaatgtctacaaggcgcactctgctgtagttagtcctttggctgtgcatatctgctcttccatttgtttctgctgcaccttgtataatattcttctccctcctcacctgagtccttcttgctttagctacccaagctcagaacttagacctgtggctatgtcccctcttgtcagggcagtcacgtgaaggtcttacatggcctgtgaacagtgctctgtccacatcatgatttctatattatgtttccactttcactgaactggaaaacatttaagatcatttgtgattgttctttggaccatttgtttaattttaaactatttggggtaggtagagcttagtggtcagtcatttgtcaagtatgcacaaggtccaccgtttaattcctagcgctatatagaaaaagaaattcaataatcaaagcactatgctggggatgtgactcggtgggtgagcgcttggtgagcagcatgggtgtagtcgtgcaagcctgtcaccccagagccaggaggtcggatgtgcagagaacagatcccaggggcttggcaggtttctagtcctactcatgaacggctaacacgggggtgggggtgggggtctgacggatgcctggattggtctctgaatccctaatggcccatatgagatggcaggaaacctggcgctttcttgtatgtggtgtgcatagaatccagaggttgacattgggtgttctcattgccgtcttacaagtagaggcaggctctctggctgaacccagaactcactgatctgatctggttcctctagctagcctgcctctgtctcccaagcatggggcagtgggcgtgggggaataaagggaatgggagacaacccatgtcccaccagagttccagtgctctgggcaggcagatgtggaggactgccgagcgctctccatacggcccctggtgggtgtctggctgtgtgaagccactgaccccagttcatggggaggggggtggacagtggacagtcgctggacacctcagaagaactgagaacaaagtgggggcctgggggcagctccgtcagctctggggccgaagggaggagagggcaggggcagagggggcactgggtggttcccacacagtctggtctggtccgtgactggagcgcaggaaggccctctagcgggaggttagacaaagctctttaggggaaagcctattccatcgttcaagtacggcatgccttgatgagcagagagagtctatggttttagagctttatcgtagaaaggcagagagaaagagagaaggtagaaaaggagaggtcgtccatggccatgtagagagaagggtgaaggggggaggagaggagaaggagagctagaaatgagagtaagaaaggtaagagctaaagagagaaaggaggggccaagcagccccttttataatgggctgggctatcttgcagtagcaggataactgtggggaggagcacacctggctattgtcagctaactgtgagggtggagtctagccagactgccaggagcttgggacattgtctgtgtgatctatagttacaggaccgtggagctgggggctcagtggtgtcaggcgcctatgtctgggaatgtggctcactgttctgtcccttgtagagtttcctactgggtctccagagcaagccccgctcaaccaaaacaggctgtctttcacggtcccacacctgagcactgggccaatgcctctggcaggctgccgcaggtaacgagagctcacatggtcagtggggattcaaactccagccctcacacttgtgccctaaacattttgtccacttgtctgtctctttggccctgacttggtaaattttgatgtgtgtgtgtgtgtgtgtgtgtgtgtgtgtgtattgacaaaattttccaaacctatgaataaagaaagaagatgaaaaacaggaagagaaccgtggtccagatctcctagatacaaagcataatgaatgggtcaagatatcaaaatagctaaaaattccttacatttgatggaatcttagataaaatgacacacacgataaataatctgatagatgcagattcaaaaactggaagaaagaaaatttaaagtaagccacatctggacatattataatacagctgcttcaaccgtccttgcgggagagaaatctcagaagcagtcgaggaaataaaacggtgtttccaccgagtatttatcagaaacaaaggagggacaactaacagggttgtggggttaagacaaggtcttactctttaaccttggctggtcctgaactcattacagagaccaggctgacctcaaactcatagagatcctcctgcctctgtctctgcctcccaagtgctcggattaaaggggtgctaaaagaaatagtaaaatctgcctcaacccagcgagactattcctccagaacgaaggtgagctgtgtacgtgtgcctataatcccagtacccagcaggcaaggctcacccaggacttcagagcaaatcctgtctctaactcaaattaaaaggaatgaaggcaaacgccatgtacttcaggtgtaccactgtgaagagctcatcactggcggagaaccgtaagaaatattgaataaagtcttttggacagacagaaaatgataccatatggaggctcgggtatttaggagagaaagagagcaccagaaatggtaaatacattgataaacaagacattgttttcctcttaagtaattaaggtggctgtttaaaacaaaaatataataccatatttaagaataacgcaggtacagtaatagtgtggcagctgcagcaagggatacagcaggtgggagcagatgcatctgccaggtatacttggatctcacagggaacgcacgctctagtgttagctcaacgtagactccaaactgtgaggaactcccaagaaaaacactgaaaagggatacagctaccaagcaagcaagcagaggagacaaaccaggaagcaaggccaaagaagggtggcccaaaacccgacagctgaatggtaatattaaatattaaaagaaacagccacaaagaagggctagagagagggctcagtagttaagagcaccgggtgctcctgcagaggacttgggttcagtttcccagcatccatgtggtggctcacaatctcaaactccagttccaggggaccagacaccctcttctggctttcatgggtaccaggcacacacatggtgtgcagacacacatacaggcaaaacactcatgtgtataaaatagaacaatttttaaaaataaaaacagaagaaaaatcattgcttaattctgtgtcatttgcacctgacacattaaataagatagatagatagatagatagatagatagatagatagatagatagatagataggaaccacagaaataccaaaggaaggtacataccaaaggagtgggcatgttactgtcagataatagactttagaagagaggtgtatcacctgtgataaaaagagccaaaggagagttagtgtccatggagaccagtttgtgtctcatcagctcacagggaaactgcacactagagacctgtcctgggaggtcacccacattaccacagccagtgtgcactcgttatatcaaaacaagtaaaggcaactcaaggaaagagagcggaattttggggggggggagggtggtggtgggggttcgagacagggtttctctgtgtagccctggctgtcctggaactcactctgtagaccaggctggcctcaaacttagaaatccgtctccctctgcctcccaagtgctgggattaaaggtgtaaagcgtgtgctaccacggctggcttgagatcagatgttttatgatgttaactgtagattatttccctgtataattaaatgatttgctgaggggtatcaggtagggacttggcagactctctctctctctctctctctctctctctctctctctctctctctctctctctctgtgtgtgtgtgtgtgtctgtgtctgtgttagcctgtggaggagccctagaatagtttagtttgcagggacttgtcgtttttctccccacagggtctgtgggcagcaccagttctccagagcaatagcaaatgtctgtagttctcagagttagcagccagaaaggtcatccgtcgtgatatccttttgttattgaaccttgctcatacagatgtggctggccatgttcatgggggacctccgtttataccatatgaccccaaatccccaagattaaccacactggccgcagagccacgatgctcccttgggcaagcatcccagctgtgcccagagacctagacccaactgtttcctgcagaagagaactttacaatgcatattgtattttttaggtttagaattttcatttgttttttgtttttgttttgttttgtttttctttagcctttcaggtttcaggactatgattttaggtgttcatttgtgctgcgtattttttccattgacatagccgagtctagatttggtgtgtgcttttaaagccttgacagctatatccatgtgagtcgtcttgaggttaggccctattgattgcttttgtttccttcttcttcagtttggtggatatcctcatactgtgaggtttaaagtgtataattcactggttttagtgtagccgtggctgttagttgattacctatcatttttagtatcagcacactctatgcagtaactaacactggaatatatcacactgtgggggtgatctgcagaagagctgcctcctgacatatctatcttggtaactcaggtgtgatggcgttgctctcccaggcagctgacttggctgcagtcggcctcttcctattggtgggtgtcaggggaagcctttctctgcagctttgatattcagagactgtcacagttaggaattctcctgctaggcaaaacaccatgaccaaaggaaacttagggagggaagggttatctcatcttatggcctgtggtccctcatccagggaagtctgggctggaacccggaggcaggaactgaagcagaggctgtggaggagcactgcccgctggcttgctcctgctctccagcactcatggtacattcggctatatcctccattgtctccacccctgtgtggtaaccaaagcagcttgggctgagaggaaaggctgctgccccgctgctggaagtccctactcatttttaacctcaacaatttggcttttccccttccccctccctggggctcaccagcagtctcctcaggcagagccgggagcctttgaggttctgatttgactcacatggcagccactgaagacccccaaccctgttctgtgcagaatgctgtctatccttcttgactgctctttgtgcagattaaaggtttttgtttttaagttgcaaaagtgaggtaaacttctgtggaaaaagttttcacaaaattgaataaaataggaaaaaggacactgcccactcgtgtgacttatctgccccacacccagcattagccactgttagtggcctggtagaacctttcagaatgcttaccacatgcacagacacagacctctgtgggtgaagtctcagtggctgcaccctgtcccatgtgtggagtggggtcacatcacagtcctgtcccccacccccaccccacccctggctcccttcactcagcttctctccctagcctctccatctccgtgtcacggtggctcccttccctccaggtggggatccttgtctcatttctgacctttgtctgtttctgtttatcacccctaacccttgactcctgatttctgcacaccgctttcaactctcttctttcttaccttccctctgtttcccgagtcgggatgccccacgcctctcacccatgcctctcaccccgcacggatgctcagtatcaaacatgaaccctggctttccgacagtgaccgctcaggctttgctgagctgctgctgacggccccccttgtagccctgtacaccagcacagaggctgatgtcaccaagtgctgtgtgaccggtacttaagcagtttgagtgagttctcacacagctgcgttgctgttaagaccctgaaatcagttccactgggctcaaggcaagtccatcttgtagtggcccaggcttcttggcctttccctccttctgctggccacccccacatccctctgaagtgcagtagccactacagtgcctgactgactctgaaaccacactgtcctctgtcctgccccagacccacagcttccttcagtagggaaagctaagctcctgtcaggcctgcctagtagagcagagtgacctccccatgccatggaaggtgaccgtcacactctctagggaaggattgtgggggacactgaccagcctaccacactgtcctgacttagcaaacgaatatcagtttccttcctccttcctctgcttcagctgactgtcagtctaagctgctgagggaatattctctaaaaggttctcggcctttgccccttcccgattgcccaatgtgctgcaagaacccagccgctgggttctttcatccatgccccctccaccctctacagtggaactggctcattttcaagcatcacttgttggctgcggtgttctgtgtccacacaatggtcagtcacatacagtcttctgtccttattcccgccgcccctgagcaccgcacctgtgatgggcccttctgatctctgtgtttcccaccatggccttgctttcccgactctgtgttcttcccccagctgtctctgtctcagtctctctctctctctctctctctctctctctctctctctctctctctctctctccttactctccgggtgtgtgtgtgtgtgtgtgtgtgtgtgtgtgtgtgtctggagttcacctgctacatcagaacgacccccgatcccatccattgcttgtggcctctctttatagtcagatattgcctttgtgtgaaccctggaactattgaaacacttgtctcttgttctgttctgttcaattgtaatcactgttacatgtggagccacacagtcacctccacgggctgtaggagctgctttgtggtctgtgtccatacatgggacccttacttggagtaggctctaggtgcatttggctaagaacaagcgagtaacactagaaacaaagctctgctggggtgagctggagatcatggatgctctgccagggtgagctggagatcatggatgctgttggatagaaaccagaggagggaaagggttgggcagagctcttgtgagctcagttttctgccccacccccatagtgacttctcccactttaagaaccaatggtgaacagaaggacaaacaggtgtcaaggtgacatggagaggacgggaaggaagggcagtcagggagactgagtcaggtaccatggggaagggaccaggtggagctcagagagaagagagcttcaggatgtgatgggtgtaatgtttatatcaaggaagctgagggctgtgagcttgggtcactgagatcttccatcacagctgtggtgtctgttagggacactgtagagctggtggagagatgggctaatacctgtcacctgcttctcacttgaaggagccggtggcgacccttgggattcttgtaagcagccaggcagcctggatgctgtgtgagtaacctcatcctgtgaagcagggctgatgaaaacctcttcaggcttttcgctccaaatagctgtacttacaggacaacgtgtctgtcacctggagggtcctggtggttctaacggaggcgctttgaaatcaaaccaatggcatgctgtgggctaggtggctcgagtgatgtccggattaatgccatccagttccagttgacacagatgttctcattgaccgggaagccaggcagagctgcctctcctcttactgggataaagtgtaactaggaaactccaacaagactggaggtctgtcagccgtccagtagtccgtctggaaaataactctcctttcatagttaaagacatcgtttgtctaggtagtaacttatttgggggtaaaagggcactaaaactagttcatttatgcttcgcaccacaagtcctgctaagcctcaggtacagggtgggtcctgctctcttctgctaagtaaaaacagtcagcagggttctccccaggagcctctggctttccttcaggtacagagctgctctgggccacacgcctctcttggcccttcctacaaacagggcattgagaatagaactagagaaaaatcatgctgccttttcattccttcgttcaaaggacagtgtcctcagcctggcgttcataatcttttcagggagtcatgttagcaagtgtgaggtttgcgttgttccccacccaacaacggtgaccaaaaactgtgtctgtcttctgtgctgttcaggggtctacaaaaagttgctcaaacaaagctcctaaagatgacatttgaaaacgaaatcctggcattctgtaccggaagattctgaattcccacactgtgacataccatctgcacgtcatacacacacatacacacacaccatgctccttagtgacacaccgcttatgcacacactgcaccttagcatcggagactgctaagtaagttgatgaagaaaataaccacgaagaacatgtgcaacttgaaattctggaggatcttataacaaattattttgtagggaaaatgctgctaacagtcattctcttccatgctttttacatttccatttgtatgttggattctcgtcaagaggaacgaggtccggctttataggtatgtctacaggcagtaatgaatctagatctactgagtgtttttctctggaaattctcagaatgacatgcagagacatattcaaagcatgtctcctgtcacagcctgtgagacctcactggaagcccttggcttggtagcgtgaactcacagtgtgtctcatagaactttttgtcacttacaagtgtcccaggagtaaggggctttgtgactctgctaaggtcaagagtcagaattggttaagagtctgggtctcagagctcagctgtcagactttccatcccaacaggagcatcgatggataggctgcagccatggggcactcgccacacccaccagcctaaagatgagtgagctaggttatagaccagcctggagcaatgaccctgctctgcccagctgcaaggcagcaagccttccccaggagcaaagccactgcagatgcctcctgcctgagaagcatctcaggatgtcctgtgctaggccatgcctttcagagaattcatcaatcctcactgcaacgctgtgtgagcagagagaagctgccagccagccagaatcagctcacagaggggaaatccacagacagctctgcactgtgacgtagccaccaccaacctctgggcagagccagttatatgagaagagaccagactgggcagattatccacacacctctggttctcacctgaagatggaaagaaaaactgtaaatataaaagaattaatacctcccaggctctaagacagatttttcccccaacatcaaagagaaggaacaagactgccccttccctgttaaaaggagaaataaggaacagagatctctaactaaaacagtcttctgatggtgtgccagaggacttatggagaatgattcaatcccaaaacacacaccaggcttccccccacctctaccagtgcctgataaatacgaataatattctcttgctcctttgggtcaagatctgtgcctctgcttgtccagacattgcagcttgaaaggtgccagaacttgctgtcagacacagtgtaacaccagcagaggtgggtggggcagtgtgcgtcccagtcagagtgtgctctgggcctgcaggacactgcacaagctgccattggaataatggataggcgcctgctgccaggtcccggagtggtgtctccagcaggcagagcctagcagtaaattagcttatgcttcagcctggcagttggcacttggttcatttgtagatgctaattgtaatctgatgttatcagcagcaggtaattgaaatgggcttgatgaattacttaatttcttttaatagctgagccctcaagaactgagtaaagaagataaggtgatcgggaggaaaacacaacagctccgtctttctaattagtgcttggtggtttccctcttctttacacaaatggttatgagcatgtgaggctgggagaggctgtgactcagaagccccccatgggggcatttcccaccaggcagctctgtcctgagcattgagaactcttcagctgggacttgagaaaggggccccagagggaccacagagggcattgatttctgagtgcaactttgtttcttagactttatagtgagccggtggccccgcccttcctgtcagctcctcctgggtggccctttctgagcacctgctgcctggaagcagcctgtgagctggagttcttcagttgtgatagctcaggctcctgttgccctcaccgggcacctgcacctcccacacctggcagtcttcgagcatctgcagcaagggccctgtagccagccctggcttggccaacagtggccaaggcaaatgtgttctgggctctctgcctgctggacttatggcatggaactgtccagagctcaggcgagactggagggctctcttccagagccttgtggctctgtttttggatctcaggttcattcctcaagacccaacagtttggggtgactttagaagaatttggtcttgaccggttccttttttctttttgagaacattgaaataacagcatcaaggttgtgacttttcatagacatttggcggtggcatagtaagatattcttcttgacttcctttaagggtctcctgacatagccctgtgaggacagctatggttagaggagagattgcaggattctcagccatggtgtgactctgccaatgccctttgtgtcaaaacataccaatgcccctaacaatgttttgtttcttttttaagtcattttgcatgactttgttttgggtgggggcctgggggtcggaaggtgtgtgcatggcccacatgttgaggtcagaggacagcttgtgggattctgttctttccttccactgtgtgggtagcagggcctgagcgagcgcagtcaccaggtgtgggagcctttgcccgctgagctgcctcaccaccttctctcatctgagctgtcctgacataaaatttgttgggccatatcttatgtgcaggatcttatctctttctgattgtatctaatactctcatttcttgttttctttatttagccttttatttataaatttcagttatatacatttatattgggaaaattatatttgagctgtgtatatattgtagaagattagtactatctcacctactgttgcaataagagcggtcaaaatctagtatcttacagttttgacttatgcagcacataagttaccatggtgtatagtgtaatgttagaacttgctcctgtctaatgaaatgtgtcatgcattgaccactgcctcctctttgcccacctccagcctctgactcacgttctcctctcagcttctgtgagtccagcatgtctacacatcggcaatgcatgtaacattcatcttctgcgctctggcaactgtactgaccacaattctaggttcatctgtgctgtctcaaattattggattccttctttctctggggcttcatagtttcccaatgtgtatctggacccagttgtctctgtctgtctgttgatggacacagtgcttgtgcatgtcggccatcacacacaaggctgaagtagtttaagaaggcaaagagagaagctggtcccacttgtgtttgtagcttttgtgtccatacaccaagttctcaaacccaggtctaacttccaattaagttactggtcagcctctatgtaacctggtatcagattgcccacagcacagccccgagatcgaagaagccatcctaggatccccacctccttccctcccagcctagatcagcagttcccctcccaaagccagtttgaatgtgtgctccagagttgtaggctcaacggtgcctgcctgggtctgtctgtcgtcgtcgtcgtcgtcgtcatcattgtagttgtcatcatcgtcatcatcgttgtcgcaagagcttctcctcacttgtccctcagctgctctttcagaccatgtgccacatggttgccatggcaactctgtaggaactccccgctgctcaatctcatcatatcatatctgtgctcggaaccctgttctgggtccccactgccctcgggaggaaagctgaagtcctttacctgccgttttcatttctccagcagccctcagcagccctcacaacctctcaaacgtcatccaagtgcagcaaagacagacatctaaattcagctggcatttcaccgagtgccctttagctctctgaggatgagcactgacccctcctcctctaaggtgccctactgagtttatttcttgccgctcactcaaatccaattcagtattccccaagccactagcattcctcacaccacatatatcttcctccccagataccatccttccttgtggagtgaaaagccttccttattcttttattgccctgaagccagaaaaactggcttagaagcatctgttttcctctacctgtcaaccattgtgctcatggccctcatgaagtattctagttctctgctggctccatcatgcattctgattcggtggtgtgtgccttaagcttgttggtgtcctcttcaggcactgctaatgcttggtcccaaatgagtgtgtacgatagtttgcctgctgttcccatcacagaacaccaccgacgatgtaagttatatatcatccaagttggtgtagctcattgttgtggagactgggaagtctaaaatcaagggaataagtctgacgagggcctccctagttgtgtcctaagatggcagagaatggctggaccaaggaagagagagcacgccctgcagcctgcctcctcaccaccactccatgagctaatcaagttgaaggcatcatccctcaggccttccctgcggcaaataaacttcagtgtgtgctcacagaggactgcaaagccatggcagtgtctgtctgtctgtctgaatggggcagaggtgataggacccaagcatgctgggaaaggccagatgttaaccaatcctaatcgcacacttctggaagccacgcatgctgggaaactctgagcattaactcacccaatcacacgcaccctttccctctttcttgctcactgagctcaggcctgtacctcattctccagctcagcttccgtcctgctggggatcccagagcctaaaaggctcatgctgggtaacagcaacaattcccagacactgctgtggaccctgaccttgcctttggtgtaaacagcccccacactacttccaactacaaaaggctccaatgccaccgcttgctccatggtcagagaatgtatatgaagctgaccttgactcctaaatttttgttaagttttaagattatatatgtatgtacatctgcatggggtatatgcaggtgagtacaggtgtccctgaggtcagaggtgtcaggtcccctggagccggaggtcatggcagaaatgaggggcttcttcaagaacagaactctgtcttaatactggaaccatctctctagcccaaaccttttctttatttcaatttttttatttgtacgtatgctgtattgtgttgagtgtgtgcagtgcatacaatatattgtgcggtgcatcacaactatgtagtatatcatatgttgcatacgtgtggtatattatatggtatggggacagtatataggcatatacacgttcaggtgtgtgtatacaaacacacacagagacccgagaaggacgtcaggtgtcctgtaactgtccatttgacttccttgaggtggggtctcgctgagcctggagcgaggcctgtgaccagcaagctctagtaattcaccatagctccctctcgcagtgtgggcggactcacaggtgtgtgcagccacaatgcatttttcatggggtctggggatttgaactccgatcctcatgcctgcatagaaagtgcccttacccacggaggcatctacccaacctcaaacctttgaaatgagctagaaatacagtgagcttgggaaatagttaaagcatcaggcagcaactggattttatcgtaccattttaattttattccttcagttagtagtgctaaattaagcagatttttctcctccctttacacagtcccttgccctacagctgtataagacagtctgattagcaaggtaactaaataatatattaaccttttggatcttgatccaagaagttctcaaagcgtgggtacaatgggacctttgtgcaagtttgaagagtgctaatatttatgactctggacaagaaaatcactaggatagcacactgctccttcctttcagtacatgaacttaatggcctgttcctcctgtgtttaacatccagcctcaggaaactggtgctggctctgctttttgaggtattcaaataacagtttccacaaaggggaaatgaaaaggcctttgaggaagctccacacacctttgaagtggctcggaataaagacttgacacttaccaagtgcctgggtgtgcctggtgtagcttctcacgcagtgttcattattgcgttgaaaacacacacaggcttgttaccatcaggaacaggagcctcaaagaccgggggggggggggggggcgtcgtcggggtcccatagagagcatggggaagagcggcagctgtctaaagccagagctggagctcactgagcctccctgaagaaacagctaagctcttaagagagctcaactggcgtgccggaggaatgcggacagtgaggcacagctaccaggaaacccagaaaaggagttcattttctgtggcacggcttcccatggtcctcactgtcatctccacctcacaggtggtgtgcctgcccacccaccaggagatcctgccggacctcacagtgcaaccacctcacacactcacacacacacacacacacacacatgcacacgcacacgcacatgagtgaaattgacagagactccatgtttaagattctttgcagcataattgttaatttcatggtgacttcaaaaagtcacttttccagaggctcctcctgaggcagagtatgcacccccagaactggaggaaagccaggaggcgacttttagtcactagtgctgactcagcgtgtccccacttgacttccaggcatctcaggctgccgctcggtggcttgggtgtgcagagatgctgccctccccgtcctgctggagagctggttgccctgggggagggagcactttcatttgccagggaaaatttcactggtgccactcagaacgtctccaaaagcagttaaaaagtgggacaagggctctgccatgtgcccagcgcctgtgaaacaggccctcatcagaacagcccctgtggcagagcttaacgggctacattcttaagccagattggcagagttggccacttactggaagcaacggcagtcagtaattgcatttccctggttcagatggtatgttctagcaaatccattatgggacactgaataagacaaagacagcttataactcggcccagctgctgggggtgctctggggggacccataatctgctctgcgactcggtaaaactagtgaagcctcacaataaggagacctggagttcaaccagaaattccagactgtcgccttagcaaaacagatggtggcccccaggtcgtggctccgtcaggcgagctggcactgtctgcctcacagctctggtacttctcatgtgcctgatgaagagaggcatccacattgcctttgtgcccacggagaacccacgaaatcctgtctgtgatgcagggcccgtggcgtgacgctgaactctgtactaagcccttcttctccagcctccctctcctggggcttcgggattctgtgtgcagtcctgttgagctggctgctcttttccttcctggagaaaggtaaactacttgaagtatgtgccagtttctcgttctgactgccacccatgcacaaaggactcactctcaaagcaacgcatgggcatatgtgctgtgccgtggctgaggtcaccatggaactcagaatgaagagactgtagtggaagcagatacttggggctcatgatggctagctgactttgtggctttgctgttttcgcttgtaaaatgtcttcctatatgtgacacagtgtggtggaggagagggggtgggtcattatctgcctgtcacccatttgtcacagacctgctggacacacaggtcaggtcacctttattatagcaccccccactgaggacggccaggactaaatgatcaaacttccaacctactgaagagttctacccctctgggaagggagatgtctccaagagcaattttaaaggtgaagtaggtgacctgacctgtgtgtccagcaggtctgtgacaaatgggtgacaggcagataatgacccaccccctcacctccaccacactgtgtcacatataggaagacattgtttgtattacacagaacatctgctcgtcctgatagcgtgatctgtggatggtgaagatgttcgagagcaggtacaggccagtgtttgatctcaaattctgttgctcacatccctcccagttaaaaacatttcaaatgaaaaagacccgcagaataaatcaaaacgtggatgtggacttagttcaaatgctggctctacacccgccgttaagggaccttggacggaaggctctccatcctgtgtaccatgcaaggcaggcacaagcaggtacagtgccccatgtcccataactcagagaggtctgagtgggtattagatgctgggtaccagacctcacctctgtggcgtcttgggtaaatccctttacctacagggtctgctttcagtaagaaggacaattattagaatctaacctttgtttcatgaaccactctgggggtcaaatgaccctttcacgggggtcacatattaggtcacatatcgtggttcataactgaagcaaaattgcagctgtgaagtagcaacaaaaattagtttatggttggggggggggggtgaaagggccgcagcatcaggaaggctgaaagccactggatcaaaagtctgttattcttcacaagattgtcacacacagggtgtgaaggcttgatgatgaagagtgacgtcattcccgataaagagaacatccacaccctaatgtgactttcttgtcagatttgtaactgaggcctgagaaagatatttcccaatgaggcctcagcaaggagcagagagcatggccttcaaaagtaagcacacttagctcaccaagttcatagcatggcattagattccttcccagttccgttgtacttgtgggacactgtggctctacaaggctcctgagatccacatgggctctctccattgcccatgggcaatctgtgcctgcctactggggacctcctcagggctctgcttgctagtcctgcaggctgtgagcactgcagatgtcagggcttcccccttagatgcctctgagtccccagtgcttgtctctctcagtgtgttaatctttgacgccctgtgaattgatgaggagcgcttagcgggactgcggcactcagtaaatggtactgctgttattacacgcccatagatttgtctcttttaaaataagcttacagatgtctgcactcatctcaattagcagactcgagcagagggcgttgtccactgccagcatctttggctttctagaagattctcaccaaagaaagatgacagtggccccagcattcacagtacagtcccagctgtctgaactcacacttggtgaattcacagcatcttcttgaaaaagtgtgaagtgggagtgtggcaggggcaggggagggagaggttgggggaggggaggggtgtaggggacatagggtgggaggcagccagggacagaaaacctgggtctaggttccagacctgccctagtttgaattgtagcatggaactgtgtggtctggggagagttatatcagatgtgaaacaaagttaaggagctctgggtggccgtggtggtagacccaaagtgcaggctctgtaaacttggcaaggattgagatctcctgttctggaagtgaacctgagccaccaggtttctccctcatctgtcccttcactgggtttctaggtgatgccaaggctgggatcagagtagttctttgtaagacaaaacaaaacaacaacaaaaccacaatagaaagacttgaagatgttgacttagtcagatgagagaacccagctccttttatgtcatggatttgctacaagttttcttccaggctagtgaaaaaataactttcttcccttatatggcttaagccatgagtccttttttcctgtctcaacattctggaccttcagtgtgatcttgttttgtttgcttctaaacatgttttgtaataatcacaagagccacagtgttcccacaaagtatctgctagcattccctgcctcaacgcctgggagatcccccacagctctgcctggcttacctgcagtgtgcctcgaagagggaagccttctaaatggttgccaagtgatagattccctgtggggataggaacagcagtgcttcccagcagtgttgtaactgacaaggaggcccatgccatcaaagtggctcaacagcttcctgatatttataagagatttcggtgaaatggccactccgacctttgtgaccatacacactgacccatctgttgttagtcagcgtttgtccatttgtctatctgctctctacctgttctacttcccgtcagtccttcaaataatctttggacacctgccattcttagggacattctgctgcgagaccaagctcagtggactgggagacaggagactctgctattgtctgttccacgggaggccacttgtctgtgacacctccctccagaatgaacccaaaggccagtgaccccctgagagtcaccaggcatgtgcagatggctcaggtgtatgcacagtgaggcgtttaggcatccttcaaaaggcctattgtgttgtggggactctagagtgatggttcggatgacggtgtagccgtgtgatggttgttctgtggatggttaagggaggtagacagagcacggcatggaagtcctacacccatcttcttctttgccttttctttgttctctttttacgactccagtaacgggagttttattacagcagtttgtgttctcagctcttttgctaaggctctgcataatttatgatctagattccaaaatgttagtgaattgctccaccagaaataatggaatgtgacagcagtggattcctcattcttggcccaaatatttgtgtctgtggtttgcaagtcatttcatagcatgactgctgcattgctcaagctgttaccaggatggattctgacaaaggaagagaatttgggtgactataaaagcacaaaatgggtgggtcaacagcactgcacttatgtgcataggggtttgggtggggtggggagaggcctcctgccctctcctccagcaggtgcactctatccctcaagccaggcagaaaagctgtattaggtttgtgatttcaaccccagcctctgtgctgattagcccccactgggcaccatcctgcctgaataaagcagtcatcacaagaggcacccagggaaaaacgtccagggtgcagtggtgactgtgaagcctcagggaaactcccgtgcaccaaaggcactgtgctgacccttctttattaggacatcacccagcaatgtcaaatgtcagagatctggaggcagaatctactataaatgcaaaaatcacttaaatggtggaggaggaggaggaggaggaagaggaggaggaggaggaggaggaggaggaggaggaggaggaggaggagaggagaagaggaggaagaggaggaggaggaagaggaggaggaggaggaggaagaggaggtggaggaggaggaggaagaagaggaggaggaggaggagtcacagcacagaaaagactgttccctgtgttgatgtggctttgttggtgagtcacaggggcttagtggccacagaactgaatgtctgaggcactgggaggttcgtcttggtattgaattgtccttcctatggcaaaaatgaggcaaaatcatctgaccagattcctagactccccctgaggctggggctgacaggaaacaacagctgtagactctgaggaggagcacagctccagagccctgttctagcagacagctgctttttctctgaacagaaccaccgacaaatcgcccagtgacctgttcactcatggctgcaccagcacagggatcatggaaaggattacaaagtggacgccttggggctgagacacaaacaccactgcctgccccttcactgattggctttgtatcaactgtatctgagatacataaagagaaaaggtggagaaagcaacattcttcctggtgtttttcaacaaatacaagatctgaaagatgacaaggctgaacagagcaacacatgatagccgtgatagggctagtgcaggggcatggtcgaggacaccctctcatacagagatgagtgaggtccagaaagctggtcttgggttgttagaattattggtttactatgtccctatgaaagacacacaatccagatattttatttataagccaaatgtctagattgggtagattgaaggctattctaatttattacccagtcattcagtcccttgttattttgtttctccctgcagtgggagtctggtccgtggcagcttcctcttcagtgtctgccctcttcccttccccaacctggaacctcctctggaacctccagtcctgtcttactccctcgaggctctgcccaatcacaggcgctggccttttattgaccagttgaaatggggagaaggttcacatggcatctgctcgtaggaggcaacctcacactgaggaacccgtttttagctacaggatgcaagcagcgtcagacccactacagtcttgggttcgaatgccaacattgctctttactccttgctgacctgtagaaccacagtcctgagacttaatagcaacaatgtttcatgttatttagtgataggacacctcctcctcttccccctcctcttctgcatttaaaatattaattccagtcttagatttttgggccaagctaataaacccataattgaaaaataattccagtaactgtttctccaagtgtaaaaaaaaaatcaagtcttaggaatctgacctgaagaaatgcatatttctgatctataggtttgtttatatgaataagtaaaagagctataaagccatgcctacttagttatgtatttaattaacctgcctttattgagaagattgcagccatttctagagcgtctgggtcatgggtagcatgaccgtgctgtgtgtgtatagcctgtgaaatgattcagggaccccagaaaggcagtgctaatagatggagctcttactgggatgctgtgtggcacttgggttgacctacgccctctgaaggatcgacagtctggaagcagatgttccagaggctgagatcggtgggtcggtgtgaacagtatcagttcacagcaacattaaagcctctttagacagagccatgtgcagccctttcatctctagggccatttcagatcacaggtatatcattcccagccacccccaggctgtacctgctttaaggtttcccatcagagtccaccttgtgctgatgggaccttgtggctctcaactttatcttgaccccacagctactctgcacctgatgggtagggaggttacatggttgcatgctgtttagggcgtcccaaatagctggagccacactcagatctccccaggaacaagagcttttccttagccaccttcctgaacggttgccaagacattgctggcatgttgtaggtgggtctttctacacagaccacctggttgaatgtagttggtttcatggtcctagcctctgtgcgtgaaaccacagatcagaggaagatgggaaggaagctcagggccagaaagccaaaaggttgggaggagaaagggacctttctggggatatgggaggctcaagcaatttagagcttacaggactgcagagatgggagactgggacctcagctcagagtcaggaatttgaactacagagctgtctctcagccgggtggggaggggctccaggcaagcaggcttcctctcctccttcctgcagagggcaccatctcactcaagtaagctttcattcagtgcccctgattctgacagccaaccccacccacactgctcactcaaaaacagactgtggtggggcatctgtctttgtcccacaggcttgtctgtctgtcctcccaggtccccctgagctgtaaatgttcctcagaagcaggctttgttttctgttacctcatgctccaatctaggctgtttgcatttccttccatattcccgccttgcacaccgcccccctcccccagtctaccatgtgagttgcttgaggtttatttccagctagtttagctcatccctgtacccagcatcagcccttggggtctgtgcatcccttaggacaaggggtagttcacagaaggcagggcagcatcttgattctcaccgtctttaatccctttagatctcccatcccttcccaaactcggggaaaggaaggagtggacggaaggacgtggagtctcatgcttcatgcttgcttctgtgtctgtgcttgggaaccgatggtcattgttatctccatttatttgaacaatcctttattctttgctcatacctttgagttcagtttaacaatattgatttcctcctaatggaacacaagccccatcagatctctaatgcacatggagttatgtgctgtttggagaggcaatgccgcctagtggcggagagctcaggatgcagtggcagctgacacacatggcctcctcacattctgcctggggtggagggtggaatctgcagtcagcttgtttggtctcggtgatgagcaggattttcccaaactattaaagccaaggtgtcactggccaagtccaaccagcagctcggcgtctcaggttgccctcacctcttgtcaaggaggcaccagctttggcgggacaggcatcttgatggagactctatactggggatgcacacgggacaatcaggcccttctcgtacgcacttgcttcttagccccttagctcccctggaacaccaacttgcaaaccttcgtttggcgttgctgtttaattggtggcagtgaggaatccactggaacatttgaagggcttgggggtctcttccctagagtcgagcagcccacccatctacagtattaaacactcataaaagcaagctctaacaattctgatggtatcttgagatcataacgatttgtgtgtgtgagacacttgctgctgcgatctattccagggaatgagctaaactcctcagaaggagagctgcggttttaaaatgcatttccagggaaagagcgatggctcggcagttaagacctgagttaccacgtgggctcacatgtgtgtgcataggcacacgtgtgtggtgagagaacaacttgtattgcttctctccctctgctatgtggatcctggggctggaactcaggccttcaggcttggcagcaagcactctgcccaccgagccatcttgccagcctaagacacttgctccattatcttgtgaaagagtgtaatggtagacatgtgactgccacatagagctggagctggttcacacccacacccagaagtagctgatcccctttcccagaaagatacaatctaagaaaagctagatctagtggaggaaccaggaaaggagtgatggacagggagtctttagggcactgctttgttctcagcacctcattccctgcagagctacacagagatgcacggtagtcaagcttggggaaccggagctagaccctagggagaaaccataagaggggcaagagaacagcagtgcagttctcagaagagactggaaagagaatgatccctgagggctgaaagaatctgcctatgtcagcctggaatcctgtatcccaccaaaatggaaatcaagacattctcagttagaggaaaatcaacagaatttgtcaacagcagactcattcctagtgtgatggtttgtatatgcttggcccaaggagtggcactatttggaggtgtggccatgttggagtaggtgtgtctctgtggatgtgggctataagacctcatcctagctacctggaagtcagtcttccaccttgatgataatagactgaagctttgaacctgtaagccagacccaattaaatgttgtccttagaagagttgccttggtcatggtgtctgttcatagcagtaaaaccttaactaagacaccaagacaatagcaagatagcactttatacagaaagggaacgaaagcaggagtttttggagcaccaagaaggacggagaatacagtaagagcagaaatacaggcaaactgaaagactttcccacctgcacctggaccaacaggaacacatggcatctccacaacattccatcaggatataggcagacacagacatttatcaaggtggctaacatcctgggccatatgagaaattaaagaaaatctgattagaaagatttgaggtcacacagaggatgttgtccaaactcgatggaaccaaaccagagagctggaaaaacatgcaaacactgagaaactaaggagtgtacccacatcatccatcggtctgtccgaacattgggagggagagggataatgtgcagaactgagtgcaagcaataagttatcagaatgtgtggggctcggctggagcggcaatggcagggagatcctggtaccaggagaggaacagcctcaagtccatcatctgcttcccccgcagaaactaggagagcaaacgggccaggagaaaggacattataaagtaaaagcaaaaaccagtgacccaaagcccacgagcaaatagggaaacagaaggacaaaaaacagtgatcaataaaaataaaagctgctctttgaaaaggtcgatacagttcacaaatccgcagtgaaacatgagtcacaaatactgggaatgaagtgaagggcatcagtgttgacctgcaggcatttagagagaagtggggaccgtgccgcacactgcctgtacacaggaagtggagagggtggtacacacctcctgtccacaggatgcacacagatatttgtcagctgaaataatgtggagcaattatttgaaaagcagtaacctaaggactgttcaacctggttagaaagccaagtttatagttaaacttccccccaaaagaaatctctcactgagatctcttgccggttttgaaggataaatgtacgaaacacttaaggagtcagcacaagtgtttcactctcctagaaacctaaaggagaaactcccaacctcttctacaaagccatgtagatacacatgatggctgtgggggtgtgccacggtctagcctgtgctacacacaggggggaagacagctctgtggagtctgtctcagcctgtgctacacacagggggatgacagttctatggagtctgtccctcttaccgctacatggatccagggatcagactccagactggcgtcttgggtggcagcctcctttacctactgagcgatcctgctggctagatataaaattcttaacagaacattagggaatgggctttaaaagcatgctgaaagagttatataccacgggcaagggtggttgcgagaccagggatgaagacagagtcaacagtagaaaagcaaacaatgtggactaattttttttacttatttattttttaatagattatttgggaatgtcacatcatgcaccccgatcagggtcaccccttaatcttcccacgtctgcccctcagccctcctacccctccccctaaaaggagaaaactagtctatcttgtgttgtctgtatactctctggagcgtggtcagactcctagtcccctccacaccccctgggagggagagcctttttccacctgcgtctatgccaggagtcaccaactgaggagagcctaagtccagctctcccacaaggtgcagtgggactactttattaataagcgcgtgaggtatctgttggtgcagggcaccaaaaaccaggctcggacaagacaggcaacaccaagtgctggtgaggactcagggcggctggagccgtcactcactggtgacaagacgctgagtggcacaccagtgtcctcataggtatctgtcccaggaaacccaaaaggtccccatgctgcctccgcagctccctatgaaattcattacttcacagtaaaaaagaaagggagaaggccacggtcctgggaggcccgtgccaaaactgaaaacggggtcttccatcttttatccagagcttagtttctgtagcaacaactcaagatacttcattttcctcttgcaatctcaactagaggtcagagctggtaaggtctcctatttcttcgcctcctggcatcaggagcagaccctgcacttctctagttgtttactgaaggactggacacgcccctgcccttggatgcatcagagtcacacctgaaggtgccaggctgaggactgtgctgcaggccaggttaggtgtacctctctccaaagcaagggtgtcgtctgattagtaggaccgaaggcctaacactgcattctgttgtctccaggccactctcagggatacacacctctggctggatggtcagaccacagcactcacattccccaacaatctatctcttaacatctttggcataaaagactcaaatacaagaaatcaaaatttctgagtcttttgagtaaaggatgtgtcttcttccaacactactaccttagggattagcccagggacagaagaaaataatcagagaggattcctgtgccaaagccttgtctgcaggcagcccgtggctgtagctatctgacaaagtcgaggcatagaaagggtcagctgtatccacagttagtgtgtgtggttcctcaggttcccaaaacttcaccaggaaactaattttagataaaatatttccctgggaaaagtttctgctccaagttttgaaacatccaagcttgtaaacataattactagatagaactttcttgaaaggagtgggttagcagctctctgcccacaccacggccaagtactgaacagtggatctgacactcaggttccgtggtcacagacttggtcaaccttgaaatgaaaagtctggattttccccctggtctttattccctaacaacacagcgcttaccctacatcggtagcacagatggccacgaggtccatgcagatcctctgatgtctcagggacttgtcctgcagaggtcttggaggtaggcggtcctcctggatatggaggattcggtgcttaccaaacagacactgcctgtgtacctgcttctccagagtggtagacacagccttgggtctgaacacaggccttctcttcttcatggggtgcaagcaaaggcagacacatctaaatctggggagagggtagcttggatatcaaaggcttggccgagtgttgaattagcataagcgtggggttctcagcaaggagccctggtcagacctttgcacattccagttccaaagctgatccaggtgggagagctgtcccttcatgcaaacatttccacttagcctcagcccctacactgtgtcctggctcttgtcccctaagagcttattagaaatttagcctgtcagaaagccacatgtcaggcccagcttgtcagccttgatgtggaagcaaggtacccaagggtcctcattgacattaggctgaaaggaacttctgtctgcatccctcactagcacaccatcactatcacagggacccacagagcgggccactggaagtgctagcatccccatgtgcaggagtcatttccaccaaagtgagaggtgctgggtgcccccaggggaaccgcatgcacctcatcttcccactgccttacaggggccatgatagccacagtttacaaacaatgaaaataaagtttgagattcaacagcttgcctgggctcacacagccgagaaatactagaaccaggagccatgagagcccttcacccaccgagtcactgtgccttccacgcgtcagagaacatgctggaatgagaaaggattgcagagggggcctggtcatgcttggatcaccagtgccagcccacagatcctgtcgtgcttctcagcccagcagatcaggctgtccaggcacacggaccttgctttgtaatctcttagcctctgttccttccccctccccacactcagctcagcccttttgatcacacagctcttgtactcctcctcgtgactgaggacaggtaacacaaggccagtcccttgagtatggttgagtctttctccttagccacctagctgggcagattgaggttttctgagatcaagtagtttgttagaatggcaggtcaaccgaaataattcccatcaacccatttctttgtgagacttttgagtaggcaaaggatctggccctagagagccaaaccctgggaattcaggttagtgctgcaaaggctggcacaggttctgatgtgggccagactcagggctagaggagggaaaggaagaggaggaagaggaggaggtggaagaggagggtgtggctccttcctcagctcatagtgctgagggaaacaatgagcagctgagccttgcaagtcacttatatctttgttagtagctgaagttttaaaggtaaaatggagtgaaactggtgatgttttattaactacatatatcaaaagcagcatcctaacgtaatcaatatgatgattaaagacactctacactcctagcctccggctgagtctttgaaacccaatgtctatttctactctaccctcagtgagccatcacccgggggttatgccagcccctgcaaagctacgcttgtgactctggtccgtcggagtgacaggccctgtgacggttgccttgaggagaagctgcttgccccttggaggacacactaggtccccatggcttactcagctcagacctgtcctcagagttggaggctctttctaggaactgggagactctagccaattaggagccacccacccgcccgcccacccggtgcggtgcggtgctgcagtcagtcagcctgccttccctgcatctcccctgcaccagcacaagctgcttagcatcgttgttgtgcctcgtgggtgttgtgtcttcctgtaatagtgcacacagccacttcgccgctctctaatttctgcctcccagatcctctcaggatcgtcatacatggggtttgtgcagtgcaaaaccctcagtggaggaggctttccccaactaatttatgcaaatgccttgtaagagaaaactcagcctttgtctcttcccccagcctcttgtaatgagctgtgcaacaatatttttttttttgtttaatggatgaggtatctctgaattagttacgaacatatttctatactgaataaattttattaatgattttttttaaatcaccactaagccagttgatgtgtcttattaatgactggtgataatcctctctcaaaagcagtcctgtaaaatcgactgcagataagaggccaatcatcaaagaaatacagatctcttgatgcaaacctgctccgtggccatctgtatgttttgtgttaccaaagtacaaggtgaaagcattctctctctctctttttttctttgatgcagaaaaacctttggcagctttggagtgagttcacccacacagtggggatgggtgggtattcctacacctgtcaccccgggttgtcacagtgaccctctactcgtggcatgcactgtggtaacacagtgagtgttcacatttaaaggttgctcagcagtttatgtcagagctaacggagcctaataaatccaggtgttcctcactccagagggctggcagagcctgactccggggaggtgagatgggaaacaggtccggactaacagtaaccagctgtcggacttcagctaggccactcccttcttgtgacttcactttctccatctggaaaatgaatgattgatgacagtgcgtccctactagggatgacgcagaggtagagagggtgaggtgggctccgcggaggaaagacctttagggcaaccactgaggtccctccagggtgcgcaggacttgggcggtggctgcttgcctgctgactgagaggagagttgccactgctgtgtgttcttctggaaagggttggtgggtggggcgagccagctcacgattcattctttctgcattgggaactgcgggggcttttcccacccaagaatcccccgtcttatttattcttgcccccaagtgcagaccgacagcttgatacctaaagctgggctcagtgggcgtaaagggaccattgcccagttgtctgcaaattgtcttatcccgtaaaggattctacatcactcataacatcatatgatgatgcagtagaaatacgaaaccaggactcagggcaaatacaaaaaaatacacagaggggctgacagctggcactgcagaacttcctgtctgagttggagctcctggcaaagcagaaggagagatccagaattctcgtctcccaaaaagagtttccagaaggtctccacgtgagcgtttctgggatggtacggatggtatcggtgaagcttctccagataacgggttagatcacaagcttccttttcctcttttctctcttttctgggtctcactcagcagtccaggctggcatggagattgtggtgaacctcccagccctgcctcccaagagcccgggttataagctgtgcccctctcatttctttctttaaaagaaatttttttttttttactatatgcatatgagcacactcactgtagctgtactcagacacaccagaagagggcattagctcccattacagatggttgtgagccaccaagtgggtactgggaattgaactcaggacctttggaagggcagtcactgttcctaaccattaagccatctcttcaccaccaccccaccctacttttatttcctaatgacaaattttaaccaaaaccttttccatcagccccacggggatgaggcaatgctcgggccagtgaagcttgtttgtctggttcaagtgcacagacttccatggtctcaccatggtctcaccaggtcaagggtggggttggagcacccagaggtgcatgccctcaaaccttcttggcacatgcgctcaaaccttcttggggaaacctctcttagtggatgtctctccaatctcatgaactttgctgcatatagtattaactgctagcctgggacaagggctcagacagcttatccatcaggcggtaacatattttgttctggtgccataacaaaacccgtggccagtagggcggccatgcagccctcgagcagctccctggccccagcccatcttcctgctgctacactgcagagagaaatggcggtgtggtgtggtggcaccaggggactggagttgccgatcctcccccctggccccgagaggaaactcagctcttctgcacatactggcaatgcaagtcccttaacggtgctccactcttcctggatagggaggagcataccaggatgaagaagatcgggggaggggctgctactggaaaagtccaccacagccaaagcaagggcagaaagaagcaagagactgggcagaccggaagggcggaagggcggaagggctgcccgtaggctggctcagccctggagcaccagcagggacatccggcctgggaggtggcaaactttaaccagctcaccctttgcaggtctgaaagagctcacagaggtaggactggtccgatcttagaggcccagactgaggagaggcagaacagctatctcggtgtcacagaaattctacgaaaacagctccctgtgctgctactctgaggcatgtgcctcctgtctttgattgtgggtcccggtgacacacggcaggctctgtcttctccaacagggactgacagcgggcttgcttcccaccagctgctctcctgcccaagctgttaggaatgacagtgcctgatccctcctccttcatcagcgccatggagcaccccttctggccgcccccttgtcgtagctttaattactatttctcctgctccataatacaattaatctttccttctagctgagatttatgaccatagaggcccaggggatttttgagcaatttacctgtagccatggtctctgattacccacagggaattaggaagtgggtctgtgtacaaagtccacagggtatgggtatgggtataggtataggtataagtatatatgggcaaatgcttgctttagggtggcttcttgtcactgtttatgcagctatagcctttgggaccatggatggaggggaccacagagcaagtgatctattttcttaagcttccataaaaagacaggtgtgtccaacctgcttgtgggaaggcagtgggggcgtgagagcttccccagcacgactgtggcaggcccctcccagggaagggcagctaaagaaaagctaacatggggccacttccacagtcccttggaggaataagaaggacctgtcaggaaaagcaggcaggtgcattagcctggatcgtgtcaaggcagaggagtactaagcacagctccctggagacagtacccaccagggatagcagctgctgcttctcccacacctgaagccctgggaattcctcagcaccaatgtggctgctgtcagcatgtagtctcagctgtgcgcagatgtcggtagaggagaaatgggcagagagttgtgtcccctgtgcacaaagaggcattctgtgtgatgtgggaaagcaggaagcaagtcagtcaggctgccgagtttggttgataacagtggaacctgcctcttgaggtctgtgggcctaaattctggacctttctgtgtctccgagaccacagagtaacttttagctttcagtcatcatgatacaatacccaagaaagttacttaaaagtacaggccctggctcccagttgcagagatcccgacaatccacagccagctgcctccatcactgggggcttgtggtgaggacagaatgccacagcagcaggcatgctcagctctcagtgggcttgcagcacagagacaggaggggtctgggacaagacatctgcttcagacgcctgtccccagggtgctccttcagctatgaaccctctgctgtattaaccctctgacgaggctagcccaccaggatccgatctcactccaacagcgtcaccagctggcacccaagccctgggcacacaggcctcaggtggctttgcagcatttatgaaccaggctgaggcagcttgtggaaaagcctgcctctctgtaagacacttgcagctgataaagtcatatgataagtggttttggagttacaccaccaccctgtttgaaaatatactttgctgtccaaccttggtaaaaaaaaaaaataacagcaagctacctacaaggacatggccagttctagcgcctgctcttgcacctttgttttgagccatctgttgtctgactaggcccgtcccccacatccataccccaagctccgagatattttcaaaaccacgtagacgtggtgcatgtgaaaacttgaggcagagatccagccgatagggacggatctcgggaccacatctgctgtccagaggcaccagaaagagcagatgcagtgccatgtcccctccaactccagacaaggtgtgcgccagcctataaggctaaaggtcacggccgtgagctaacgtaggacacagtactggttatcccgtgtgaaatctgcatgcagtgtcttgtggtaggcacgagacctggtaacctggagagcctagcgaccagcctagcgatcacttcctcttccgagatccccaaaatgggaaaatgtgcttaggcctgcagcaggccttgattactctaaagagcctcctgatccaaagggggccacacagagcacacagtgccaacgtgcctgcctcgctttattatttaactgttagcagactagtgtaacaactcccgtgcccgtgctgatggcctgattttcctcatcttgtttcctctatttgcttaaacaccccaagtctcccccaatacctaggatatgtcaaacagcggggacactggagctgtttcatctgtggacagtcccaccgaggaggaccttactcagcctgactgctgtgccaggtcccgctctgtctggaggcaggtagactagtacagccaaggggacaggggtccatgaattctgctggccgctcccctctcctccctgagactcacaaccttcacagggtgagcctggggtggcgaacgtgtctttcctgttccccagacctcgagtttcccacgcggatggccgaactcttgtctgcttgaaggcagaggaaagagcaggtcagctctaaaatcccagctaggcactggtagcaatcaatatgaagtatgactggtctctgtgctgtgtgcataagaactgaggccctggtcccagcgagctcaaatgagaagccaccagcattccctgctcaactggcaggggtgccatcttagtggaaatattctctgtctggtctgacccagtcccactgagtgtgctaagcatgccctcgtggcccttgccacagcctttgaagtagacattagtattcccacacagaaagcccatggcggagacccacagtgaccatgtatacatcctaaccacgtgtcctctcccacagccctggtgagggcccagctttgtgaggcctgtctgtcccactaatcttcatttaattccctccccgcagcctattgtcacggagggcatccctgctgacagcccctctgtacctcctcatctgagtggcatccaagaaagggcaggaggagccgcacattagcccctcagcgtgagcgcagccattctgtgctgctctccggatgctcttatgtggcttcaacaaagagaacagctgccaagaggccacactgtccccacagaacgaacgccccaggctggcagctgcctgaatccgccaagggagacaccagccagtggagggagagggcagctcagccaggccagccctgcttttctctgtgtgtgtgtggaagctgtaattttgaaagccctcctctggttctctgtgggccagtggaagataaggaagcagcagcagctgtctggagaccagatcggtttgctataaccagcaggcagcttccctcacaaatcattgcaaccccgggcagccatttctatcctgactgcttgctgctcccagcccagacccttaggccagagtaagagaaagaaactctcctgccgccgccttgtgcattagccacaccgtcttgggtgttattcacaaagcaagatacacaggttgcttattgcttttcttcctttctttgtctgtttttgagagtctcctgttgcccaggctggcctcaaacttacaaccctcctgcctatacctcttgggtgctgggattacaggcatgccccactatggccagcactccatgtctctgggatgattataatctgaccttattgtttttaaagggggtggggaaagacttttgattttaaaacaaaaacaagaaagacctcagactcattacaggtctgtctgtctgtctatctccaggacactcaactgagtagggtggaggtgtgcctgtaaaacacgactttagactttgtctaaagctggatgttttcctgaggctggggttctagggaaatggggtttagcttttcccacaggagggtagcagtagcaaggccttgtgttggcagatagggagagctacactctcagtctttcctcctcttatatcccaaccagcaagcgatcatataggtgcctaaaatgttgcagtagactccagaggctattcagagatcactgagggcagaggtatcataggaggtggggcaggagcaaggccaggcagggcttgcactcacagcgatccttggttgggcagatcctctgacccattttagaaaggagaaaggaagtatatgattcattttgtacaaggatggttgaaaccatgacacctgaaggcagtttaggaggactggctcaaggcaggtctttaaccgcagtgtccccatattcccaccactaaagggcctactacactgaagggacatttcctagttctccaaccctgccaggctctggaaactgtgccccttcgaagagaaagctggcgacattctcagctccatgactggacacaaccccaggaatgtcacttgtcctgtgcggtcagagttctgacccctcgcatgcacacttggccgctttgtctgtccagttgatgactgcgggtcagagcagagcccacccgactgcacgccacgatgcttctacggtccttgcttccatgtacacacaacagctggcgtgtccaccagtttgggggcatcatcagtacagggggcgctccaagtttttacttgctaatttagtgtgggtaaaatggttcttcagggttggtttattttgcatctcattgattattaaaggaaactagtgccccccactcctctcttgtgtctctccagctgagttgtctgctgacatttattattctttgactatttgagtacattgagatcttgattttttttttctttttaagccaacagtgaatttttacaacaaattttcacagcagctgctacaatttttcctatgttttcacatattttctagtgtgttgtgtttgccctttaattttgtgtgtttatttgtaaaacattctcatttttttgtcatcaaatctgttgggtttccctggtagtttgaaatgtggaaagccatcctccctctgcagcactgacagagcttgaccccttctcagcttcagaccctccctctgcagcaccaacagtgcttggccccgcccaccctcgggccccgcccaccctcgggccccgcccaccctccctctgaagcctctgacagtgtttggccacgcccaccttcagtcagtctaaagcctttgactcaggactaaactcaccttagattgagctataaatcgcactttctctaaccttctgttctcttccccatcgttccagggataatccaccagatgaaaggcgattatgacacagccctgaagctccacaagacccacctgtgcatcgcccaagagctgagtgactatgcagcccaaggccgtgcctatggaaacatgggcaacgcctacaacgccctgggcatgtatgaccaggctgtcaagtaccaccgtcaagagctgcagatctccatggaagtgaatgaccgcgcctctcaggcatcgactcacgggaacctggccgtcgcctaccaggccctgggagcccatgaccgggcgctgcagcactaccagaaccacctgaacatcgcccgggagctgagagacatccagagcgaggcccgggctctcagcaaccttgggaacttccactgctcccgtggagagtatgtgcaggctgcgccctactacgagcagtacctccgtctcgctcccgacctccaggacatggagggggaagggaaggtctgccacaacctcggctatgcccactactgcctcggaaactaccaggaggcagtgaagtactatgagcaggatctggctctggccaaagaccttcacgacaaactgagccaggcgaaagcctactgcaacttgggcctggccttcaaggctctgctgaactttgctaaggccgaggagtgccagaagtacctcctgtccctagcccagtccctggataattcccaggctaagtttcgagccctagggaacctgggcgacatattcatctgcaaaaaggacataaacggtgcgataaagttctacgagcaacagttgggcttatctcaccatgtgaaagacagacggctggaggccagtgcctacgcggccctgggtactgcctatcgaatggtccagaagtacgacaaggccttgggttaccacacacaggagctggaggtctaccaggaactgagtgacctgccgggggagtgccgggcacacgggcacctggcggccgtctacatggccctcggcaaatacacaatggcgttcaagtgttaccaggagcagctggagctggggcggaagctgaaggagccgagcctggaagctcaggtgtacggcaacatgggtatcacgaagatgaacatgaatgtgatggaggacgccattggctactttgagcagcagctggccatgctgcagcagctgagcgggaacgaatctgtgctggacagaggccgggcctacggcaacctgggggattgctacgaggccctgggggactacgaggaggccatcaagtactatgagcagtacctgtctgtcgcccagagtctgaaccgcatgcaagaccaagccaaggcctaccggggtctaggaaatgggcacaggtaacgtggactgggaacgggggctagacttgtttgcaaggtggggtcgtggcaggaagggcacctgtgagctacagagcagactgcccccatcgtgcctcttattcagcttttcaacagttcaatgacttaagtgggtggtagtgtataaaggacacaccacagctcggagagggcaggttcgtgcctgagttacacccaggaatcattcagggctcagacctcacgtgtagtaaacggtgaccaagatgatgagttcacagagataggaagctgggtggagtgcctccataaaattcacattttatgaatgtgtttattagcagagcgttcggtagccacccattactcggccctatctggtaaaagagggacaggtcctgtgcaccagtcagcacccacgctgggtaccttcatagctgtccaaacagtacagcgatgctgtatgtactcaacgcatatccatctgctgtgaaacaggggaaactgaggctcaggcgatgagttccacatgcaccgacaactggctccaactgccaccaaaagccatgttcctcctgctctgtccctgagcagcacacacaaaggctgcggctgtgccggctgagggatgccccccccaagggggagactagagacggggcctcccttggaggcaggggaccagggctcctggaggggagaaagaggtcagactaatcgtcacccacagactgctccaagaaactcagggtgagcgatttatagctcctgtaagtgatttcaaaagcaccgtctaagcagtagtggaggctgggaggcccgagtcctggaccccgctatcatcgtgtctattaatatattttatgtttcctcgggggtgcgcgtcccactgaattgcaagctcctgggaaggtcactaagggatgacttttgaattgctttccagattatgaaattcctctgcatctcactctaagggcacatgatagatttttagctagagaaggagttaagagcccctatagtaagtgacagtgacgaatgcttttcattttctcaggggctttagcatgtctgcacctgcacagagtgatctcattgcttctctgtctgcatccccacagggcgacgggaagcctgcagcaggccctcgtgtgcttcgagaagaggctggtggtggcccatgagctcggggaggcctccaataaagctcaggcctacggagagctgggaagcctccacagccagttagggaactacgagcaagccatctcttgccttgaacgccagctgaacattgccagggacatgaaggaccgagccctggaaagcgatgcggcctgtggcctggggggtgtctaccagcagatgggagagtacgacacagccctgcagtaccaccagctcgacctgcagattgcagaggagacagacaaccccacatgccagggccgggcctacgggaacctgggactcacctacgagtccctgggcaccttcgagagggctgtggtctatcaggagcagcacctgagcatcgcggcgcagatgaatgacttggtggccaagaccgtgtcctacagcagcctgggaaggactcatcatgccctgcagaactattcgcaggcagtcatgtacttacaggaaggtaggcaaaagggctccaaccaggggagacacagccagtgctgtagaaggagggtcgcgcaggccctgccatccccactaggtttccctccatagttttgttttttttgttttttgggttttttttttttttggtttttcgagacagggtttctccgtgtagccctggctgtcctggaactcacttttgtagaccaggctgaccttcaaactcagaaatccacctgcctctgcctcccaagtgctgggattaaaggcatgcgccaccactgtctggctccctccatagttttaaggtgtttccctttcctgccccagctctctgcccttaatgcctcccctcctccctctcttggttttggtacctgcccctgacctgctgcccaaatagccgatacccctttggttgtcagagcggcgactggacacaggacacatcctcaccagtcggatcataagatgcaagggcatagaatcaggagggtccaccacagcaacaagcccaactgcctcgggccgtggcaaccttccagaggatacctaagcaccacggcctatggttctctgctcaagcacagcagctgctagcccagtgtctctacccggggcccggccagaccttctggtgtttgctctgagagtacacaaactgatattaaaaagctggcctggaaaccaccccctacctccgctactagagtctgccaattacctgaggctggtggggccttcctacatgagctagaatctcacagcaaaggcgttgcctttctcctccatacctggctgcccctgctctggaaatctcagaggtgcacgggcattgtgtgtaggagagggagagaggggtgtgctcactggtgaaggacttggctccaagtttgcaagggcttccacctgcagccccttaggccgcattttacttctcacagcaaaactaagatgtgccctttttgctaccttctgctttcgtttttatctttctttctttgacagtcagcacatgtcagctcatttcacatgctaggcagattctctacactgagctgcacccacagcccaagaactattccatgtctccctgtctttgtagctatgtcaccgaggcttggagaagcaccgcagtttgaccccgacccttaagttagttcattgcagagtgggctcagcccctgtctggagttgtttctgacctcacagaaactgcagggttggggcagctataccctcctgtccctcaggggacgtccccagggtgggaagcaggaggctgagtgaacaatacttccaggctggccgtggctcagcacaggcctgcagtggggaagctctgaagctgcagtcactgtcccacctctatggctcccgtgggcccctagctttgctgacattctagtattttaacggccccagtgcctagcaatggcttttgtctgaatgtgtgagacccagaattgagggtttgcagcagggaccttactactaatccccttctgaaatgccatttcccggcagcagctggctgtgttgggtcaactgtcacagaagtctgtatcagtggaaaactctgcacgttgtttgtgttgtctcttgtgacaagtctcagagaactataaaaactggtatttgaaaactccccatagtggcagacagggtttgtgggtctctagtgcactccgagcaggctcgggacactgtaaggtgcaggatggcgttctccacaagccgggcaggaggtcctgcagacctgcagcagagggccagttcagctgggagtcaccccagctttgccctgtctgccctgtgcaatggaatgctgtgtgggtctgagtctaaacaactcccagatggtgtggcttgacacgggttaactccagggctttccacccagcccttctcactctggaaaccagcaaaggaagtaggctccatccggcaactccctgaggctctactgcagtgcaggagagctggccatgcagagtggaatgtgcaggctccccgaaggcagttcgagtacgtcttccctgtggtctgtggacacccttcttgctagggatacacttggaaccaagcaaggtccctctctctcagaatttgtcttccaaggggtttgcccaaagaaccattcttctgactcagaccaaggacttgccagacttctgcactaagggtcagtgcagtgggcgctttgaaagtcgtcacacccagagccaccctggttctcccgagaacccttgtctctcatgtgaattatttacaaactcttctgttgcccactggcatgatttagactcagaatgctatttctgaactctttgagccgtgtgttttgaaatgcatcataaattaggaggcagacccctgagcggtgactcacagcagccattcagctgactcagggcctttaaaaaaaacaggaatcacaccagcccatagtgcttggcgctggcttcctgccctgacttagatgagagaggaaccctggcttatgtatacagtggaattctgggagccatgcagtggctcatgtgcagagaaccctggaatgcaggcagagtgtcagagaccaatgtagtgaccgatatgatgaactgtggctgttagacttagccgcacaaagccctagaggcggctggtgtcctgaaaacccaaagcttgctgtgagtgagtgacccactgcaggtgcctctgtggagaccatggaaatgagggcagccactcagccttccagcccacagtagcacttgctttgcaaccccgctgaggcacatcacagatgggacccagagcgtgtcggcggcttcagtcacaggagcagggtccagctgtgcaccgttctgctttcaagagacactcacgagcctctcatcagcactgcctggacagtgtcgggggagacagaaaggcatgtggtcttagcctctgtagctggctgtcaggaaaagcttttcccaggcagagatctggggatatgagtgtatcagccaggatttttcatttgcagagccaagcgttttgcatctgcgagggcagccgggtcagggaacattggttttcctgttctgcctaccctaccaacctatccactgccaacagccgtgacctgggctcctgctgcggcacctcctcacttcctgtaacactggaagcgtcctcgccccggggttgatttggcatgtcccacagccttccttacatgcatccaaagcaaaatcgccagtcggtccctgtcacctctccttacgattctctgtctgctttcaggcttaaggttagctgagcaactgggtcgaagagaagatgaagcaaaaattcgccatggtcttggtctctccctttgggcaagtggaaacctggaggaggctcagcaccaggtacgcagagctctgttccaggagctaaagcaccctccatgactgtctcagcagctgcggagttctcagggctgctggcctgtctaatgcacccagagtccctgcctgtgtagcctgagagctgtcaagattcccgctcacccacagggcagatctcttgatttctcagattctcatgttgtgcactgttgccatggttagtataaaaccacattcctccttcagtggagaggtaagatcaggatgtgtggtcattgggcttactgtccttggcggtttctagttagggcagagggtataacctctccccctttctcatagggagtccctgttgctgaagaggagtgtgttgacacactggctgtgggtggacagacgtctgcttcaaactcagcccttggctgtttggttactgagaacagtgtgccaggaaacggggattcctcatgagaccagtgaggcctgtctccagaggagcagcctgggcacaggctgggactgggtctgtgctgcagcatgctgggatgttagagtgctgagccatgagctcagaagtgttaaagattggggctgaatgtggctcagcagggaaaaccagaggatttgagttcagttcccagcatccacactgggcagcttacctctaacttcccccatagggtacccagcagcctcttctggcctccacaatcccctgcagacatgtgagcaagtgcacacccagcccacacacaccaataaaaatttaaaatcctcttctaaaaagtattaaaggcaatgaaaaggattaatgctgtcatttcctgtgtataagactcgaagtttatatcagtgcagcaacttagttttcaaagtactgctgctccctgagctattcctcaaactcctcgggaagacagagagaggacagctttcagaggaaactgaggcttagtgtcctggccagagtctgacagcgctgagtggcagagtctggagcatcttgtgtgctcttctgctccagggttctggctccatgcttccagcctgtataaatgtggagcttcagggacagggtctcccagggaaatgtcagctgtctgggcctcaaggtgtccgtgcaacagaaaccagccccatggagctaagcaaagcctggtcttgagggctatgattggctctgtgacactgggtcacttacaatctcactgcccagcctggtccatctccagtgtgcccaaggcccggggtggggcatggggaggggcagttactcttgtctggtaacagaagtagaggattttcattgctttaatcaaaccagctcctgtttgtgttgataattggttttaacgtgtccttcagcccacaagtcctaatcgtccatattccctcatctgtcaaagattggtcacgtaaactctagttaactggggctgagttaactgatttcttcagatccacaaggacctgcctggcagtcttccttttaacccctttaaaaggtgctttcaggttgtgtgcccgggtataagcaagagctgtcttgcatctccgaactgctgggtgttggttgtggacgtgagtgacagtctctgttctgtcccttgcagctttacagggcatcggccttgtttgaaacgattcggcacgaggcacagctgagcacagactacaagctctctctcttcgacctgcagacatcatcctaccaggccttgcagcgggtgctcgtcagcctaggtgagagcagctggcgtccgtgtgtgtgcctgtacacacaaagcccgtggttcggtaatcagtgcagaccataaggccacagcctgctattaaatggtcacttgttcattcagcaaagatcggcagagcagtgagggcaagtgccagtccccatgagctcagtgagcacgctctcagctgatctccaccagatgtcatgcacataggttgatgaatccagagtgacttgattggcttaaccacagcagagcaattccaattctgagagagcagagcaggtgtcactcccccacagacccctgctccaggtgtccctcccccatagaccccctgcttcaggtgtccctcccccacagacccctgttccaggtgtccctcccccacagacccctgttccaggtgtccctcccccatagaccccctgcttcaggtgtccctcccccatagaccccctgcttcaggtgtccctcccccacaaacccctgcaccatgtgtccctctgccacagactcctgtaccaggtgtccctcccccacagatccctgcaccatgtgtccctctgccacagactcctgtaccaggtgtccctccaccacagacccctgcaccatgtgtccctctgccacagactcctgtaccaggtgtccctcccccacagatccctgcaccagatgtccctctaccaacacttcaagcctcactcaggccatgtgctgagatgacactggccacttctgtttcctgagccatgtgttcttgctgctgattgattgtactctctgggcctatgtcccaggctgtgccacacacagtcagggctcttcccaactgcacccccagcctgtgtattgaaaggcagcagggcaatcaatccacagccaccctgccctgggcttttgtgttcacagtggccctttcttggaaaagcaccggagaaaagaaaatcacagagggggtattggagtttttcatttttagggatgcagttcacatttagggggcataacaatgagagctggtggcccctggtcacctcacaccatagtcctaaagcagagagacatgaatgctggccctcagctggctttctcttgtctgttaaaagacccttctagacacacccagagctggctcctaggcaatccccaaaccagccagggtggcagtgaagacagacagatagacatcacagtgttcgtgctttgagttgggtgtttgaagcctttctccccacctttgcttcccatgcatcaatgctcaggtttcctgttatgcatgggctgggatcatgcctgggatgtcatttattgccattatgatcacactgttaagtctgcccagcactttggggataattctccagtgtgtgcagaaatcatccctgctgttccagttaataagttaatagcgtaagggagggtgtttgcacgcactcacataaaccccttctttgtaaggctgcctgaacaacagggggtgaagcctctggagtcaccagagttgtggcctgggctcccagcctcagtcttgtctcctcagaccttgctctgacaacatttccatgttggtgtttaccctaaagtctgtcgtctgcagtgtgtccctcatgtgtggcttcatgttgtcaggcttcagcttccaggcagcaggaacaggtgtgcacagccctaagaggaggtagggttagaatgcagacggaaaggctgcaggaaagcttggggaagaagcagcctaagatgtacagggaactcaggcttcatttagacctttgcccagttggatgataggagcacggagtgccacaggctctcagctctgatggcaacaaaggtaccacccatacaggtggtgatagcgaacaccttggcatcaccacagtcgggatttcaccgaatctactgagctcagtgggcagctgtcagaatccctctttctgggagtgtacccgaagcagtgtacctgaaattctgccagcgctgacacagaggccgtgggtctcctccagatcagatgactggctgctcagctgctccctgagtgagcacacctgtccctctgtctcctaggccaccacgatgaagccctggccgtggcagaaaggggccggacgagagcatttgctgacctgctggtggaaaggcagacgggacaacaggactccgacccctactcacccatcaccatcgaccagatcttagagatggttaacgcacagcggggactagtgctgtactactccctggctgcaggctacctctacagctggctgcttgctcctggagcgggtaagggctctgctggagcacaggaagtgaggaggtggaggggggccgaggggggctgagcggcgccacatgtgtcagatgaaggaaaaccttaccagcagtggatatccacgatggggcatcctactagtaaaatagcccgagaaaaggtggctccttgccactggatgagaacacatccaacatgaggcctcagggcgaagcggctagaggatccgtaggcagctgctcaccagctaggagtgatccgatcattgtgacctctggtaatattatgtatcaaagtgacgatgactctcgtggtttataagtaaatcgtaagcttgaatttctgagtttaacagaatcaaattggctagtttgtttgggttttttgttttgtttttttgtttgttctgttggtggtaggttttgttttgttttactagttctgtcggaaaaaaaatctgttttaggccaggcagtgttggcgcatgcctttagtcccagcactcaggaggcagaggcaggcggatttctgagttcgaggccagcctggtctacagagtgagttccaggacagtcaggaatatacagagaaaccctgtctcaaaaaaaaaaaaaacaaacaaaaaagtctgttttagaagtgaatatcatctttggttaaatcagcactaagcatgcaggatttaatagtttcactgaatacaaaactactaagtggttgtggggccatatatatatatatatatatatatatatatatatatatatattgaataataaaatgccgatggcttcaccatgcaagggacacaccagatccaattagagtttattgactggagaagcgggtcttataattggcaatcttgaaaaatgggcttctcgcttatctgtagaaagttcagctgccagggagatgtgacaagcctctctctctgtcctcagtaaaggcgacagtgtcagccatcgccttctgtagctgctctgcgtcagcaggaccatctcctcccacaccccccatccctatccccactccctaaccctctaccccccccccacacacacacacacacagtggtgctcacctgggcttcccacaagctgcatcctcactcttccccctcaccttcctatgctgggtttaagttttgattttcctgcattaatgagcgatgtccacacctctgcccccaagaggagctcacatccatgtggacagggttggcagctggcagatgtcaagtggcggctgcattattggggacatgtctgacaggtgacatgcccagatcatgtgacagtgagccccgtgtaacaaggcacctattgtgccctttccctttctctctctctctctctctccccctccccctccccctccccctccccctccccctctccctctctctctctctctctctctctctctctctctctctgttgttaatgagactgaagctcttgccagggctgtgatccaatcagaggaccggcacacctcactgccattgaggatgctgcccaacttattgccagtaaaccactgtgggccacctccatttcacagaccatcttttccctcccttaaaccattagtggccattgaccagttggttttattttagaatggatgcatgcttatcgtggtctgcttttgcgaaatgaaaggtctttggtgacaacttccatttggccagttttgctcaggatttcagtccctgcaaggttctgatctggacacttgcacgcggatcaggaagcaggactccccagagcgttattccaaaagtgcacaggaagcagtccacagccaaggcttctgcacgtgtcatcagaagcttgcctgtgtcttgacagtgtgcgctgtgcgcagacgtggctccagtccaagaagcccgaaacctcaggctcccagcacacttggccaagaagccacgcagcacctcgttcctctctcctgcctttgcccgaactctcctgctacccaaccatgtgtgaccttgccatgtctgccttgttgcaggaatcctgaagtttcacgaacattacttgggtgataattcagtggaaagttccagtgatttccaagccggcagcagtgcagccttgcccgtagcaaccaactctacactggagcagcacatcgccagtgtccgggaggccctgggggtggagtcttactactccaggtaagaggctgtgcctagttcatcaccattccgttttgggttgggttggatgggagattttggagcaggaaatagaagcagaaacttggtgggaatcttgtgtacttatggcccttgcagtagacagtcaaatgtctgcctgccatgtgtgggcagtctctctcatctttcattacaatcccctgagctgggaaggacctccccagagctgtgggttccctgagcaggatgtggcagcgactgtaagtgtgacagtgcaggtaacatgaccgccaacttaaacagaggtggtattagcctataaacagtaaacagagtttgtgctgtggctgactgacagaatctgtacagatctgcctgttggagggctggagtgaagagggttggcctcccagataccagggctggggacagaggcagctttctatgaagagtgagaaaggagtgaactgctgctggtgtacattacaatgctggattagcctgcacgtggaaaatggtttcctctaaatacctcctaggtgtttgcaagcacccaagtcaccactggtgaccaaatgttgcacttctgtgagggagacctgaataacatctactcaacccagatagggcaccagcaacagatacattccacccaagtccagatgggtgactcaaggagttatcaggctgccttacagaacatagggaatggggatactcacagggcatggctgatccccagtagctgtatcacccaaacatcccacttcagctaccttctgcctcccaggagagagacagacactgtgggtgacagtgtgacttgtctagcacctcccaagccacatgtagcagggcaggattacttacagctggtggggaagagagtaaacggctggagtttcaggagagggaccagtggccttcattccacgagggggcatccacagaactcatcttgtgtctctgatgaagacagtgctggccgtattattcccagaggacagctgtccccagcagcagcagtccagagtcctcagtggcgaggactggtccacggcagtcagtgttggttcccggacagaacttctacttttgtctcaaatggcccagaaccatgaagcccagggtgtctctggtcccatgggcacttttcctggctccatgtgtaggcacttgttggggtgcccgtattacttatagaggggctcttccatgagaaacagaataaccactggacagtgcagcatcaaggtcagaaggggagagaatggccgcctggtccagatctcatatccaaccgaacaaagtctgtgtcacaagtgaaacggccttgtgtacaaccatgccagtgtcatggcgagggtgaatacagcgtagccctcaccaatctgttcttcattatcaaaattagcatcttgttttgagaaaataggaaagcatacaaaatgtcattttttagcttctgtttttatgagaaacaatgaacatgcactgtggttgctgggcatcccagaccggcctggctctggccttgggcagtgctgtggtgagcccaggggttgataaaacagtcaaccacaaagacacggaggtatggatgccctctgaggtttgaatcataagtgcccagaaactaggtcagaccagaggggggcaaagctgcatctgcagactgcaaagcacgtgtgccgggtgacagggctgctccctggccgacagcatagcatgcttaaagtgaaacacagggtgaagggcaggctggcagaggaaaaacagaagagagggcaagcaggcaaactaggcagggcccacctctcacggtggcgggtgactcggaatctggagtccatggcacaaggccattcccacaatgcacatgagggcaccgtgcccttgtctttacccaccaggactagagcagctgctcagcataagtccctccctgctctatgccagatactgggataatgataatcagggcggacagcccactcaccaacctacagtatggtcagcagcagagtgataaagagactaaagtcctagtgagtgtgagcaagctggtctaagcagggaaggagtgggtagcatgcaccaagatatccagaggatcctagtgagaaacttgcttctgagatcaccttattctaaacacataatgcctttggagaccccccaggccactgctcctggattctcaggtgctgggcttcttgttagcctttgagatgaccattggtctcttgggcaggagccatgcacagtggcagggttccggcttggacagcccccttgtactgaggccgctcactcaagaggtgaagcctttcttgggcaaattcaaaatgtcagcctaggtttcaaaccaaggcctggagtttgataaatgtatgggaggtacctggatgggacctgctgtgtgaaccctcttacagaggcatgggaacaactgtctactgtgcccttttctgatagcaacagagcggccacaaccagactgtctcaagccaaaccagccatcagtgaagcttagcccaccgaaaacatatgtcacctcctcctcattgtcacatgcctcgatagaaccacacatgcataagaagagatctgattttggcctttgaatgaggggcactccctgaggctagagactgagtcatgcttcttcccccatagtctcaatcagagaacatctttgagcctttcagcggtggcgtacacctttaatcccagcacttgcaagacagagacaagcagatcacttttcgaggccaacctggtgacaagtgagttctaggacagctgaggctatacagagacagaaaccctgtctcggaaaaccaaaaaggataaaaggagaaacgacaacaagaacgtctttggagttgaagctccgcactccactccaggcagggaacggggcagggcacacagttcctatgttctccgctccatgagctgtggagttctcagcacctctggaacactatggctccttgcttagtggctactttgttggactgccctgggtagctgaactctcactccgggcttccccaggcctagggtaggtaaccctgtcagccatgtgtctgcattttgtgagtttcgtggagacagcggaaaggtctgtgcatgtagcttttcctctgtaaaatcagtactggcttgtacatctggaggctaggaaggtagatgaaaagtagaacaccaaattatacaccatagttttatactgagtgaagtgtgtatgccagacacgcgtgtgtgcacgtgcttgcgagaaggcaggccatattgcacgtagacagtaagatgagggacgctggctgtatttattacactgttttcatcatttccaggttgttgtgcatgttagtgtgtatcttctacagtggccatatgttatattttaagatagaaatgaataaccacaaacaaaaaacctctgccgtccatccaaaagaaaacacagagaccttcctgtaattttaccgcacaaagaaataaacacaagtttgggagcccatcaccttatctggtcctagtagatatgttttattttccattcttgcccccattgaacaagatgcgtgcctcaatggccacgccccctcagagtcctcctcggtgagcatgccctcctcaatggccactcccaccttggtagccacgcctttgccagcagtcacacccttctcagcagccactctcataacagccaccacctctgctactacaccctccttggtggccatgccccttcagtggccacgccccctggcaatcacactcgcctcagtgaccacaccctctccagcagccacgcccctccccagctattacaccctcctcagcagccacgcccacatcagccatgcccttcccagtggccaagccctcctcaataaccatgctttcctcagcagctacatccctcaatggccacaccctccttggtggccatgccctcctctgtcccaccctgccccttgcctccaccactgcacttcacacagctgtctatctcactgtgctctgaacacctctgtctgagtatgctgtagtgacttctaatgtcacattaacatgtctcttcatggcaacagaagaagtctctgtgggaacaagtgagtctgtctgttgggccacctaaggggccacaggtgactctgaaagctacatcaccaaggacccatctagacatggatggcagctcatgaaagctgcatccctggtgtcccaatgccagttaaccttccacatcctgtatatgatagcatcccacaccatatgcctctgggggcagaggccagctgggatggggacaggaatctcaggttagggtcagatgacacccccttcccctcaggagggaatgtttcctatgaaggttgtctgcagactcatagctgctctgatttcaacatgatggggaacatgtcctgtttcaaggggagagacagaacaggacgctttccaaggatccatagtctgaatgagtctgagcctgtggggtccccactgcaccccaggcttcatcttagttcttgcactgtcaaagggcaggtgtctgaagacagaaaagatcatcaccttcctatccttccctccctgctctctaatccataagtaaatgccgtgggctctccctataacgttcaattttgagcaagccaccatggaactaaggcagaaataaaacatctggacagatctaagagactgaagggcccagctcttccagcaggggccagtccaaggccagacgatttcagtgttgaccagcgctaccactcttgaaggcacccattcacccacgcacctgtaagggaacagtcagggcaaacaacaactgtacggtcagagatacccagacaccagaacaatccagatgccacaagttaactatgaaccgatgtccaagctctggctacaaatgtctgggaaacaccagaaccagttcaacggcccttgggaaggatgccaagtcctaaccaaatgggactgagttccagaaagcaagaatggttcagaacctggaaatattaatataatgcacatcaacacgagggcagagacccaccctcagcccagctgatgaggagaagatgcttgtgacagtcttttgtgattagaaaaaaaaatatgacaggagaagaacagagagggaacctcaaccttgttacatccacactcgaggccagtcctcagccagcaggatgcacaagcacccctcactagagtcagaagcaagatggggatgctgcctcctgctgctgttacccaatgtggtacccacagtcctcgtcaatgacagggctttcagtatggacctcctaaagccccgtaggcaatgcagaaataacacagattcaaccaggtcacagggttctgagctgtgacccagagtccagtttcttggcactctcgacaaactgagatggaggtaaagactgtccaaaccgggaaaagccttccggacatcttcaccgtaactgaagtgtagccaggcttgctgtgtggaagctgctccctgggcacctgctgcagagctgggcagcctggaactggaactgatgaaggcactgatgcaatggtacctgggtggaagggctcccaaggccatgactaaagtgcaagtgcagacgaccctgctaaagggggggtgctcctccactgtgatgaaatgtcaggctctgtaagcgagtgctgtcagaatcccctcttcatgctttcctaggctcctgtcgcataagttcttttgtaaccaaaggctttttatctcaagcaccgcctgagctgtgctgcctgggtgcagcagttacagacatttattgcaaccactggggactcagcggtccctatacttgtacagcaggagccatgtccccagcccacccgctccacattaggcatagagaatggtgttggctggaggcaaggtgagccctctgctcatccgtactgtctgtactatcttgcttggttccaaggcttccagcctgctctgtgatgtgtgtactccagcgagcttgagtttgctatttgatttcttctccttccatcatgggatcccctgcattctacactgtatggcatggtcttttctataaaacttttgcacttgacggaggcaggaaagcttacacaggtaagctaggcttgctgaagcagagggtgcctgcagggtctaacccatacctacacctgcctccatcccagacaggtttagcataacatagcatatgtatggtaaaatacactccctggtctagaccgatgaggccgagccagccaccctcactgccgattctcactgaaagttggagaccaccttcctccatggaggtgaggtggagaaacaaagccagaccctaatccacttgaagccatcgcttcctccttttgtccctctcctgttgttgccttggacaccacagccaggtatagaactcaggagatctgaggggttattgcagaaaagactgcattcggtgtgagcacgttttctgtgtggatttcctacctctgttttcttctctcagacctgtttgtgtccattctgggtactctgtgagtttgattagtaatgtctggctcctctgtggggcttcaaagcccactgagagtacagactggtttggccactttccccaaggtggcacccggatcacagtcactctgaatattccctgactgggaccatgcctccccctgccccacacagggtaccccgtacccccacgtcagtactgtgttgtcataatgcattaaatccaagggcgggaaagattctcagccattgtctaaagtgcccggctacagatatgaaaaatcatcatctccaaagaaagatagctgcagacggcacagaccgaaaaaggaggagggggtgtccgtgtccgctcaatgtcctggtttcacaatggctgtcatgcatttttcttctggggtaatttttttttttttttgtattttttcttcctgcctgctgctgcttgccttgattcaatgttgagttttaacccctagagataaaaaagcaggttgtcagtgaatggtgactttgaactacaggggtcttgaatgtagaatggctgtcttcaaaggacacagagttagagttgggagagtggggaaagctgcatgtgtagctgtctttggaagcacaaggatggccctcttgctcatcctgtagtactaacactcagcgtcaatctcactgcacaggaggtagcagcggtaaccggccactccggggtttccggctggaccacgcatgtgtgtgcagctaatgtttgtgtttggcctcttcctctccaatgagacctatcttttcttcctcctggctaaagaggagagaaattgcctctttgaggcctcttctgtccacccacaggtgcctgaacctgctcagcgtggctgcatccccaggcttccaactgaagctcaacatggcttggggagttgcccacggcccccaggtacctgaatcatgacctagacttgaaatgtggccttcagtgaaggctctcaaagttgggtgctggcagccatctagggttggggagccacatgctcacattgctgagaggaagaagggagccaagcacaaggcctccgtgatcatcttcccagaggctgctgtccttttgcaaactgtggtagacttttattttcctcttctgaagcgtgcatttgttctactgggtattggttagtctcactgatcttaggagtgcagcagacgaaaacacagtgtgcaagatgggaaaacagagagagcctgttaccgagcaggctgacacctctgttgattaaagtatcttaggacaacaaatctgagaacgggagaatggctcttctcgttgagaagcaaaagttctttggtttgaaaaattattttcaaaaactgaatgtattgccctaggtcttctctgagaagcccagccttcctccagcatcaccggctccgtttccgacacgggcaggctctgtcagtcttgcacgcagctcccctgtgtgattgcctcggcaatttctgctcagccctgaaacaggcttggctccgtggcatatttgaaagacagaagcaattttaaagcagtggagacttgaagcccttgtggatcagaggaggggtggagagcaaagtgtgtggggcacagagcagagcagggtccccttcacggtgccagagcagctggttttaatcactgcagcctcaaagactgaggggtcatctggggtcagaggcagggtgccgactacgggattgctcccgtcaggatgatctaccaagactcttcagatctctgatgtgatagttttcctgcctttgagaacttcctagtgttgcccggggctgacagcagtgttaacagagatggaactggagctgccaggacactgcaacaccaagtctcactcatcgagagcaagcagaagcgctttgtggcttgaataagaaatctatgccccacgggctcctggaccccaaataggttgcattgttttagaaggtggtgagaactttaaggaggtatagtctcactggagggagtaggcaactgggggtgcgccttgaggtcacggagtctggccccactttctgtccactctgtgcttcttgattgcagacacaatgtgactggtgacctcatgcttgtcaccacaggccccactgtgccagaataaattctccctctcttagttaagttgcatttgtcagacattcggtcccagaaacatgaaaattagcatccgatcaggcagcagagatgagataaacgaggggggctctagtgagtgcagccttggggacttgcgtgagaaaacagcatgggcagttttggaagaactctcccagtggggtgactgcgcattcctgttggccaggtgctgttgggccacaggggaccaaaggggatacagaatccctgtccttgtgcacacaggtcagaggttacaagggaatgaacttcacagagctcgactgtttggtgaatgacaggcatcaaactggcccgcctccccttctctaaatagtccctgttcagtattccagagcacagaagatactgaaatcagtctaccagaccattatctgtacacacacacacacacacacacacacacacacacacacacacacacactcacacacactcacactcacagactcacactcacatccacacacatgcacgcgcacacatacaaactcatactcacattcatacacagacacatacacacaaattcatacacacatacatacacatgcacacacaaagactcagtctctcttttctctctctctctctctctctctctctctctcacacacacacacacacacacacacacacacacactcactcttcctttctcctctgggtactggtgctgctgagaggaagccagtgcacaccttactatatggtatggacccttgtttcttcatacaagaaaaagaaatgaataaattggcccagccctgtctctgcctaatgctagctgtgtggctgttattgagcagtaaattctcacggggtttttgtagcagtagcatagagagagaggaaacatacaaagataagacacagaaatcctgacaagcagaaaaaacagagctgagcctgtaaggcagcgccagggatttgcctgtggtttaggaggccataaggggaccaggcacagggcttccacccgcagcacctggctgcaggaggaggggtgtggctttcactaaaggacccggagctcccagccatccagagagtgcaggctctccttgtcctcttcttgctcagcctctttactgcagtgtactgtatgacttggctacttgctgggcgagcgagctcaggagtgggacttaccaaagctgaggtcacgggagtgcggtgtggatggtggctgcagagctgggctgggaggggctggtcacagtgcacaaagtagacatggagatccagatgtggcatgaggactattccaggtgatactgtgttgagacagacatcggggccccagtgctcctacaccccacactttacacaggtgttgggagtgggtgactgtgcacaggttagcagttcacatgtcatcaattgtgccagtcctttcaagtgtacacacctatccaggtgtccccacacaccttggataatagttcctatccgtcatttcccccatgataaagctgaagtaaatggaaatatttccatattttgaatcctggaagacagttaagtcatgtcgaggcactggccacgtggctcagccagtaaaggtgctcgtcaccaagtgtgactgctggagttcagtctcagaacctatgtggtagaaagagagaaccaagtcccacagttgtcctctgatctacacacacacacacacacacacacacacacacagtcacacacatacacacatgcacacacaacacacatcacacactacacacactcatacacaccacacatcacacactcacaccacacactctcacacacacactcacacattcacacacatcacacacacattcacacacatcacactacacacacacataaacacacacattcacacacttatacatatcacacacacattcacacatgtatacatatcacacaccacacatcacacactacaaacactcatcatacactacacacactcacacacactacacccatgtaagtaagggctagagcgagagctctgctgttgagagcacttgtcaatcttgcagaggacgcaagttcagttcccagccctcacatggtggttcataaccacacatacctccatcccagagacttcagtgcctgcttctggcctccatgtgcaccaggaacacatgtggtaaacatatgtgcccgtaacggactcatatacgcaaactagtaaataaacataaactgaggagtattcctgcattaagaagaaagtccatgaggctagagaaatggctcagcagttaagagcactggctgctcttccaaaggtcctgggttcaattcccagcaaccacatggtggctcacaaccatctgtaatgagatctgatgccttcttctggtgtgtctgaagatagtgacagtgtactcatatacataaaataaataaatcttaggaggaggaggaggaggaggaggaagtggtggtcctggaggtggtccatactccccacagggaaaggcttcatttctggatctagagaaaatcagacaattcatactgcagcttcatgcatcaagtgctgtgggaatgaagcatgtgcagaactcgcagctccctggccacgctttgggtgtgttggcatgtgctggctgtgaggatggcatcccgggagtctgagggttagccatacccttctctggccaggctctgccctggagcctgaagtctggagtgtcctcggctctaccggcgttcttctagaagaagaacacggcctcctcttgctgaaggatccaccgggctcttctagaagaagaacacggcctcctcttgctgaaggatccaccgggctcttctagaagaagaacacggcctcctcttgctgaaggatccaccgggctcttctagaagaagaacacggcctcctcttgctgaaggatccaccgggctgttgtgcttgggcagctgtgacactggggatacggggcgcgggggggggggcgggggtgctgcagctgattatagaaaacgcattttcttaatctgtgagaccttacatggtgttttcttaaaaagaaaataatccgagtatgtctgcctgccccttggtggccctgccagctggctgttcatgagactagtgagctggtggggtggcctgagaggtgcatcaggtcaggcaagttagagacgcccagtgacccaggggcggcaaggggtggggtgtgcagatgctgtgggagaggatctagttttcttcagaagaatcttatctctgaaggaagtaccgtcacctcacgaaggccactttggtcagagcacccacgggtctgtaactgccagggtgactcaaaaggccaactgacctgccctgttgaactgaggaggctcagcagcttctgcctgctgctgtccatgagggctggcttccaggagcctcagagaaagccacacattcctctgtggctgtgggctgccaagctgagcccagagtcacagatgtgggagaaatcttagctaaggatgtttgaactctgagctctgtctgagttgcttcctaggagagtcctcacactggagccgagcacagtagttcacactggagcccaggggtcagagcattcacactggggtccagtcagagtcagtacctgctttagaaagaaagtggtactttttaaaggaatgtaacagaggccctgtggttaccactccggatgcctgtgattatgacagacttcacaatagaaagaatctgggccaatacaactcacttatacaagaaagggcagccaactattgccatccctgagatgactcagaagttgaaaatctgcaggaaagggtttcccagcagtcaccgccacacgcaatcagctgtgctcacggtgaaaagaacatgccaaaggttccatcatcgacgcagagacttctaaaaataccagcgaagggtctgtgtctaaacacacagcctctgaggtgaagagccccgtcctggcagaggtagcatgggaaccgtttgggaggcagagctgagagaagaaaccagagggccccatgagcaaggcgaaaggcagcagcaaacaccaacgcctgggcgtcacagacacctgcaagcgaggctgagagcctccgagggcatcagagaggtctagacagcccgctgtccttggctagggacgcctccaaagcatgcacactgttgatcccggctctacaaacagccaaggaacaaaccaaaccctccaagaacaaaagcagaatgaagctgctcttaggcggcagggcccgcatgggaaggggacacactctttttttttttttttttttctctttctttttttttttccattttttattaggtatttagttcatttacatttccaatgctataccaaaagtcccccatacccacccacccccactcccctgcccacccactccccctttttggccctggcgttcccctgtactggggcatataaagtttgcctgaccaatgggcctctctttccactgatggccgactaggccatcttttgatacatatgcagctagagtcaagagctctggggtactggttagttcataatgttgttccatcgatagggttgcagatccctttagctccttggatactttctctagctcctccattgggagccctgtggtccatccattagctgactgtgagcatccacttctgtgtttgctaggccccggcatagtctcacaagagacagctacatctgggtcctttcaataaaatcttgctagtgtatgcaatggtgtcagcgtttggatgctgattatggagtggatccccggatatggcagtctctacatggtccatcctttcatctcagctccaaactttgtctctgtaactccttccatgggtgttttgttcccaattctaaggaggggcatagggcacacactcttgaggctgaagtgagtgtgtgccttgagagcaggccctcagagaaggagcagagaggagaaagggggctaaaggatggggttgtctttttctattctacggaaagtattttttccatataatatattctgatcacggtttccctcccccatctcctgagcctctctgaccttccaacttcactccttctctctctctctagaaaaagagcaggcaaataaaaagaaaaacataaaaatatacacataaaaacccattatctataaaaaccccaaatcagaatccatgacccacaaaccgaagaccagtaagattaaaagaatgaaagccaaacagagcaacgtaagacagaaggcattcaaacacactgctgagctcattttgggtcggctgcccactgctgggtacagggcctgtccttaagtatggtttgtatacccagtgagactccatcgaataagctaaatttctgttgtaagcagttgtcagttagagtgcctgggttagggatgggagctggagcccacttctctcagagctctgggaccccacctgtcttagacccgtgcaggccctgtgcacactgccccatctccctgtgtgtctgtgcgcatcaatcatgttgacttcgaatggccttgtgtccgtggtgacctgcgtctcctctggctctcatgttccctctcctcctctgcagagctctctgagccctgaggggtggggtttgatgcggacagcccacttaggactcagcgctccaaagtctcaccctctacacattgtccagttatgggtctctgtgttagctcccaacacaggacgaagcttctctgatggtggctgagcgaggcgcttacttatgggtgtagcagaatggcgttcttattttttaagtatatgaaattttgtgtgtgtgtgtatatatatgtaatacatatataatttatattatatataaacagtcatatttccctggggtgttcacaatgaaagctcaataaaactaggagagacagacagacagacagacagacagacagacagactcttcaagaccaggaaactgggagaagcgtcaaacttgtggcatataagagtaggagaatgttatgaactttgaaccaaatgtgcaactaagatgaaacacagaaatttcttaaaatcccattcgaccaaaaccaacaccacatcaaacagaatatgaaaggccctggatgtgcttcagaaattaaagtccttatcacgcactttaactccaccgtaaattcactcaagtcctagaagatttctctaatgaagtctacagagtattcagaataaaagcctgcagggctgggattgtagctcagcacagagtgctcgcctggtgtgtaaaaagccctgggttcggtctctagcaccaggaaaaaatgttaaagaacagtttataccaaagtcatcttgaaacagtagaacagagtcctttacacctccacacaaggtttatgtctgcctcgtgcacagcagcatggacagctgtgacagacaccctttgccctgcaagcctgctggagagatggctcttaagtggttaagagccctggctgtactccagaggaccagggttcaattgtcagcacctacatggcactaacaaccctctgtaactccagttccagaagatctaatgcccacttctgactttcgcatgcagcaggcatgtatgaggtacacacgtatgcaggcaaacaccactatgtgataaaatattaataataataataatatctaaagcaaccttgatagagaataacctccctggagaatacacaccatgtgtctcccagcctcactgtaaagctgtgacagtcacggctaaccacttggaatcccagcccttgggagaaccaggagttccaggccagcaagggctacatagtgagctctggcctctgaggaacaaatgtctgactgtggtatcctgagtgactgaccctggagcaggatgcgagatgagaaacaggtcctacttatactcttacttgatttcggcaaagtcatcccataatatactgggaagaggcagtctctccagccaacggtcctgatgggactgagctgtgtctgggggaaattagtctcaaccctcgtgtcaaacacaaaagacaacagttaaacctgcgcacgcaccattgagaggcgcacgctgggtgtattcctgagttagagcaacaggtaacagaaaccagcagaaaatgacccacaacgtgaacaaaagtatgtcaggcatcgcaattacatactgacactcatatgagcaggcaggtgagcaggcgggccacacctcacacggctgacagggggctcaaaatattcaaagagccttgtgactcactaaaatacaaacagcaagtagaatcttaaaagttatgcagtatgtcactagtcatttagggagtgtgactggaaccatagggaactcctgggaggggtaagatgacaaaaactgacctcacagatgccaggaggaagcagagggagaagacaatgtgcattgttagtgactgtggccttgtaaccaccctgtgaagcctccagccattgcaatgatgccagtatcctcactgtgggcacgtaacccactctgaccctcaccatgggcatgtgacccactctgaccctcactgtgggtgagggacccacactgaccctcactgtgggcatgtgacccactctgacctttaagtgattcacactctgaccctcactgtgtgtgtgggacccactctgatgctcactgtgggtgtaggacccactctgaccctcactgtgggcacaagatccactctgaccctcaccatgggcatgtaacccactctgaccctcactgtgggcacaagatccactctgaccctcactgtgagcgtgttactccactgcccaggagaaaggagaacctctaatgacagagacttccacaaggatggcagttttgtgcctcatgcctgcagcaggccatcagcctgacaatgctcagaatgctgtgtgatcagggtgtggtcaaagggtatgaactaaatgagaacatcaaaggtgaaatccagaaaccctgtggtgaaggacagcaagccaaagggaaggccagttgctatgggaccatgacctctgcctcaggcacagcttcagtaatctctgtagggaaaaggcagggcaaaggcggcctccaatatggaggccaaaactgaaactttgtttctttatagggtttttagcacaatgtccctgtctgactcggtgtaagttaagatttgtcaagttcattttttgtagttctgtgcatatattttatattagggtgcatatactagtattgctctccagccctgatatgccttgtgaggtatttgaaagaacattagctgtaatccagtgtaagttatttaaactgcacccaggtaggaaattatgcagatgactggaaagagcaaagacagctgggtaggcaggcagtaagcatcagggatggcgagatgtggctgagaggcgtctcagtattctctctaagaatctttaagctttcccatagctttaatttttttcatcataaaaattttggaaaatatacaaagcagtgtggacagatgatcttaaaaatgcagagtatccactcctgagttcaacttaaagaaatctaagtgagtcttccatgggaggctgattgtcagtctatctacctggcgtgcctgcgtacctatgctcactgtggccctgttcataaaagccaagatttggggccagcctagcctagacaaatggataaaggatatgtagcatatgtatacactgttttattaagccatgaagaacacacctacatcactctaagggaaacggatggatctggaggtcatcgtgttaggtgcactaagtcagacttggaaaggcaagtgatgtgctcttatgtgcagtctacatggcaacaggaaaggaggagcttagagggaacaacctggagtcacgtgatcagagggaccatcaactggggaactgtctagatcagactggccatggccatgtctgtgaggtgccttgactgtcgtgggaatgcctggcccaccgttggtggcaccatccctatgcaggtgggcctgggctacgagaaagctaacttatgagcacccagagagcagctttcctctgtggttcctgctttgagttcccgccttgacctccctcagtgatgcattatgacctggaagtgtaagccaaacaaaccctttccttcccaatttgcccttagactcggtatttatcccagtaaccaaaacgcaactagaacatcacttgtgggggctgaggtgaggcttcggtccaaggccagcctggtctatagagggagacgtgaagtgcccatgtgcaaaggcagcagaggccatcgggctgcacagtgactgcacacagctgtgcctgtgcatcctgtagtaggaagcattagaagtgagggattggtgctagacaggtatgtgtgcatatttcaggggagagcatcgagcatgcgatgtccagtgcacactggagacagcttccacggggcaaaagtaacatcaacagagcctggtgagacagacccatgccaagcaggtagtctgacagcgagcctcccacggactactactggtcacaaccggtgagggaacagaacaagctgtggaaaatagtgtgaagcctaaaaccacatcctaggaccactagtttctagctgcgatgcttggagcaagttgtccacccacacccctttctcattcgccagtgcggaccctcatccccaccttgaggcacggtcaggcatcgtgagcccctcccagcacagccctttcctacagcctgtgcagcagaggctgatcttcctgcccttcctacttcccagaccctctgggccctgcaagggctgccttcccctcagcatgggtcccttctgttgtccgtccaaggaccccaggaactggtggcacttgtccgtgtgtccttccttgagaggtatactcactcttggttatgtccatcttgcctcttctaactgcaccactgggaaaccacccccacccccacccccgtgtcactcactatctctagaccttggatctggaagcaaaggttgtgtgactgactatgactgcacagaagggctcagtgtgtctcgcatgaaggagctggcaagtgggcatggccagggctccctgccttctcattcagtgagtctgtggagtgcggggacgatcgtcactccaccgcctgctgtggtgtgctcacccccacaaacatgcagccgcaggagcctgcgctgcccagttccaccacaagacgtggccacagaagctcactggattcaaagatagggaagctctctgtattgtgggctctctttcagctatttttctttttttaacaccacgattccatttaagacctggaagggatctgagattttatgcaattaaaccccaaaatgttggccggtcagtaagagactgaatgggattattaagggagcctcactcctctatggaaaaggcacccagagaactgttatccatgagaagagacatgggttgtctagagagagcccagaacaacccagtggtacagagcagcgtaactagtgacggggtggcagtgctggcgggaagccggctgcatgtcagggttagcacatggcttggaagccacccccactctgcctctgtcaaaccccgccttacccttgaaccgatcctctctcctctgctctttcttctgggctgtgcctcaaatgctgactttaaaaatcaaatccaaatgccatgcttggcgctctccactggcccagaaacgctggttctgcaccgtgtgtggcatacatatcagccagcggagaccgcctcagacccaggaggaatctttggcccagcctcagcctgatctgtgcaggtcttcaagtcggcccaggctcactgcgaggcctcatcccagtgtataccagcgcagatctttagtccatccggtctcagagatgagctcaagccaacctctgaccactgcacatcagagtgtttttgtttgcatctaagggaggaattccttaactcatccgggccagaaaaccagtgtgtcctgccgcaggctagaccctctgctctgtgaacatgtgcgcagctcctcaaagcagacacgtctgcagagcacattgctgcttcctttcctaggcattgtcgccctgtactttctactctctaatcattacatgggaaaagatgacacagagcttcaggagctgaggcaggaggatcaggggttggatgttagctggagtcatacagaacccatcgtgtgggttggggagaaaagcagaaaagagggaaggatctcacctgccccaaaaccgaccactgtcctgcacccacagagttggggggggtgtcagcgatttgcgacccagcagtaagctggagaggatgggctacacaggcggcagcagttgttcttggagcattgctttgcaattcgcacaacaaaaatacctacagaactcaagctgccactgcccttgctctttgcattaattttccaacattctgtgccccacccccacccgtggaatcatagggatttgtttctctcaatgcaaagtcccctgtcccaccctgaatggaaactacttttcttatttggtttctcaacaagccactacccaattgtgctgctttaagcatggaaacaaacaaacaaaacaacaataacaaaaacctgcagagccctggtagaataatttggatccagagggactcgtgcagataggaccaccaagagaagccaggccaccctgttcccagtaggcacgacacgcatggcctctgccccttggctctcaccagtgtctgctttccaagccccacagagcagaagctggcttgcagcatggctgtcaggccgatgcatctgtgagtgctgtaggcagcctcttgagcagctcctttgcctctcctgctgcaaagccagaaacaaatatttagctggctgcagagagccattcacatgagtgctgtccccctgggggtcttctgcacacagcgcctggctgctccttccacgtgacacaggacatataatatatttatgtctggtgtaaccatagaaacctgttgtatccgtgaagacattgcaattctgcttctcaccagaaagacggataaagccccagggcagccgccactgctgcaggctgcattcagtagtggccacatctgcggactttaacaaagtatcagatagacacaaggaggtaaaaactgctctgggtgttcttttagatgctggagccaaaccatcattttctctcatcacccacacagcttgcacttcattacttatcccgaagacagtggtcatgtttgtgtgacttcctctagggagtcagaggcataaggcaaatatacatttgtcatacaattgtacaattgttggctttcagagaacacagtgtggccattgaaaggggtggaaatgatgctggtctaacccaggctccttcattccctggatgcagcagtaaggtctgccttcctggtcactgtgaggaaggcagtcatttaagagaaaggcccagtccacagcagccgtggcactggctggtggcactgccccagtcttcatttcctttttttggtcccctgcaggggtcgtaatgcctgaaaaagctagcttttgttagcgcatctacgttgcctcaatacttaccaaagcctgcttcacaaatatttattaattataaaacccccaagggagacatggaatatcaatcccacctcttttccaattaattctgcacctttccatttggcaaatatgtatgttttgtggctcttaatagagcaaggaaccctttggctcttttgtctgtgcagtggcttgttgttggctctgtgtgtgtgtgtgtgtgtgtgtgtgtgtgtgtgtgtgtgtgtgtgtgtgtgtgtgatttaaaggaatttatccatggaagctcccagtgcagctgagagatgacttgggcgacatctgctggctggctggagaagtaggctgctccacagaaccaaaagccatgcccttaccccaggccctaagtaaatcctaaatctacagggcccggtggactgtgggtggtaggtacaatcatagctaagaaggcagggcatttacacttactgttattattttctttattattgttatttaaatggcagtattagaaagcaggggatgtttcccaccagctaataaccatttaagttgcatttgggggctttcatgacttgacgacagcttctcaaaatcgccgggctgttaaaccccctactgggttaatgtggcagaaaaagacaagaagggcgcttctgtgcggaggcctctctggtgtctggggggtggggaggggagcaggtcttttcagaaaatccaattagagggagagaggggaagaaccccccagtgccccaggcagacactcagccttcaggcaggaaagcagtatagacaggaacctgcctctacccaaagctcattggagacagagggtctctatcctgaatgcaagggtgtggacgcttatcctaaccactcccaaggaggagtaccggccaccttttccccagactcccctaaccagtgtgggtattcaactgactattccaaggaagactgagagaatagccaataactctagagattgccaccgcttctttagagactgtcttctacacaaatgcccctctcccaggggttgcccaaaattggggcaccactgttaagtggtctcattttcaaaccaagtagactgggtctggtggctctcagtggaatccttttgtgcataaattttaaaggtgggctgcttgcctagagtcagaatcctgcacaaagctgctacataccacacaattctgttgcagctatctagtgcgtatttgctgtgctgcatggggtgtcgtgtgtagagcagctctgagggctctgcccagtatgctcctgagctgtgggactcccttctcagtggtcactgtgacttcctccttacacaggggtttcagaagtcactcagcactttactgtgactttcatccgtgcaattgtggggggggacagaaggctctgaagagacttcagaaggtttcctcttcttcgtgccacaccccctccataccacacccacatataagcctcctacacagcgcctgggggcattccggcacatctgttcctgtactcttggactcctggactcttggtgaacaagggctttgaatggacttggaaggccattccggttgaggtggtccttctgtgctttgtaggatagaatccaatgaagatgaacccatacatagtgtatagtgagggatctcgtgctgcggaaagctgaagggatggggcagctgcctggtgagcctggagcttctatcctgagtgattccgagtcaccacctgtacctctgagggcgagggcagcacaagaaggctgtctcgaagcttaccttcccttggctgttctgacactgctcccagtggagcaggctctcctacctggcttttgccacgaggtttaatgacagtgttctaggagggcctcgacatcaagcagccaagctcagctgctgtaactgctcatgattcctgacagccaagagttggagctcacggtcgtctgtgaggcccagagctcctatctgggaggggtgcctgatgctctccgtgctcacacatgcacacccaccttccccctgtggcatgatgtgatatggggctgtcacaaacccttaaaaatcccatccagagtggagggaaaagccagtgccatgggcttgaggcccggcagcatccaagagcacagtgtcccctatggtcccagagtcagtcctatgacaagcaaacgctgtcttccagagacactcaggggaagccccttctaggttctactgaggaactgggagaaagggatcctgggatcactgtgaatccagcagaattttgttttccagtggctgagtggttctcctgggtagataggagccccatgtgccatgaagtttctggttctgtcagccccacaatgctgggcagtgtgtgtgacccagacacaggtagtgacatccaagaggccctcagaagtctatgctgagcttggccagagtccaggcctttgggcaccagagcccagtgacccactgagctgtgtttcctaggtgattccaacccagttaatccagcaaagaagaggcccaataccaaggaactattttaaattaatttctttatgataaataagtgtttgatttatacacctatcttatatatccctgtacccaaagtcacagaggaaaaaaaaattgggggggggggcaaaaagtggtctcaagagccatggccagggtccaaaggttaaaggtgtttgctgcacgagccccatgacctggattcaacacccagagcccatgtaaagactgaaggagaaaactgactccacagttgttctctgacctccatatgcactttgacatgcacatgctccccatacacaggctcgcacacacatccacacgtcaggcatgtatacacacacacacatccacacgtcaggcagcgcacacacatctgcacatcatgcacaaacatatccacacatcatgcatgcacacacatatcaggcatggctctttccccactctttccccccctccataaatatataagtggttttctttttttaaagatttatttatttatatgagtacactgtagctgtttatagatacatcagaagagggcatcagatcccattacagatggttgtgagccaccatgtggttgctgggaattgaactcaggacccatctccagccccaatacataaaagtgttttacaaaggaatctggtgatttgaataggaaaagtccccatgttgtttagatgtttggcccacagggagcagcattaggaggtgtgacagtcttggaggaggcgtggccttgttggaggaagcatgtcactatgggtgtgggctttaaggtttcctaggctcaggttccaccaggtgtggaatgagagcctcctcctggctgtctgcagagggtagtcccttgatactgcctgcagatcaagatgtaggatcaagatcagttcctcctccaggatagatgctgccatgcttcccgccatgatgataatggactgaatctctgaaactgtaagcccgtccagttaactgttttcctttataagagttgtcttggtcatggtgtctcttcacagcaattaaatcttaattaagaccgaattccaaatacaagaactgcacaaactgtacaaagccttgtagtgatgaccatggtccggacaccaggcttcacaccagtctggggtgatggagtctggactgtggggccttgaacaggtgggttgctgtctctcctgtgtccttcctagcctgacccttgtcatttccagctcatcttagaggccactcaggacggtccgaccttaccccagatgttggcacttggtgtgcttgtagcgcttattcagctggtcctctctgccctctgtggagtgggcccttcagctctccccagaatcccagtctttatagatttaccacagaaaaaaaagcatctcccacacagcaagaatggcagctgaccagggcctgcaggaccccttctatggaatggggaacagggcagttctgtctgcaggttggaatggaaggcaagatcttcctctctactgtacctaggggccaggggaatctccaggacaaacaaacaaagaactagccctggtcacacacttcatcaagtcagggatgaagctgttctggacacctcttctcagtatgctatggtgtcatgggccgggtctggctccctcagcttcctgaacctgggcctgtctgcttctccacctcccactcaccaccaccaaggcaggagagagaatgcacagggccactcttacctgctgtactggctagttttatgtcaacttgacacaggctggagttatcacagagaaaggggcttccatgacatccagctgcaaggtgttttctcaattagtcatcaagtggggagatccccttgtggttagtgccatctctgggctggtagtcttggttctataagagagcaggctgagcaagccaggggaagcaagccagtaaagaacatccctccatggcctctgtatcagctcctgcttcctgacctgcttgaattccagtcctgactctctttggtgataacagcaatgtggagctgaataaaccctttcctccccaacttgcttcttggtcatgatgttttgtccaggaataaaaaccctgactaagacccctggcaaagtggcttccaggactctggttgcagtggctccttggaggtaccttgcagtcactgagcctggtagtcacctctgctcctctcagcctttctcagcctctggtgctggagacatttcccctggccttgatgggtggctgtgtgggactgagactgagcagaaccacactgggtctctaggaagtgctctgtcctccctgatcccagtcaccacagggggtggggccctcattggcctggcctctggtgagcagaggtgagtggactgggagtggactctgtagggtcgaggtcagggtgcccctcctattcccagaggggtaaggcagtgacaggctgtagcactcgtgtgtctttgttccctcctctttggccacaaactccactaacagggactagaagtccaagacaatactcaaagccttttcctgtaattgcctataagggaagaggtccagttccatgactttctgtgttgacatttcattttctgtatacatggctcaggcacacatgcacacacagcatgcatgcacatgtgcacacacacacacacacacacacacgcacacacacacaggatatcaatgcatgcttgctctatgggcgtggggcagggcctctgagtcttcccttgcccacatctgtcagtggtaaatgattaccacaggaaaacatagcagattaagtgactgcactgtttcttatggctttcggcatttgcaccaagggatgcatgcactgcgagaatcgataaaatctccagaaaggacttgtagtgacacacggtaacaagtgtcacatgcacagtgtgccttctgctgcagactctcacatacgctcccgtatggcactcagaacagtccctgagtgaagcagcagatgtgcaccgaagtgcgtgtgcctccgattcctgcacgacccttgcaggaacaaccggagtgggaaggaaacatgtcccttcagggcccttcacacctgccaagtgctgtgtaccactgcccatccctactcctctcctgcaggtgactagcctggttcacctgcagggaggagggtctgctggtcttaggtcccaggaacatatctggaagggtgtgattccaccccatcacccaggtgttcccacagggactgcactgggctctgtccacgtcacacatcaactcagaggatgcataagacgtatttcagggggagtgccattgactatacactcccagcaaagacctaaaaacgagacaccaagaaatgaggcttccgctcaattacagctttgtgttccctgctggctgactgtggagctgacaggaaacaagcctcagccgtttgatcactgtatttactgaaagcagaaaagctaggccaagaccgtgagctcctcccctcagcactggagttcagaccagatcactccaggccacggagacagacttcacagagctctgggcttcaagtgattttctctcaaaagcacttggaaggccatttttattcttttatcagcgtgacagtcaaggggcaagtcaggatgtggggggaggagtgtggagggagccgaagggaggagggagagggggaggagtgtggagggagccgaggggaggagggagagaggggaggaggtgaagagagggagggagagaaaaacaagggaagagaatgtgaacgagaacacagtctcctgtcaggtaaatgtaataatccactttcagacatccaggtttctggcatcatttagagataacactaaagtaactgggttttggctttatggaggacagccatttctcgagtgactcgaagcagaagcctttcccaggagactcagggaggggaagcacattagtgactggattgctgaggagggccaggctgtgaacaaggagggtttgacatcagagtctgtggccactgtgcagtgcatggctacgaggtctggggtgtgtgacatcagctaaggagagagcagcctgggcaggagtccctgcatctatttctgtgcacactcaagcgcctctctcttgaccgtctctggtctcaatggtgtcatagcaacaggctgtactactgctagtttggtgcagcaagggcacagaggtctctggggacactgcccctccttaccagtcctctccaaggcttaaacagaagaggggctttctagtaaggttaaggggctcaacgaactgcagcttagccttgtaatgtaagaggaaagctgggacccctgggctatgcgggcaaggctacccattactgttctagagcaggaagatggccaccttctgtgtttgtgtttatacacagtctaaagccagcctcaggtaaccacatcccctgggtgtggacgctaaaaggaacgtagctatctatgatggggtgcctcctgcactgacccttccccctctccagcaagatgtcctgccgagacagcccatgcagtgggatgtccctaccaaagtgaaggccagacccttcccatcttataggtcagctagaattaactgtgaaatagcagaggggctgcctgagggagcacacctgatgcccagcttcctacacgttctcaagagcatcccccccccaagaaacgtgcaaggcatttggtcctgaggacaggcaggggtctcggaggcactgaacttgtgcggtgatagcagagagctccctcagtgggaaggagagctttgctttgaaagaaccacccttctgtgaccatggggcttgaggccaggagcttgcctctccaccctgagcacagggcctgaggaccagtctcttgcggccatctccagctcaggattggaagtcgctcttcagcaagcaactgctcattggtacaagagaagctttgaggcggggactcaagatgagttagcaagagatgctgggatgtaaacagggccatgccagtgccgagctcctgcccggctgatggacaacatgctcacagggatcaggaggctgagtttctgagcagaaatcctttttggagcttcctgccattcccgtctattcccggtgcaggatgagccctggcacagctccacagcactgattcatggctgtctcttggagggtcacaactgtgagcatcttggaacccaccatggccagcatgttttatcctcacgacagtagcaggctgggctctggcagggctgggtcaggttccagcaggataggtgggcgccttggagagagtgctgtggagcctgccttgttctctcctcctttcctgccctcaccaggatgccagcttctgctgtggctttgccttctgtcctccatagcatggtgatctccgtatcaacctctgctaaccccacaggacaggcagggggctggagcaagaacagagcccttgccatcccttggggacccaggagtagagacggccagggtaagaaatcaagctagaacccttatgtgtagagagcctcaaaacaaaaagagcaagagtggtgggccaaggccatcagagtaggactagagcatggtggacaggacagagagcaagcactgcaaaaagggacactggccttggtgcccacggcatagatgaccagggcctcccttccactgctcctggccacacccatcctgaagcctccctaccttccctgccgagctgcaactagttctgtctgaaactctgcctaccgatgatccttctgtctcttctactgtggccgtcagaagagtgaccaagaccaggcccagacggtggtgaaggctttccacacagcacctgtggcagattcctgcctgctcactggcactcccatctcacccccaccctggctgctcctgcagcattcactggggaacatagtagtacagagtgctattcctgtgtaaaggtttccatgatcatcagcaccatctctgagcctctccagggcagccccagctaaggatctgctacataccagttgctcaatgaaaggagacttttttacatagggtcttagcaggtcgaagcaggccttgaacgcacgactctcctgcctcaacctcccaagagtggagattgcaggcatataccaccacctagtgtactttttcttactctcgctattgggtaaactgctctttcagtttgctggggtcaggaatacaagactactctgtcatttcaacaaggaacatttaagactctagaaagtgtgaatgaatcacatagagacgcaagctctggagaatataagtcacactggagactcggccctcacgtgtgagccccaaggtctcactctggacatttccagatgtgaatgtgacctgggcctgatgctgagtctgggtccaggaggccataggcagagagaatggtgggatggtgatttgggcatcattgtggtcctctgtatccccctgcacagcacacagcaggacatgaagcaagcctgtagtcattttatttataaatcagggctctgctgcacatgtctgtcacgggggagggggctatgaatgaattccaaactggtcgcatactcaagttccacccagggaagggacccaagaagccagtgctatccatcaaaaccatccgtgactgtctccccatctcagactagccccatgcttggtacagtacaggtgatcagcaaatgtttctagaatggattagaataaacctgtgctagggattgccccactaaaacacagcctggacagagtgcctgctcctccagcatgtgctcaatgctagggcacacactgttcaaacactgctccatctgcacagttcattgttgctgtgtagacggtacaggcaccagcgagccacaatgtggaaggcagtgggggcgcttagcatcaggaggacgactccacagtaatggcgcctctctggtggttttccacagggcctgtgccagcagtgagacagaaagcgaagctggagacatcatggaacagcagttggaggagatgaacaagcagcttaactcggtaaccgaccccacgggcttcctgaggatggtgcgccacaacaacctcctgcacaggtatggatggcgctcagccccaaacacaaggtgctccctgcagcacgtgtccctgtgctccttccgtgggacacggagctatagcagcaagcctggtgctttgcctctgtaccaacaattcagatggaggcggtgcaggctctccaccttcctgtttttaatacagtggagtccagggttgttggcctgccatgccaagtctgagctgcctgcccagcctcaggaagaagttgagtagctctcacctctctgccagcttctctcaggcctacaactcaggaggccaaaaggagccaagaagccagcagggtgggagacagaagtggcccagaaatgaacttctccacatccagccaccctgacccagttccctgccacttaacagatgggtgggttgtgggtgaaattgctatggccccaggcttatgttagccatattttgtcagaattcataattcctgtcttcaagggatgatggctatttcgggagtgcagagggaccagagggactagactgggtgggtagcctttcttggcagccctacatgtaggcactgtgtaccttgtctgtagcagcctggtttcctgtcattgtgttatcagggtgacagcagtgtgtttgccttcccagggcccagcaactttaggaaagaagccaaaagcgtgagggacaagctggtcctccctccctcttggccgtgggggtgtccctctgtcttagaaggactcagccagatgcaaggaggtgtggggttgggctagacttggcatcttctccacctgggtggcaagggataagattttggcttgtgatcaagaacagcaagcccaaaactagatgcaggcctcaccaggctgtagttgacacctagtagacaccttctcagtcctaacatgtgcacagacccccccccccaccatgtcccttcagtgtggcaattaaggaccactctgcaaacatcagctggcttcctggtatgtgggcagcatcgcatggctgatggccctcttgccaggcaagagcgaggctgagcgtggagacaagagtgtctcctcattacttcttaattcactttcctgtctacaatatgctaatccctcaagactgtatagaagactgggaggtggactcagctcagcagccccagaagctccctacctgaggccctgtcccagggatgacactccccagctgcaggtgacagtgagtgctggagatgccgctaaaccccaactctgccccccacagcccatgcctggtaactccagccccagccggatatgctagtgctgtgggtgtcagccccttcggaggtcaaatgaccctctcacaggggtcacctatgaccatcagagaacacagatatttacatcaagatccataacagcagcaaagttacagttatggggtagcaacaaaaataatttcatggttgggggtcaccacaacatgaggaactgtatttaaaggtcgtggcattaggaaggacaagagccagtgtgcaggtgggcctgcaggtgcttccggtccccatgctgactacccccaccccatgcctgagcattcaccgttcacagggagtggtgatgcaatcctggaagagggccttgcaaggtggccagcactacgtgacatgtcactcccaacagagtggtggcaagatggggttcatccctcacccataccctgaggcaagtgggtggtctccagacccccactcacacagtcttaccccttctcaggatgctaagtggagtcagatagcctctacgtgaccctgccatccactctctccatagtctgtcccctctgtatggcccagaggagtcccaggcttgtcattactgactccagatctttgcctggcattgggacatgaccaagtctggctttcctagctgagtactctcttcttcgaagattccctggtgctttgggtatagaggtctttgcctgctcccttgcattttttctctgggtctgtctgcccaaccccacccccacccccgccctgggctgcacatctctagagactggatttgctctaggatttctttctccacccccgaggtgctggctaccttgctactacatacttacatgtgcctgactcacttaactggagagtgggggaaggatagaagggtcctttggtcaggtaccaccccagcaaagagaaggcacctgtgatgctcagctgatgcctctaagcaccagcacaatgtagcacttccctgatctctgttgacccttcttcccatagctgtaaagggcacggttcaaaggaaactgggaaggcttgccccaccttctctaactggccctggaggaaagtccctctggcttgctctctcaggcaacaatggaatagctgtcactgatagcaggcttacaaggaatccagctgttccagctgcctggaagaagcagtcacccagagcctcgtagctacatgaagaggcagcacaggatctgacctgtcagatggaaagtctgtggtccagtctcccagaccccactcaccctccttagatgctggccctgggcttctaaagctccagcaagcactcacctgtgtgtgcttaggctcctccaggcgcaaagcaggatcattctggcccctgcggacagctcctcccaacatatctgaggggtccttgtgaactcacagggagcaacgccccgtgggcttgctttggggtgtagagcctctgcaaagggctgaccacgttgctgtcatggataggtgagaaggctactgcccctgcctgtagtctcacctctccatgccaagcacaggtaaggtcagtgggcccctatgctgcccccgagcagcagtgtcaggagggacagatgccagctcccttgccatcccaagcttctgcggaaggtggtgggctcaggggcacagcagcgtctgtcaggggagaccaggcttagtcacaccaagccgacagccgcctcttccaacagtgtgtgaacaatacgccctgggttgcacctgccctgcctcctccctgcacagcacaggctgctgtgctctgcagtcctctaaagtgggttcatagccaaggaaccccctcttcctggggctgagctgtcacttagctgtcccaagtggagctgggacttagctgtcactgtcccaagtggagctgggactggatggcaagacagtgatctaccgccacctgctggatctctgtgatagtgcaagtccagtggcatacaaagcttgacccctgccctgcccagggcagctgcagagatgagagactggagagggcccctgaggacttccttggggacctggcctgctgctgggtcaatgggaagtgggaaggtgcctgtcctgtgccagccctgaacccagcccccttgtacagccagaagggagccaatgctctgctcaagcacgtcttcagagaacaatgtgcacatctctccttcggagagcactgtccctggatacagagtgtctctccagggtcatctgtacaccaatggctctggtagcaaagctatagcacaccctgtcacttgtaatcatatttcccgagtagaggggaatggctgcaccccaggaaataggtgggacggggaagacctaagggagaaagtagaacacaggagccacagccggggaggcacacaggccccctccaactggccccggaggaagccctctggcaacaactgaatagctgtcacaaaactaacaggcagagcacttgccatacagcctgctgctctgtctggcgtctggcacagttcgtgccagtgcaggtcctgccgcataccgtggaaacaatacactgctaacactcgacagtctcacagagtgtgctaccagctggccacgttgaggccacgagccaggctgccaggaggattctgccacctcctccccatttacctgcatgcttagtggagaccatggttctgcctagcagtacttaataacctaaacatattttctgaatcagtcagtagttgtccttgtcaccctttgagagtatgactcctggaggtcctgggggttgaagatgcctctgtgttagtgaaactgcccctaatagctgctcagagtgcccctcctctacaggcaactttccaatcagctgctctcagggcacccctgtgaaatggagagtccctgtcagggtctggctgggtttggccagcagatccttgtcttgtcacttcagcagtgagttcactgctactgaacgtcatcttccttgtcagcctggccgctgcactgacccttcctgacccctgtctttgacggagcacaattgcgccatgcgggaccagcactctgggatgtttgattacatagctgacaccacagagatgcacgcacgctgttctgtacagaactcaatgttgtatgacagtacccctgcaaggggcaagcacgagctggaggtgacaggcatgctgagaggccctgcctctgggcaaccagaatgatggagggtgagcttgattccaaccctggtcctgtctccccaggagctgccagagcatgacaagcttgttcagtggtacggtgtcacccagcaaggatgggacctcctctctgcccaggaggcagaactcactggccaagcccccactccgtgccctgtacgatctgctcatcgcacccatggaaggggtaagtggctcctgggacatgacaccccttcgtatcagaatgcatttgtttttctgcttggtgcgcatgcgcaccatcacccccccagcggattttttctgttcagtgtgcatgtgcacccccagagcactccacggacatgcattcttcgctggctgcttatagtcaggatggcaggtctgagcttgtgctttgctttgctctgctctacatgggctgaacgcatttggctcagtgtcctcgtgtgctcctcgtctggtctataggtcatgaggctcaacgtgtcagtgctaggaatgaatgccagccacgcctacctaatcttagatgtttatttggattgacccaggccacccccttgctctttgcctgggtctcaaacacagaaccaatgtctggtgctaaagacaccaactacagcctaccttgccctcttgctggcatatccaagccacatgagcctgccatatccctgcttaattcaaacagtgctcttgggtggtacagggaccttggtgggtctgagaatttaggggccagtttcaggcaggatagtcacagacagctgttctaaggaggcaggagcatccctcagcaactctctctctctcaggcaccgtgtatccttaagagaccacagttcacatatgacttctccattccctgaatgggcacctccctggtcctccagcggtgtttcacctggcctaacagctgtgggatgactttcctgtcttctggcaagtgaccctggccatccttcctgatgtcttttctctgtaggactgtgaggaccatctagaggacatgtcgggtttgcacagggcaaggtgtacaacacattagggctgcaggcagggactgtcacctgggcagggggaactgctgtgtccagggccctcctcaaggtcccttcaggagttcctgtctgaagccttctcctggaaaggccaagcccctcttcccttcatgttccaccctgtcccttcttatcttcacgctctccacactgctatgatagggctccagctcactgtaccttgctgattgaggaagacatgggtttttctcctgcctcccactgccacgagcagtcttgcactcctctgcacttctattagtcctctgaacttgcagtgctccccactcctagcaacgctccctagttccagtagtgctctccacactcccagcagtcctctgcactcgaagtgctccccactcccaacagtgctccccattccctatagtcctctgaactcccagtagtgctccccagtcccagcagtcctctgcactcctggaagagctccccactcggcattcttcacttgcttgagcgtcctcccacctttgctcctagccgattgcatctctgctccatcagtgctgaggaagacgaagaggcagactgctgtgagtgtgctctctgcttgcccagatcagcaaggcctctatcccaaagccccgtcccccgtctctgccatccacagagcaacaatgggatctgaggagttggctcttgtcgcctcctccttctctcccttgtgacctaattcactccccagtcatggccagggccatccctcagcttcatgtccctcagcagctggcctgaggcctcatgcatgtgcacagagctgctctcagtctgaggtgcatttgcactggatctgatacagcacagaaagcagaggaccctaggaagacactaggtcatggtttctgtggcgacctgggggctttccaagagccagaaaccagatactccctccccccacgaatcacaggccacgtgtcctgtgtacatgcttgtcagaacccacagctgaggcagcccccttgatggcagcatctagtggaggtgccgctcaccctaggggtccaatacttggtgacaagtccaagccaggctgggagtcagcaggaagctgaggccaggaggtgcccagagtcagcggggtgtgcttcaaacagtccctcttctgtgactccccccagagtaagagtgtgctgaggtggtctacacaccctcacgctcctgcagaggtgcaaagaagggtggtctcagccttaaacaggtaaaacagccaccagaaaacacctttgcatgctgaccaccaggtacccaccaggactgtgtccactgcaggtgaggggccaatgcttctcacacaagacagagtgagccaggagctctcagccaccgcaagcaacgtggcaagactgctcaaactttaaagacaaaggatccactgttttaaggaaagcacttctgagaacctgggattctgtttcctgtccagttacagctacacacttaacacatgcttagacatgcttggtgtgcgctgccccagagtctggagctccggccctctctcatgactgtcctgtagcgggcctcctggaaacatgccactcctctccagaggccaccagagggcgcattgacgctgccagccctatggggagtcacactgtccatcagcttccagaaacagccggttccctccacactgtcacagaaaccgcagattgggattcatggatgtttcatgtggggcatgggattatctcaacaactgccttcagttagctagggaaccaggcccgacacaactgaaagtgggacatagtaggccggcggcggcggaggggtgggggggggaccacacaccagcctttggctgactgtatttccagggaagtgtactatcaggaccatcagcaaatgctgagccagatcccacctacagtcaccagggagcagtatagaatgtctgagtgaaaagcaggcaggaggtgtgggtggcgtggtcccagcaggtttaaaggtgttaaggacagcaatgggcctgagacctggtctgcctttctggttgtgagaggacaagggagccatctcatctctgaagcccaggtgaccagacaacctatgaccagtggtgttttcagggctgacttggagtgtggccctgtacataccagcaacatgtatgatcttccttccacactgcaggcaagcttcacccagtgcaaggcaccgtaccctggaggcaggcttgcagtagggccttctccaggtgggcagtcactcactctatggaggcccagacttaagcatcctcagactttgggcttgccctagttacagcctgccagcctcacctttgtatccctttgcttccactctgcttggagtaaaatttgaagctggatgctccaaagaggtcattcacacaacttacacacacagctgtctgtctgcagaggccagagggacaatgacacgtggctgcgagtcaggtgtggcaccagccactggctgttccaacacatcgcgtcactgtggatagccatgtgttcacacctgaccgcgtgtgctgtggcccgtgctacggcagctccctctgctccctgggctgtgagtggaggtgtgctggcagcggagaggctctgcccatgccatgcagagctccccatcccaacttgccgtttctggggtggcggtgacatacttcctactccctgggtcgtacagcagctcgtgtagctgcctgtaaagcaagcaggtgccccagcgatttcaattctctttcccccaggttagccagattataaaaggaagcaaggctcggggccccgagaagcctgagcttcccaccagacacttgtcactttgggttagccagcatttctgccaccctcagccaggtgcctctggcagcaggcagatgggtcacatgagcacatttgcttcctgagggcacagcctgtcaacctcactgagtcagcaggaagcatgctgggcccaggagacaggcatttctgcctgcagtgccacggctgcggtgactcccactccatccctgttgagtggcagccatacttgcctcactcccaggcgctctctcccctctccacttcctcccatgcctcttctcaagtacagagtcctgctctttagtgtaggctcaccctgagttcatggcaatccccctgcctcccccccacacccagagtattgggattatgggtgggcgctgggtcatcttcacagttggcttgtctcttctgagtcccagccccacttttggaaaggccacttctgggcagagcgggccggtcagcgtctgcatgctgtggcttgcacacagacttccccaggtcctcacgtgagattctggcaagagaagtgctgcctgtctaacaccttcccacccccagacgccataaatggaaacactgccttcaaagctgggggagctagattgagaccctgacatcacaacagtccctggatgaccccaggtcctcctggctctgagtgtctggccttgtgcctcatcaaatgggagactcaccaggctccaggagtccttgctgcccgagagggtcacggcacgcaccccagtcctggtggcaacacagccctccagctgtgttcctggagggccgctagggcaggtctctctgctatgttcctggaaggcagctagggcaggtctctctgcactcatcctctgcctccagggagaacacctgcatccacaggtagttgctctttgtgtgccactcctcttcagactggtggctctcatctcccccgcacccccccagcctctcacagaacttgacagactgtctgctacctaacacagaagcccgccctccgagtaattaccaagtgcggtacctgttaacacttgtacagggcagcacgcccaacatccagtctccagccctgccgtgacagttagccagggcgatggtcagtgtggcctcccaccctgagtccgctcttgttcttgctctgcagggcctaatgcactccagcggccccgtgggccggcaccggcagctggtcctggttctggagggggagctctactttgtcccctttgctctcctgaagggcagcgcctccaacgagtacctgtacgaacgctttaccctcatcgctgtgcccgccgtccgctcgcttggtccgcactccaaggtaacaacacactgcccagactctgggtctcctgtgcagcctgaggggcaggcaggtgggcttggcaaccagacccagggcataattcatacagggtagtttctgcctcagtggatttgaagatctttttagtttgatgttgaattacaactttgtcaagaggcaggatcagttcagagggaacggaacaaacttttgaagtctctatggccgactccaggtcccagatgggaagggagccggcctccctgccatcggcctccctgctgtcgcctggctcacaaagcacattaggcattggatgttgcccagtttgcagaagcctctgccctgctgacagcagggactggctgtacgggatcacaaagatgctgaacactcagggtgagggatgttaccaggacaccagctgcctggctgacagggtctcctctcctcacagtgtcacctgaggaagaccccgcccacatattccagctccaccaccatggcggccgtcataggcaaccctaaactcccatcggcagtgatggacaggtggctgtggggcccgatgccctcagcagaggaggaagcattcatggtgtcagagctcctgggatgtcagcccctggtgggcagtatggccaccaaggagagggtcatgagtgccctgacccaggccgagtgtgtccactttgctacccacgtctcttggaagctgtcggccttggtcctcacacccaacacagagggcaaccccgccggcagcaagagcctcctttggccacccctacacgatccccgagtcgctgcgggtgcaggatgacgcgagtgacgtcgagagcatctcagactgccctccactgcgagagctgctgctcactgcggctgacctcctggacctgcggctgtcagtgaagctggtggtgctcagctcgtcccaggaggccaacggccgcgtcacagcagacggcctggtggcgctgacacgggccttcctggccgctggcgcgcagtgtgtgcttgtggctctgtggcccgtgccggtcgcggcttccaagatgttcgttcacgccttctactcatccctgctgaatggcctgaaggccagcgcctccctgggcgaggccatgaaggtggtgcagagcagcaaggccttctcacatccctccaactgggcaggtagggagcagatgccattctgcagccgcaggagggtgggaaacaaggccctgggtgccaaggctctccctcatactcagtccctggaggcacagccaccaccttccaggtcaccctcagaaggaagccacagctctcagcaccaatggacagtgtctgtcactgggcacccaattcaaaaccctgtgttaagaaaaaaaagagagaccctggatgcgtgatacggtcacgggaaggtgtagatacggatgtgtgccatgtagaggtcacctacccttctgcagcccagcacccctagtgggtgtcacagctcctccagggtagcctcgccttgtaactagcagcacaaggcttcagtgtggctgtgccacagaacagctggtgccttggcagacagagcacaggtcctggtgacccacagtccctcatcagaccatacctgtcctgtccaggctcctcggtatctgtgtctgagaccagaccctctgcctggcccttcattcccacaggaatccctgcctgtgtgctggcttcctgggctagtgtgcttgtttgaaagtgacattcgtttgggttggttttgttttgttttgtttttgatagataaccgaggcaggcaaaggagccaaggggtccgggagggagaccaatgggatcctgctgcttagctatctggcctttcaagttggaggaacaacatgtctttacccctggttgctggttcctgccccaagttctctcccataggcctctttcccacaagaaagcttcaggctgctcaggtcagaggttgctctggagtacctacctgtggctcacagagacagccaagcagtctgggtgtccgagaggccaagcacagcccacacccaccagcacccagctctctcactgggcagttgggaggaaatggccagggtagcagtgctgtcccccgctgtcccctgaggagccctctttgctgtcctcaggtttcacacttatcgggagtgacgtcaaactgaacagcccctcgtcactcatcggccaagctctcacggagatcctgcagcacccggagcgggcacgggacgccctgcgcgtgctgctgcacctggtaagggctgacgggaccctctggggaatttgggtatggtgccagtgaaaaccagcagggacagcatgagatgggggtggctagatccaaccgctcagtttcctacgtgggggtgggatggggcggtgagatgatgcctcagggtctagggtggattagccggatgagaccctggttggcaggaagaccccaacagccgacagacatcattaccagagtctttccctgaattcaggaaaggactgattgtgcccttggccagcccgtgtcagtgaggcctgaaggcgcctgcacagttagaagttgccagttaagacagccactcgggaggcacagctaaaaggactaggggttaaagcctggactacgaaagactgactgcctcattcccaaaaataaaataaaacggtggcacagaactcgtcccgtctttgccgtttgctcagaacatggagagcagtctcttgtcattcccagcccaaccctggcccaggcagacacacggttgtctatggtcacctcacaggcctagagcgacaccatagcttcagaggagccacagcaggagtgggaagtaggctgtggcttaaggtgggcaggccatctttgctgggtaatcagtcatcttagcgtactgagatgacccaagccaggcccgtcagccccacaccctgggtcgggggctctctgtacacactgatgaaagagaaggtacatcgttcttcaagcttgggtgtgtgtggaggttctgaatcttaggctgtcagcaggcactgttcccaggggagcctagctgctgtgagcagccacactccaggccctggggacgccgagacattagctttctccgtcaccccgtatctgtgagccctttcgagttctacaccactgcagacttctagttgcactttctgccctctctgtccagccggccttctctgggcctcatgaggcctctggctacaggtatatttaccactttcctcctctttgtaacggccagagccacacccctagctccctgcaggaggcaatgtgcctccgagacccctctgtcccagggacagccactcctgacccttagtaagtggacacttcttctccccccaaacgtctgatttgtgctgtgctctaagagaagcctcaagtgacatgctggacagtctgcaaaccacatgtgcctcgggggcctgtgacatctcaggacagagccagatgtccattgggagagttgtgcagaaaatgaaaatctggcaggcaccggtggtggcagtagtcagcatgacaccgccttcccccaaagccccaggaggacgaccagggctgacctgggtctctgcctgcctcatccccaccaggtggaaaagtccctgcagcggatccagaatggacagcgcaatgccatgtacacatctcagcagagcgtcgagaacaaagtgggcggcatccctggatggcaggctcttctcaccgcagtgggcttccggctggaccctgcggccagcgggctgccggcagccgtcttcttcccaacctcagacccaggcgacaggctgcagcaatgcagtagcactctccaggccctgctgggtaagctgctatggcatagaggggaccatgggtcacacaaggatgctgggccttgtagctagaagcatccccagaggtgaaagagagtcccagagaggtactgccacggatgcatggctgataaccaccttacccagtcttcttgtctgtgatggttgttggccacatctgggctttgtcctgtcctgatgagagtatgagagtggtcctgagcatatcctgtcaccagcagctatgcttctagcaaaatcacagagcaaccagggtgacagaggtgcaccatcacctgggatctaggctgccccagagtcagagagtgaaacacagtgtcagggttccttttctctggaggccacatgttcctgtcccaggccacacaggaacatgtcactggccaggccagcctgtagctaaccaccctcagggccgagcacctggaactcactccttggaaggtgacttctgctcctctgtccctgctcaggtctgcccaacccagccctccaagcactgtgcaaactcatcacggcctcagagacgggagaacagcttatcagccgggtaagtagagccaggtgctaagtgcaggctggacagaaagagtgacggacccagacaggcccgtcagaaatgtggagtgtggcttcccctgcctccatgaagagaaagaagggccaggacctctgagcaggcaaggtctacagacaggttcttagggctcacagccctgccgctggctgatccaggtgtctccagagccctctgctcattgtcctctcacgccctgccaccttccccagctaagtgacagtgtcagccaccgagggcaaagcccttttagagaagaggcagctttgaggagatgtggaattcggggggttgaattctgactctgagctcccagcagccccgttcccagcagcttctgtctccccgactttccttccggccactgagaatccagagtccacccaggtgtatgggtgtggggggtgaggctctggatggcattcaaggaagcagagtggtttccctggtcatcccagaggcacagtagtgcacgctgctgtggtatatggaccagtctcagccatgtgcagtgtggttaccctatatgagcttgagcagggtagataccctcagtggctccgggagacgcctctctctgggactgttggcaccatcactgggacacagaaccagccagtgacctaccttccttgagttcccactggtgttataattagcacgcctcacctgctcgcagaattgcattagaggacacttctagaatgttgcatgtaaaaacattcagaacacagccctgtgttctccagacaagaatgcagaacttgcacaccctacactgcagacaaggccaagagcctcagagtgccagctccttatgtctcttgctttcatggaacaaagggacctcgagtctgttctctgtgagccccaggacgactggacactggccaaggcatctcctgtgtgctcatctcctgtgtcccccctacccccccccaccttgctgcctctcactcctctccagtcagagccaggctggtgcagcatctcctaaggcagtgatcagcttgtgtgcataactgctacgcttgaatctaaactcactctctttctctctctctttctctctttcctttccttatactctgctggctgaaggctgttaaaaatatggtgggaatggtaagtacaactttaattagcagctgctgtcaggtgagcacctgtccacccaccccaggaccctgcagctccaagcgcgctggccctgcacacaaatgctggcacggagctctgggctgggacttgtcccctcctctgctctggctaccccttttctgttccactctgtcctgatttgacctcacaagttctacctgagcagcagaggcagaaccagtgacaaacacaggcagaacacccctaccccagaagcagggttcatatgaactgttccatgagtgttgtggtcacaaaatgtagagttcaaatcttccccatctagtgcaagaccctaaagatggcctacctttgggcatgtaagcaaaatggaggcagtcagtcacagttcccctccccaactcctacagcctctcccgtgctttagggaaggcagaggctgaggcagagctggggcccctggaggctcctccacctttgctccacacagcgccttgccttactgtccatggccagcacagagggcagtagatgtgaccaggggggcaggctgcagtaggtgtgaccagagagggtgcagtaggtgtgaccaggggggactgcaataagtgtgacggggggctgcaggtgtgatggggggggctgcagtaggtgtgaccagggggggactgcagtagatgtgaccaggggagagctgcactaggtgtgaccaggggggctgtggcacgtgtgactggggtaggctacagtaggtgtgactgggaaagggctgcagatgtcatgagaggacaatatgtgacaggtgacatgaggcttgggtggtgtgctcaaaaggctgcaagagtatgctcacctctgtccctccctcagctccatcaggtgctggttcagctgcaggcctgtgagaaggaacaggactttgcctcggctcccattccagtctccctcagtgtccagctatggcggctcccagggtgccatgagttcctggcagctctcggtaggaccaagcgcctctaacttaacttcagctctcctcactcttgtttccccctcctgtcctctgttgggtcaaacccagtgttgtagaaattatcaaccaaagacactgatgctgcagccccttccctccagcactgtgtcccctctagtctgtcctgacctcaccaacacagacacaagcattaccacatgtccagggggctgctggctggaggaagggatagtggccaggccagacctcagcgactagtagtcaggacagaaggaccaagagcagcagcaggcctagggcagggcagggccagcctccaggccaggtacggagccctcatgcaagccctctttccttccccaccccacagtctccagcaggttcagtggtgtctcaagtagggagcccagctggtctcctctggggacagtcgctggccacggtgcccgagagagtacttgctggctgcctctgtggtgcttagctaacctagaactcctggtctcaagggatgctccacttcatgtggctgctaggatgtctctgaagtcatttaactgcagcatcaacacctcattagccagcttctcgctcaggaaagccaatgccctctgcgctattccaaagcccattaaaaccctaggagggggagctggcccctcgggcacaaaagatggccttccttttagcagaagtacatctcagaccccaaggacaagagatatggagggcatacaggcaggccttgtcttcaagtagagagaggcctccttcctgggtgccagcccaaagtcctgccccagtgccaagcagctacatttgccctagagagcctgagcagaccagtctgtgtttgactaagtgtccagaaagactgcagaagagtcaggcagcagtccacatcagcaggcgaggctatgcccagtagctcttctgagaaaggcagcctgatctcctgatggatcaactgggagaccccacctgggtactcactggcacccctgccacattgcccatggtgaggaccatgcatcttccatgttcctctagggtttgacctgtgtgaagtgggccaagaggaagtgatcctgaaaactggtaaacaggctagccggcgcaccacccacttcgctctccagtccctgctgtcactcttcggtaagctcctcccctgtccctctggaggagagatgcatctatagtcggtgttagagtcttctaggggaggaacctgcagagctcctcgctctggagagcttcatccttggggtatacaggcagcaaactcatcactgcttactccagcataaggaactaaggcctcaggaacagcaaagtgggggcaaaacaggggacagtggcgctaatgggacatggcatggtgtcgggctatgcctgtcccactcagggctgtgtaagtgaacacagtgtaagagggggcccatgggaccatgcttggccctgctgttgtcccagagaaagtaagttggcagctgagtggcagccctggtctgagggcaggcgaacggacaggtcatgctaaagaatgtgcactgtaacagggagattccaggggatgctgggccttcagagcaggtgctgatccatcggggcagcactgcacagacgtctgggaaccagtggcaggcatggggtggggtgcagtcctgggctcagtgtgcactagaccatccgtgagatgcctgccaagggaggaggagtgggatgcctgggaagaggtcagcctagacaaggagagcagctccgtgccctgtcggcagaagcagaggctatgcatgcactgaagacaagccttaagtaaaggacatgggggccctgagctcactagtgacactcagaagaacagtaagtaaggcttgagtggaaggtgacaggagccgagaaggggctgaagcctgtggcacatgggcaggcaggtcctagggtttttacctcttgttcacgaggtcagggttgattcaagttgtacccaggtagtaagtctttgctagcttccagcattaagggacgcttcatgaaggaagtgttggtctgtaaaatcctaactgttctttggcctgaacgttctgtgcctagattccactgagctccccaagcgcctcagcctggacagttcctcctctctggagtccctggcatccgcacagtctgtgtccaacgctctgcccttgggctaccagcaccctcctttctcgcccacgggcgcagacagcattgcctccgacgccatttctgtgtacagtctcagctcaatcgcctcctccatgagttttgtctccaagcccgaggggggtttggaaggcgggggtccccgaggacgacaggactatgataggtccaagagcacccacccgcaacgagccaccctgccacggcgccagacgtccccacaggccagacgtggggccagcaaggaagaagaagaatacgaggggttctccatcatcagcatggagcctctggcaacctaccaaggcgaggggaagacacgcttctccccagaccccaagcagccctgtgtcaaggccccaggtggtgtgaggctttcagtcagctctaagggaagcgtcagcactcccaactcccccgtgaagatgaccctgatccccagcccaaactcacccttccagaaagtggggaaactggcaagctcagacacaggtgagtcggaccagtccagcacggagaccgacagcactgtgaagtcccaagaggagagcaccccaaagctggacccccaggagctggcccagaggatcctagaggagaccaaaagccatctcctggcagtagagcgccttcagaggagtggtggcccagccggccccgaccgagaagatagtgtggtagcacccagcagcaccacagtcttcagggcatcagagaccagcgccttcagcaagcctatcctctctcatcagaggagccagctgtcgccactcactgtcaaaccacagcccccagccaggagctcatctcttcccaaggtgagcagccctgccacgtcagaggtgtcgggcaaagatggcctgagccctcctggcagcagccacccatcacctggccgtgacactccagtctccccggcagacccgccactcttcagactcaagtaccccagctctccttacagcgctcacatttccaagtcccccaggaacacttcccctgcgtgcagcgcgccatctccagcactctcgtactcttcagctggctttgctcgatccagtccagctgatgccccggatgagaaggtgcaggccgtgcacagcctcaagatgctctggcagagcacaccccagccccccaggggcccccggaaaacatgtcgaggtgcaccgggaaccctgacgtcaaaaagagatgtcctcagcctgctgaacttgtcccctcggcacggcaaggaggagggtggggcagacaggctggaactgaaggagctgtctgtgcagcggcatgacgaggtgccacccaaagtccccaccaacggccactggtgcacggatacagcaacactgaccacggccggtggccgcagcaccacagctgccccgcgccctctgagacttcccttggccaacggttacaagttcctgtccccaggaaggctcttcccttcctccaaatgttaaagcagcttcttgcccccaactcagtgcacactccagccagagtcccggggcccctgatgcagcgtggtcacccacccacatagccactgataccatccctccccggacaggcgggctccctgggcaaggtcactgccacgccaaatgccactgtactcacgggtaaaccctgggccagattcacccaaagcaggtctcacgtgggaatggcagcgccttctctgccgcttcacccctgcttgagttatgctcctgccacagggcttgctactaagtctctatgcatacctttccttcaggagtgcacacagctctcgttgggcttccaggtgctggtgggagatctaacgctctaagtcaagttctgcactgacgcattacattagccaaaaggagaactatggttttcaaaatgccaattctttgtgatttaaatcgtagccatttttggtggattccgaagtcacagccacaatgcaataactcgcgttgaaagcttgcatccccagctgctccctgtgagcgaggccaggggcctttctgaccccactgttggccaaacttgaattttcttaaaaaaaaataataaaaataaaaattctgtactcttgtccaggcattttagaactatgcaattgtggtttaaaacacaacattgtgcttttaaaacataactgaccttttttctacatggacaaacacttggttttattatcaatagtactttgcatttatagccattatttttaaaagctggagaaattttaaatgtcaaattttgaatattcatccataagtagtaatcaagttttcctgggggcatggttgaaattattcactttccttatttaaagaaaaaaatgagaaagagggaaaaaaagaaaaaaaaaaaaacaaaaaacaaaaaacagaaaacaaacaaaaatccagtcagtcccctggctagcaagactggaacccctgccatgttatcagctgccttgctgcgtctctgtctctcctcttctccctgcagagctctcctctcttggtcaccaggccccgctggctgccactcagcaggtcagtctttgcacacactgcaccaccaccaggtcaggcgagaatacccctccctccctccctccctccctccctccctcccgtgtgagcagtgagacttaagtcccccctccctcctcactgtgagagcagacatcaccacaggggtccaggggcctgcatgacatcatgaccccagggcactcctgaccttgaaggaggctctgacttgggtttgtttctggttgtggggtccgcaggaatcttcctgcctcagcccacaccaacacaccacactaggacctcactctgtagccgctaccttgtgctgctgttttgtaaactgactccttgtcactccagtgagttttgtcctagaggattctgcatttgacccaaccgcctcagtgacaatcacagtaaggggactgccattctaacctggcccaggccctaggagagagataactccacaaagcagcacatactatcttaggttagcagggagctaactcaccatgtagcagatgaaaaaaaccaaacccagcactgtgcataaataccacttgccaagaagtcaggtcctcggcaaccgagaatcaacctcagcacaaacgcaggtggctgggctctgttcccccttagccaccacctcagcctctcccctcccctgcccccaagtgcccaggagcttggctctctgtgctttcgtccagggcgcagcccgccatcagcaaatacctccgcccctcaaaccatgtgtggttgccaagccatggaggaggactcccaggctgcctaggtacgctgtttttcctctgactgacactgaagagcaaattggtacctgggctgctttctatttgtctcagatgtgaattccgatgaaggaaaacagagttggcaaaactaacgggaccggtgtgcagacccaagtcatcgtttatgccagtcttggcaacgactccacgcatgtgaaataaaagtcaaatgaagttctcagctacgtcgcaaagcggacacttcaaatcacgagactgtatgaccagagttctgtatgggtcagggtttggcgaccgtgacccacagctaaggctggtgaatgagtttgaagttctatttgtttgtcttggcagtaagtcagcaatggattttaccttttaaaatggttaatgagtacagcagaaatcctgatttttgcctcttggttcacaaagcctgaagtcacctgttacccagcctcttaaaagaaaggttggcaactcctgatacacataactgaaaaaaaaaaaaaaggccaggaagtattcaaggaagcaggggagaccgactggcccattgggcccaaagcctcagcgaggcctcacacttggtggaggtggctccgacctagctcttggctcttcaagccaacagatctgagtcaaagttacaaaatcggtctctgtttcccctttgctggtagtagagagacatccccttaagctcaggaaatttaaaaaaaaaaaagtttttaatacattttttccttaaatgttctaccctgccctaccagacaaagatatgctccagaccagcagaagcctcctctgggagcctggtgggaccacacagcaaggccgtaggctgccccagttttcaccagcaatgactcctaactgcaaacacacccaagaaaatcacccaccaaaacttacacattgtttctgcaccagtgcacaggtctcaccttcctccccctttaaaaaagaaagaaagaaagaaaaatcagtccacactgatcagtgggtcactggtgaggtgctgccgggcacagtggtcctcagcaccttgcaaacgggcaaatggcaacagtgcagcttcccctcacacactgtactcctggcttgtgaactgggcctgtttgtagaggatcctagagacgtccatgccagcactcacccacccaccctccccgttgtcctgggcacctccctacttggcattcactctccttatatgcattgttagccacctttggcctacatggactcttttttgtaaattacacaatttccagacagcattaaactttttatattatgaaattttgccatgtaaaaagaactccatatttttattgaggctgcagggcgcttggcccttcctttgtgattcagtgtctattaaagcatgagcctgtcagttttaaa

SEQ ID NO: 315 - DNA, 3558 bp, Homo sapiens
ccttccaagttatctccaaactcagatgcatgcttttccagcaaataccctaagcctcatctatgagtaatgcatcctcactgttcctggggtgactggaaggacctggcctgttttcccatacacctcacgggccaagcagtcacgttataagggagggaggcccagtaaaacatggtaagtggcaactgactttgtatctcagttttagggagtataagagaatggtggggattgtggcaaactgaagagaaagagtcttcccaaaaaggggcatcctctacccaagttgactcaagtcagttgttgccactgggaatgtgggtcactgggacagccagttcttcgtgtggtgtttttttttttttttttttttttttgagatggagtctcactctttctcccaggctagagtgcactggtgcgatctcggctcactgcaacctccgcctcctgggttcaagctattctcctgcctcagtctcccaagtaactggtattataggcatgcgccaccatgcctggctacttttttgcatttttagtagagatggggtttcaccatgttagccaggctggtctcgaaatcccgacctcaagtgatccacccacctcagcttcccagagtgctgggattacaggcatgagccaccgtgcctggcccagttcttttttatagtgtgaaagtgctaaacttttaaatattggcaatgaattaagaaaaactctgtgtgcttcacaaaatagataaatagatctgtgggctgaattcatcttgaagattagtttgccaggtcttcgtggaccttaagaagataaggtcttctctgtctcagaactgttgagaaaacctatgtgtttaaaagtgtgttgtaagctgcagcaaagtactagagacataaaaagcagaaccttaataggttgttcatcatatttttcaatatagaaattttacactggagggtaggtttcaggaagataacttgatccctaatcaacttccaaatcaagtcatggctggggagttaatgattctgttcttttgttcattaaaaataatttataatttctacctccatattaaaaattgatttcatgctattagccttgtgggaaaagcaggctataatataatatatatttaaacttcatatttctatattctgtggtaagtgcagccttttatgttatgattaacatattaaatgaaagtatcattttagtataaaattgaatatggaaaattgatatgagtaatatacattttagtcaatatttctgccatttgaattcacaaggatataatgtatatcttctacaatactataataattgcaaaaaaagtatgcaaagtacaaaagcaacatgacagaagttctattttctttatactaaagtattaaaccttatctgcagaaagacagaaagaggaacagagagagagagaatcaaatgaaagttgaatttagtcttttaaaacatacatggtagctgagcgtggtggctcacacctgtaattccagcactttgggaggccgaggtgggcagatcacaaggtcaggagatcgagaccatcctggctaacatggtgaaaccctgtctcttctaaaaatacaaaaaattggccgggcgtggtggcaggagcttgtagtcccagctacttgggaggctgaggcaggagaatggcttgaacccgagaggcagagcttgcagtgagccgagatccggccactgcactccagcctgggcgatagagcgagactctgtctcaaaaacaacaacaacaacaacaacaaatacatagtagtagctagattacttttgtttttttaactgtataagaaatacaaattttaatttcgggaatgtgtatgatatatactgcagtttttaatttatttaagtgatgtgcaagtaataggcacaggtgataatttaggaaacaagataaagtgaatcccatattgaaatgccataatttcagagtaaaataatggaaatagtacttaaatataaagcttttgcttttacatggatagataacaattctgttttcaatttttttcatgatcttagcaacttaagacataaatatttcatttctttatccttttttctagagtttgtctcattttcttcccttgtatttaagctttttatctttttgcctcatgtatatagtctcatagatttgatcgattaatgtatagtttctgatgatggagtttagaacatgctgcctcaacatagagcatcttggcatttgagaaaacaaaagcaggaaggactctgaccttctccctttcttctcctttgaagcaggtcataaaagaattctctgactttcctctgaagcagatcatagtattgtcatgtgagaagtgtccaccctataccccgaggaaaggagtatccttacctctgaagacacagaaacacaaagaatctaaacaaacagttcttgctaagttctcccagtttattctcaataggtcataccccctttgcccaatcgtcgtacttcatggctatccacttcctcatcaaacttagcataaaaatacacaggtttcccttttctttgagtctttctttctgaagcctcctgtggcatataaaacttatattaaatacattcatgtgcttttctcttgttaatctgtcttttgtaggtacctcagccatgaagctagcaataggtgagggaaagaaatctttcctttctaaaactaacttataattttaaaacacattttatgcttttaagctttcactttagaatacgttgaagggcgcatgtatatagttttcctatgagcaaggcaaagtgtgaagaaatctttaccaagtcagatggcataggcacaatcagaatggacactgccatggtctagacaaacaccagctgtaaacaactgtttcagacttatgtttctcaacaagttgcaactgtgcaattatgatcactagaataattacagtatgggaagtactaaaacattttggttattgtatcagtcaggataattaaccattagctgccgcaatagatcaactctgaaatctcaggggctttatacaacaaaaattgatttcttgctcacataaaatgatgtagtcagcagggattcccctctacccagagaccccatgcctctccatctgtgtctaatgctgccatattaacacttggtttccaaagtcactgcacaagagacaggagagctggaggaggtccctggctctcagtgaccttgacttggaagcgacatttgatgcttctgcttacctttcaccggccagagctagatatatggctctaacctcactgcaagggaggatagaaaatgtaggagagcatcaattattttgtgagtttgcaggcacagccctggtgatgatttctatctcacatcatgaatttatttaactcaaggcaacttgcaacctttgctgctgactcacggcctgattccatgacttctttgcatctccttctcttacggctctatcataccatattcttcaatctatttctggttcagatgctcaagagag

SEQ ID NO: 316 - DNA, 7694 bp, Homo sapiens
taatggaagtcggtttcttggccatctacatagttttctgggcagcgccaagcagggaggtgtctccagttgtgagtcctcggacaggctgctgcatgggtgcacatactcacgttattggtggaagttttaagtcccaaactgaagggaaggaggcctaggtggcacaatcagggaggaatatacatctgagaagttttgggaagacatcacctggcaaggctgcctgaaccacagtaatttagtcttcctctatccagatcactgagagttgtgtgctggtcttctctcaaaccctggatgtgttacctgcttctccctaagtgctctaacctcgctgaactatgagcctgaagggtgggtcgatgccagaccttaggtggaggccaaagacagtacagaataaacagcttcttcctaaattgaccccatcttgagggtttctgagattgatgccattctttagtgactacagccaaggcctaagcaatccagctggttttccccttggggcgtgtagttgttcttggatactttgaggattgctcactctttttttttttttttttgagacaggctcactctgtcacccaggctggagagcagtggccaagatcctggctcactgcaacctcagcctcctgggttcaagcagttctgtctcagcctcctgagtaggtggcgttacaggcatgcgccaccacgcctggctaatttctatatttttttgtagagatagggttttgccacgttgcccaggctggtctcaaaactctttagctcaaacaatccacctgcctcagcctcccaaagtgctaggattataggcctgagccactgcacctacctaggattgcccactctttttttgttttctttacttttaaagacaaggtctgactctatcacccaggctggagtgcagtggcacaatcttgacagcctccacctcccgggctcaagccatccatcctcccacctcagcctcccaagcagctggggctgcaggcgcaaatcaccatgcctggctaatttttgtatttgttgtagagaaggggtctcaccatgttgtgcggatggtctccaacttgcgagctcaagcaatccacctgtcctggcctcccaaagtgctggaattaacaggcgtgagccacctcacctggccaattgcccactcttaatgagttccctcccatttccagtgccacctgacaccccccaccccctgacacacacacacacactcttgttttctgacttcctgcctctgcaagacaagaagcctgttctttttctggaagatcacaccaactcctgtttagccctcagacatagttgccagggagctaagcaactgagcaggaattatggtcagggacacagcacaaatactccagcccatttttctgacaaccagactaatatcccttacattaccgaaagttctgggttcctcactacagagattagctgtccaaaattaaaaaaaacaaaacaaaacagaattatccgcccagagacctagttactgggtgtggaaagtgtgtgtggggaggggtgggaggtggttctcccttgcttcagttggcttctgccttgttttaaggaatcttctcctttagcaaaaggaggagactttggaatggattgattacacagactgtggtatctgacccattgaattttagaaaaaattctgatttaaagtttcagaaattgcacagaaaatttcagatttctggcttctctggaaatgatagatttgcagttcagggctcccataccctcatggtaatcataggctgccccctttagcacggtcccaagaggtgaaaacgacttgtacaccccagctgcttgggattattgaggacgaaagtagagagaaggggagaaatattggggagtgaattttgagccaaggcttaaaattaaaagtgggggaggtagagcccagcagtagtaggtggaggagaagggctcctggccgggggtgaggattcctcctgagaaccatagtgtccaagctagagggaaacatggggtccactagttctcgacaagtggaacaggtcacttcccatcatgccgtccaggagcaagagagactcttagggggttgtgcccctccccacccccaatacgcagattctgtgtaccatttacatccagaacattggttaaaacctgaattctggccctgcgtggtggctcatgcctgtaatcccagcactttgggaggcggaggcgggcagatcacctgaggttgggaatttgaggccagccagaccaacagagagaaactctgtctctactaaaaatacaaaattagccaaccatggtggcgcatgcctgtaatcccagctacttggaaggctgaagcaggagaattgcttgaacctgggaggcaaaggttgcggtaagccgagatcacgctattgcactccaacctgggcaacgagagcgaaactgtctcaaaaaaaaaaaaaaaaaaaagtagctgggcgtggtggcatgcacctgtaatcctagctacttggtaggctgaggcaggagaattgcttgaacccaggaggcggaggttgcagtgagccgaaattgtgccactgcactccagcctgggtgacagagtgagactccatctcaaaaaaccaacttgaattctggggccaactccagatgtactgagtcagaatcactgggacccaggaatctgcattttggcaaattgcccccatcattcccaagcagggatttgaaaagccactgccttaggggttgaatgaaagcctcgggtgagggtgtgttatctgaaaaacccctagtgtgactctcttgcaacccaccagggaggggagcaagctccccagaacaatcactgcttaaacattttcaatttatagcaaaggaaaattaggtctgaaggatagaaataggaatagcatttatttatttacttacttatttgagacggagtctcgctctgtcacccaggctggagtgcagtggtacagtctccgctctctgcgacctccgcctcctgagttcgagcgatccgcctgcctcagcctccagagtagctgggattacaggtgtgcatcaccactcccagctaatttttgcattttcagtagagacagggtttcgccatgttggccaggctggtcttgaactcctgatctcaagtgattcgcccacctcagcctcccaaagtgttgggattacaggtgtgagccactgcacccggccagaagagcatttattgagtaataactgtataccagacattgtaataagcaagagctttaatgcggcctaatttagggccaggtgcgattgctcatgcctataatcccagcactttgggaggctaaggcatgaggatcaattgagcccaggagttcagaaccagcctgggaaacatagtgagaccccctctctacaaataatttaaaagttagctgggtgtggtggcatgcacctgtggtcccagctactcgggaggctcaggtgggaggatcacttgagcccaggagttttgaggctgcagtaagctgtgattgtgccactgtattccagcctgggagacagagctagaccctgtctccaaaaaaaaagaaaaaaaaacaaactacaaaaattggctgggggtggtggcacacacctgtagtcctaactactcaggaggctgagacaggagaattgcttgaacctgggaggcggacgttgcagtgagccgagatcatgctactgcacttcagcctgggcaacagagcaagactccatctcagaagaaaaaaacaaataaaattatatatatataacacatatatattttatatatattaggcaataaatatatatagcttaaaccttacaacttcatgtttaatctcacaacttcatgaggtaggtaccattattattattattatttgagacggagtgtcactcagccacccaggctggagttcagtggcacgatcacggctcactgcacctccgtctcctgggttcaagtgattctagtgcctcagcctcccaagcagctggaattactggcaagcaccaccatggctggctaattttttgtgttattagtagagacggagtctgaccatattggccaggctggattattattaagacagggtctacctctgtcaccaggtgcaggatcatggctcactgcagcctcgacctcttcggctcaagtgaccctcccgcttcagcctcctgagtagcttagctgagactacaggtgccacctatcacactggcttttttttttttaagacatggggtctcactatgttgcccaggctggtctcgaatttctgggctcaagcagtcctccagcctctgccccgccccgcaaaatggtgtgattacaggcatgagccatgtctcccagccctaaataatgattttttttttttgagacagggtctcactctgtcatccaggctggagtacagtggtgcaatcacagctcactgcagcctcaacctcccagcctcaagcaatcctcccacctcaacttcccaagtagctgggactacaggtgtgcacaactaattttctttcttttctttcctttcttctttcctttctttcttttttgtagagatgggagtcgcattgtattgcccaggctggtctcgaactcctgggctcaagagatcctcccacctatgcctcccaaagtgctgggattacaggcgtgagccactgtgccctgccctaaatgatttctaagatgctaaacaaccctgacgtacggtcaatcctctggttctttcccctctgaccacattctgacctcttctcagaatatcccaaccatttctgttttccacctctgattccaccttggattcctagagctcttaggagagagaacccccttagcaaggaacctctcaacagccccaggcccagagtgaacccgggaggcggaggttgcagtgagccgagatagtgccactgcactccagcctgggcgacagagcgagactgtctcagaagaaaaaaaataaaagtatatgtatgtataacatatatataatatagattatatatatattagacaataaatatatatagcctaaagctcaaggtgtaccccccacatcccgttcattctgcctaagtgcacagagctggggtcccctcccaacaccaccccttcacaaacatgtagtagcctaacagaatacttaagatcaaaataacattctgctgtttttggatttttacttacatgatcctatttaatcctcacagtgcacctgccgaggagaagagattattatcccgttttacagaaagctcagaaacagaatatggccccttaaccaccagttgctgataatgccaggttggacctctggcttcccagagcactacacccagcagtccactgcagtccacccactgacatcccctggaacccagaagcaagtgcgttttaatctgcaagacctcggggccctggggaggtgggatggctagcatgtgggtgttgattaactgggaaaccggcacgagtgtcttagaagtacttcacaaaggagccgggtggggagtgaaggagggggtggggcgtgagacgttaagaaaaattggattaacgtgtcgtgggctgggttgcattaaccattcccaacactatctctggggaagtctcacacctgatattcaatagacatcccctgtagtgggtgatgttggcagaggcaggcgacatatacaataatatttttagagatccttgttcacacttcatccgcaccagaggacttcagcccctgtggtattcactcctctttagggctaatttgagaaactgtctcagattggaatccagcacctagagataggctgaggtgagcaggctgatctgttcagacgcttcgcggaccaggttaactttacaagctcattggcttccagagggttggggacccttcttatcctcctagctcagagggaaagattcaagagtttactcttcgcccaatgcccacttcagctaggggttcctggaagaacggggctgtggagtatctcagaaaactttcctccctctactgtcttcaggccccaggagacaaacctccttccaagcctcctggtcccagtggcttccctctcaccgaaatcgaaagaacccgagtcccagcccgaccccttctctcgccgagccctggctgggataccttggccgggaggacaggacggcctcaggctggccgccagacgcactccgcaggacgcgcgcgctcgagcctcggtggactcagccgccggccccgggaggccgcctccctgcgcagcacctcctgccacccgcgcgggcacgtgggatcttgactcgccgcccccgcctccttctgctccgcgtccccagcccgcggctcggggcgcggcgtggcgcggcgcgtgggcgtgctgcggggcgaccatggctgtagactgttacctccagttcccacagtaacaatcgaaagccacggttgccctggagacgcgggggcggggcgcgcggacggcgccggcgcggggcgggctgacgtcagggccgcgggggggcgggcggggcggcgggggctgaggagcgcgcgtgggccaccgcccctcgcagcccctagggacccggacggggcggcccgatggcggcgcctgcgttgatcagcaccgcggacagcggcggcgcaggcagcgggccgggggcggggccctgagggacggggactgggggtccccgggcgcggcggcggcggccggggccgcggtcctggggcggggccaggcgtcggtggccgtgactggagactgttactgagggcggcccgggcagtaagcagtctagagccaaggtgccggcgcgctgtccgggcggggtgccccggtcgccccggctgccccggctgggggctctgctgctccgcctcccctgcgtctcccgccctgccccgcccggcgctcgcgaccaggcacgcggcccctgacgtcagagggccgtgacgtcaaagatgtcccagagggggcacttccggcgggggcgtgggggcggggcgggacctgggaggccccgcccccccggtcctgagaggacagctccgctcgcagaggcgggaagccgtgggcgccgcgggacccgctggacgggacctgccgggaaggggcgcccgacgccatgcggggcgggggtcccaggagggccggggaagcgggggtgggcgtccgtctctcgcctgcacccccgctcagccggcccgggcagcgaggctgagtcaccgcgccgcagggagggagaggagggggcgcgtctcctggggcgccagcaccttcgcctcactttcctgggagaatggcgcaggagccccaagaaagccgggggggggtctccgaggtcggtcctccactcgatgctcctccgaagtagctgcgtgtccatcgggcgccggcaggtgctgcgcgggctcgtgtcgtctctggccccggctccgcagccgcgaggggaccccggtgccccccgtccgcccccatccccaccccggaggggccgccccacccgccgcctgcccgtcccctcctcgtcctcccgtccgtgtccgcacatctgtccctccgcggctggtccgtcccgcttacctggcgggccgcgtcgccactgcccggtcgcctcc

SEQ ID NO: 317 - DNA, 104063 bp, Homo sapiens
atttccggcaacgagcgcaaaggaagggatccggtgacgcctcttcccgtctccccagcggcccaggctctggctctcggtgcggcagcgccatctggtgccgagtctcccgccacccgcggaggtggcacgcgcccttctctcggaaccttccagagaaaccgtggcccctgctttcctttctcccgccctggacggggagggacccgagtctccgccccgccgagttcccgcgcgggagggactttgtggcgactctgaagcggaagctgcctgtaggaggagctttacaaacccaaaatggagcggaaactgttctttctctagttttaagtccagaagaaacggcgtccttttattttttgcttccttatgcgttgttgctgggtcattctcagtcttccccgtatcagttctttaatctttgaggactgggaccctgtattaattgcctggtaggaagatgacacgagctttgtggcttacattggcctctgctgtaaaagcttttgtttcctttggcctattaaagcgctgttgtaaaagcctgctgtgtatgttaggaacccatcgagaagcagaatgtagtaatttgctttaaaataggccatggaagtttcagaaaggtagcctcagaaatgctcaatgtagattcgtttgcatgtcacgtttcttttagataatcagagaaaggaaaagtaatttccccaaagttagtaaaatcaacacattttcctttaataatgttctttttttcctgtaatcttggagtactaacagagttgttctaaatgttttattggaatggtgctgtggatatcaaaatatataatgaaacaaatttcctttagagtttagatagcacatgttaacttgactctttgattgtatttctcctatagtaatgcttctcaaactggagcatgcatccagattctctagaaggcttgttaaaacagattgctgggcctcaacaccagaggttataactgggagggaaggtctgaggatacagctggattagtgtagctctagtaaaatctcaggtgattctgatgctgttggtactaggaccacacctggaataatttagagttcaggattgctttgtcaataatgctttttgctgttgcaggacagacggtactaaaatatactggtgatactaagcctgcacaagttagtagtccttttgactccgtggatgggaagtagtaaactaaaccctagaaccagtagagagctacataaatgttcacagattaaagcaaccagttcatagaaatgtattctgtatatgatcatgtgatagagggtgctgtaataccaagtatactaaatatttcagttattatacagtaattgttctttagctgttaaattagaaatgactaaaattaaggacaaaatagtttaaacaatcatactaattttaccctttggaagatgccaggtttttttcagtcttttgcatttcctcaagttcccttgttttacggaattctctacccccagcccactcccatccctaccgtgccatttataaatgtacacagtgcttacattataaaaaatgatcatctcagaacttgtctcatcttttcagcaggacttttctcaattctgtcaaattctgactgtgccactgcctttattgacacagtaattaaatcacgcagtgattaaagtgtgctgcacactgtaacttttgtgcttgctacaaatagaaatacagatattgttagataagtttatgtttatgataatcagttcctaaaatgtagaaagcagtcggttttctggtctcagttttatttaaatcactgctattttgtttactggatgtaagcttccccctctctgctctagcctgaatgggccttcgtgaaaagaagaaaaaaaagattgagaacaactgtcttaaaaccatggtatttccctaataggctagtaccatgtatttggataattactgatgaatcatttaaatcagggaaaggtgcatggttttgtttttttgttgttttttctctttttttttttttttttttttgagatggaggcttgctctgtcgcccaggctggagtgcagtggccagatttcagctcactgcaatctctgcctcccgggttcaagcgattctcctgcctcaacctcctgagtagctgggactacaggcgtgtgccaccacacctggctaatttttttgttttatttatttatttatttatttgagacggggttttgctcttgttgcccaggctggggtgcaatggtgcgatctcagctcatcacaacctctgctcccaggttcaagtgagtcttctgcctcagccttcctgagtagctgggattacaggcatgtgccaccatgcctggctaaaattttgtattttccttagtagagatcagttttctccatgttggtcaggctggtctcgaattcctgacctcaggtgatccacccgccttggcctctcaaagtgctgggattacaggtgtgagccaccgcgcctggcctaattttttgtatttttagtagagacggggtttcaccgtgttagccaggatgatctcgatctcctgacctcgtgatccgcctgcctcggcttcccaaagtgctgggattacaggcgtgagccactgtgcctggcccgaaaggtgaatgttctttgccttattttaaactttattgtaataaattcactaatgaagcaggcagagaagatgtaaaggacacttcattagtaatgctatatttcatatacctgctgtattttgggagcattattgctatcatttggtttgttggatccctccaaatctcacgttgaaatttgatccccagtgttggaggtggggcttaatgggagatgttttcagacatgggggtggatccctgacacagggcttgatgccctcctagtgataatgagtgagttttctattagttgctgtcagagctggttgttaagagcctggcacctccctcctatcgattttcttgctgctttgtcttgcttcctcgcttaccatgtgatctctgcacatgctggttctccttcaccttcacccacaagtggaaacagcctgaggccctcaccagaaatagctgctggtaccatgcttcttgtacagcctacagaactgtgagccaagtaaacctcttttcttcataaattacccagcctcaggtattcctttatagaaaaataaatggactaagacagttgttaaataaccttattttgttgactaaaagtaattagtattttatgacatttatttattatggctgttaacattacaatttatcctggctaatttcatcagtaaacactcttatgaaatgatactgtagtttactttcaaccaagaattggttgactttgatacagtaattagattaggattcccacgtcagattttctttcaaaaataattcctattattatgtggaagcctccttttctgatttttttctcttattttctaagaacataatatgtaaatggatgtataatgaatatttgtggcaaaaagcatttgtctaagaagaattaagttgattcagctgttaaaggggtcttagttgttagagctttttggcggtttatttgctataatcaatagacttattaatacttttaattttagcctaatagtactaatagtcacattttgactaactattgggccagtttttctttgtcattcattggtagttgagtctctgtagcctttatactgccctatttttggtttgccacattttaaatctcaaactgcctataatttatactgttagtctttggaaataagtttgaattgactattctgctaaactcattttaatgaccatgctcccttgtgatgagctaaatttatttattattgtgttgtcgtattaatttttttttttttgagacagtctcactctgtcgcccaggctgcagtgcggtggctcagtctccacttactgcaacctccacctcccgggctcaagtgattctcctgcctcagcttcctgagtagctgggattacaggcaagattaatgttttttatttgtaatcaatttaagcctaatacatgttctaataatttttgtatttcatatatggataaattataataattcttttaaagtgaaagtattgatgagagatacttttttttggaatagctcattttaagcccctgatacttgatatggataaaatattttcagtgtttaataaaatgttgaaatatatttaactttactaatttgagccctgccaattataatactttagaaaaagtgaaaatataatagtacatttataaggcttttaagtattcacaaaatagtcatttcccagtagatgtttttcagctcttatgatacagtgttttctttttcttttggccatgtattgatcagaattagtcattaactttactaacaactggatttagtttgtcagccttgatggtttggttacacagatgtagctattgtgtcaaccccactgttttaaatatgttcctatgccaggtgaaatttgatccctttaagcaaatttctgttaaacactttgtgtcagtttcagtaacgtttccccaatgaacattcctactgtacaaaattttacatatgtgtatttacatatttatacttttttcacaaatgtgggaatttaggatactatgtttgtaaaaattgggcaatttttcttgaagataatttttaaaattacagcaaaacatagggccctgagaagaagaggtaaaatatatggaagagcaagtatgtatagataattttgtaacgtaaccttgagagaaatatagaaaactgagacaacataagccaaaggaaaggaattgggatgtaaaacctttagggtagagcagtgctctgctgtggtcatttatgccttggcattaagttcttttgaatataaaacaatgcatttagaaggattttaagactatatcacagtgcactggcattttcttcttcaattttccagggctaaataaggtaattgaataataaaacttaaaagcatttttcatttcatgaagatccaagaaaaaatatttcataacaatttttatttacaagaaggaaaaacatattcataagaatcttagatgattagtaggttaatgaaataaaaagtttgttaggaagaaggaatactagttattgaacaatgccaattttttctatttaaaaatatttaaaatgccattagttgatttatttaatgagccatcagcctttattttagattcactataactctgatctcctaaacctgcttttcctatcaggtcttaaatatttcatccctgctttcttttacaatatagtttttgggaatgtaactatcatgttgataagtaatgctaggtgaaggaaaaagttaaaacaactccaatgctaggcagtgatataccatagaaaaataaatgagccaaagataggggaagtgattttttttggaggaagaaaacagaaatgagaacaagaggacatggatgactgctgaaaaactgaccaagttcctcttcagtcttctaacagaatttggaagatgttcttagcatgcaactgttggttgaaaaaaacccaaatgtacaagggccatcagttcttaaaagtggaatagtgcatagaaagcttattgacacaacatagcagtttgatgaaatggactgaagccatttctgtggagtggactcgtggaaaatgtgatgcctgattcataaaattgtacacagttgaatgttgctatataggtaaggttttgcaaactcaggactctcaggaaacatcaaaggtatatagttggcacacttaattttagatatgtgtgatacgtttgtgattttttttaaaaaaatatttccaggaatgcttaagaagattataccacctcatgctataaaataaaactaacttggagaattcaacaatgtttgctgttttaatatgcatcttacaaagataattataaacactgagagtatttactgcaatgccctgaatatagtatgcctaaagaattttctgtataaaaataattgtatttattttagttaaaaattgagtaaaatatacatgcatcaaaataatttctaggtagaccaaagtgatatatgtaaagaaagacaaaatcaaaaatcaggaaattgctggtgaatatctaatctcgggatagaaaaatatttttttaaatcacaaaagcaatcagtaatcaaaagaaaagatgactgataattattaccatataaatatttttaaactcatgtgttaacaatttatagaacaaataagttcgagaaaatgtttgtccttagcatgtcagttaattaaaataaaacacagaaacttcatacagttcagcaaaggacatcttgatttgtgctttggagaatctattgagtttttttggttactgagtaatagtttagttagatgtgttgctatagctatacattcttccatcttatgttttcaaaatattaagtgtcctcatttattttttgtgtaattgagaataaactgaaatcaagtaatacacattctctcataaaaataaatatactcggtcattgaattgtaaagtgtggatcccaggatgatatcatcatcacctggaaacttgttagaaatacacattcttgtcccctgaccaaaatctattgaatgagaaactctgagggtgaagcccagcattttaaaatctaaaaatccatgttttaacccatttggggatactaaataaactgctgtagtccttcaataagcccatcacacattttcaccatgtcatctataggcactttttctacggtgttaacatcatcttcatcatcactattatcataatcaccttgattaagaaccattttggctatttccccatggatcaatgaatgaataattagagccgcattattgctggtaaaaacttacatgacatctgtttcttccatcttactgccagactctgaaggtgtatttttttgtatatgtatggaggtcagacattattttttttctcatgtgacatatagaaaccttcaaagtcaccactttgttcatcaccatcactgaacatagttatagcccagaggttgtgccaggcatgcacaactgtgtatttgtcactgtattccaaacatgggcattcttcgtgctaaactccttttgaaaactttccacactcatgcctctgttcactgttgctagcatgctgatcaagaaactttttatatttattctttattgatccaagaacaccctagtcacatggatgaattaatgaagtcacaattagggtaaaatacatgacctaaacatttttaatgagaatttctgctggatgatgagcagaatccttatcaagcagtgccaaaatcttgcagtcgttaatcattcagtctagattccctacagcaagcaagagccactagtaccaaatgtttgtgaaaccaatcagaaaagatatccctaattctctatgcctttttgttagcataataatttactggaaagaaatttactccttgaaaacaacaaggatataagcttttgtctatcatagcaaggttttctttatgcatgcgtgctgcattagcacatcccagaacagttattctgtccttagcatccttaattcctattgaagctgtctcaccagctgtagtcagtgtttttctggtgcaataatgccgaaacagtgatgtttcatcagcattacagacctgtcctggtatcagattttcatcagtgatgaccttagtaacctcatcagtgaatatctcccttgcttcatgatcaggaaatggtacaaatcttcaaaaccttaacgctgtgctttttcttaaatttatgcaactagcctgttgaatgttcacagttcccttcaattttcagttcatcgtgatagatctttgcaagtttcatgttcagcataccattaagtggcatgtattcactgtgacactgatggttccattctttcaatacatattcaaggacttcatatttcactccatgcattgcttttctatttttcattaacttctgttcatcactttcagcatagaacttccaacaatgtatccttctctttcttcaggtcatacatggtggtcactccaacactatactcttctataagacattttccacttataccaccatccagtttcttcaacagcttgactttctgtgctatagataagtataaatgcttcctcttttctttactactgttactcataagggtatctgcagatctttctacattttccacaatacctttataccacagagaagagaataagcaaaacaaaacaacataatgagtaaggcatgtaggtcttggcctcatgtagggcatcacaggcaacccgccattggtgtgtcttgcctgacatgtgccattttattaccctttgtggatgtgcctgcatgacgaagtctggggcatgtgtggaaaagatacttcacagctgaagggggctgggagggtctctttggagacattaagtaaactgtgtgttgtgtatctgcattttgactgtgatccatcatatgaggtcaggtgtggaattttcaacttgtgacttcgtgtcagcactcaaaaagttttggatttgggggaatttcagttttggattttcagattagggatggttaagatgtaatttcattatgagtaaatagattaaatactccaaccaaaaggcagagattgtcaggctggattttgaaaagcaagatccaactatcttctgtctacaagagacaagcttttgcttttccctttttttttttttttttttttttttttttttttttttttttttttttgagttggagtctcactctgtcagccaggctggagtacagtgttgggatcttggctccaagcaacctccacctcctggattcaagtgattctcctgccttatcctcctaagtagctgggattacaggtgcccaccaccatactggctcatttttgtattattgatagaggcagggtttcaccatgttggccaggctggtcttgagctcctgacctcaggtgatccactcaccttggcctcccaaagtgctgggattataggcatgagccaccacaggttgccatgagacagactttagattcaaaaatttagtctgaaagttaaaaggatggaaaatgatatatcatacaaacagtaaccattaaagacctgcagtgaatacactaatattagacaaaatacactttgagacaaaaataaataaaatacttgagacaaagagtacatttcataatgataagggggttaattcaacaggaaaatagaaaagttatatatatacctcagatttccccaagtacatggagcaataaatcacagaactaaagagagatatagacaataataattggagacttcaacaccccaatctcgataattgatgaacaactagatacaaaattagcaaggatatgttttgtatcacttaacacttacacaacacgatcagcagactactgatccaccaactctatccaccaaacaaaagcagaatagacattcctcacaagcacacacagactgtcctccaaaatagaccatattctaggccataaaacacatctgaatagatttaaaaggaataaaatcacataaagtacgttctttgactgtaacagataaatgagaaaccaccaacagaaggtaaaatccttttgtggtgatggaaacattctaagactagattgtggtgcaagtgagcaactcatttactaaaaataatcattgaattatatacttaaactataaattttatatgtaaattatacctcaaagctgttaagaaatgaatgaaaggagaagcacattcactatagcaacaaaactttaagaatacctttactaaggaatatttgtgacctataggaataaaaagtgattaagctttgaaagaattaaaaagagataaataatagacaaactatgtttccatatatcaaaaataatacttccaaatgtcagttacctccaaattatagatttgacacaattttagtaaaaatcataatgaaagtttgattttctgacttaaaatcattctaaagtttatctggaagattaaaaacacacaaaaattcacagaatattttgaaaggaagagaaatgaattacacaagctatggtagacactgaaccatattttaaagctacactgtactagctaaaatataatatggatataggagtagaagattaaacaaaataagaaataaaacattttatttgtttttagtatgtattaaaaatacattgccaaacattttgaaatggataattcaataatttttattgatataaagagttgcatttgatctagcagttatacttctgggaatttttttaatggaaataatcctgaaactgggtgaggcaaatatgaattccagtttcattcgtaaatgtacaaaattggaaacaacctaaacacctaggtaggagattagtcaaaataatcataattgtagttgtttaacttacaactcagaagtaggcatcttatgcagttattaaagtaattttaagtagcatgtgaatataagaaataatgcttataaattttatgttaaatgacataggacgtaaaggtatataaatagtgtgaatataagtatataagcaaaacaaaaataacttttcatgaggagattaatgggaaatataccaatatgttaatagtaattttgtatttgatcatagtttgagtagaatttttaaatatttataatttacaattataaaactaagcactttttttttttttttgagatggagtctcactctgtggccaggatggagtgtagtggcgctatcttggctcactgcaaccttcgcctccagggttcaagtgattctcctgcctcagcctcccgagtagctgggactacaggcacccaccaccacgcctgtctaatttttgtatttttagtagagacggggtttcaccatgttggccaggatggtctcgatgtgttgacctcataatccacctgcctcagcctcccaaagtgctgggattacgggtgtgagccaccgtgcctggctgcaagcattattttaattaaaaatttcccaataattatatcaaaattttagaatttatagtttagttttcaggattcacagcaaattttttaaaagatttctatttttaacatattcattatattattattagagtttggtgaatatgctaaatgcctctcccttccatgagtttatgaatttcaattatatcttctcttcaccattgggtatctggcctaatcaatattaatagatatttaaccacattttaaagctataataattaaaatagtataatacttatatagggaggaacattaaatactcaggagatgtaatttttttagcctcttaatttggcagtgtatctcaaaatgtggtatgtatcaaaataatctggccccaatttcataacttctaagtgggatgcagctctgccatgtatttgttgaaggcagtgatggtggcagtgattctaaaagagaaattctcaattttgtagctgattcgcatagagggcttgtgactccatcacctactgtctgtgtgaccctgtgcaagttacctaaccttccatgcctcagactcttcctctctagaagaactgagcataataatagtgccttcttcatcggattattatgatagttacatgaattaagacatggaatgtgccaggtactatgtatagtaagtatcaaatatctgctattattatgctaaggcctgttattacaaagtaaagttacctaatatttattattttttacgtgttataaattgttaggcacactgaagatataaatgcatgatctcatttatttttcatatccactcaatatgctgaatgttgtcttacccatttcagaggttggaaaagtgaggtccagagaggcttagctggctgagtgtgactgagaagaaaaggcttggggctgcaaactccacagagataaaggtgaagtaattttccagtaaatgttggggttgggatcaaaattatgtgtaatttatttcaaaagccctcctagtgtttggcacattttaagcatgcaaactttgaaagcataccttggttttcctgggttcatctgagggcattttcgtttagtaggtctggatgtagggcccaggaatctgcatttaacaacaaacactcccaggtggttctgaggctggtagtctaaggatcacagtgtcagaaactccgcactaggtcatgttctgagataactaagaaaggatgtaggaagtaatcataaagggtttcaaaatgtgtttaaggtcatatgtaactagttagtatctgaactgaaactaggtgttaggtgccctctcaatccattcctctttttcacatcagagaccttaagcctggatttttctcttagcctagcatcaaatcagctaagcccatgtctgctatttctctaacctcttgctgggcttcagcaaagcttctgcaggggagagggcttgtttatttttagtcagaggccagaccagcagaggagctaaaatgctccaactgtctgcattaacttttcatgaagtttttgggaaagaagagaatggccttattaggtgtaaaccttttttatcctgaaattattttgtaattgggaggtttgtttttattataaatttcaataccctgggtacattcttgtaagttctaatgctattctctaagctgctgatcatcccaaacagctgttcgttcctctgtagtccaacctaacctcagttagatttttgagagaatggatggtgatctaatggaaagagtaaacaacttggagttaggaaatactggttaagcattgtcctgctagacactagttaagtgaacctagaaaagtccctgatcctctgcaaacttcaattatttcacttaaaaaattgagataataaggtcttagtatctaacatcagaattatgagaatcacatgaaataagttaggtaaatggactttgcccactcttctatgatgttcaatctcttgttagtattagacccattttatagtctgacccatttttattgtctgatgtggtattcctgaggccccaggtttggagataataatatttcttcttcagaaaaataaatgacagagccatggctgtggagctttcatagacacagggctctttagctagtgaagcaagaactggcaaagtaggaacacacaaaagttaatgctgtcatgtttactgttaaaactggcattttgcacaatgtaatggacttttaatacgttagatttcttatggaaaaattcataaggtaaggtaaaataaaatcaagatgatgtttaattgttcttttttataatagggttcagatattcatgaagaatgttttcaatgcttattcatttccttcccgcctcccttttcttttcctttctcacttttttaaaatttctttttaaagagacagagtcctactctgtcactcaggctggagtgcagtggcgtgattctaggtcactgcagcctccaattcttgggcttaagcaatcctccacccaaggctcctgagtgactgagaccgcaggggcgccacctttcccagctaattcttttttattttttgtagagatgggggtctcactaagttgcccaggctggtttcaaactcctggcctcaagtgaccctcccaccttagtgtcccaaagcattgagattacagacataagccactgcccactgtcttttccttactcctacttttcacatttctattcctattctaaaacttacttttataaaaatcattttaaacattctggatttatggtggattaccaacttctctcacatgtttaaattatcttcctaataatgcattaaagacttagggagggcctaattcattttggtaaggaaagcatacaactttttttgtgtgtttgtgtgagacagggtctcactgtgtcttccaggctggagtgcagtggtgtgatcttggcttctcctgggttcaagcgatcctcccacctcagcctcccaagtagctgggaccacaagcacacaccatcatgcctggctaatttttgtattttttgtagagatgaggtttagtcaagcatgcaactttttacctgaagcagccatttggtgattcaccagtttgaaaaaagcagattcatcaaacagtacctagctggatgatatcattccacctctcattcaatctgtagagcaccaatgagtgtactaaattcacaagagataagaagtcttctgtaaagaaatccttactgttgctcctttaaccccttagattgaaagaatattgtttcccccctccacttcctctccttctagtccctcttccttctctccctccttctcttctttaaagttaggataatgtgttgcttttgtttcagaagcttacatacattgaacttgattttttaaattcagacttcacccgggcgatgtaatgacttgtgatgatttccaagaaagtattatttccaagtagcataatactcttgtataaatctgggaaaaaaatctcctcttgaattttcatgttattctacaaatacgtttttaaaaatcttgcagccattagttttcaaatgatcttattcagggaaattattgctcactttcttgaaatttatgaagaatttacattcttcataagatttagtattttattatttgccgtatttcctgcaggacagtaattgtatcttatttctctttatatttctagtactatcactgtatgtgttacctagaaggtgctctgtaaatgattttttaactgtttttattgcttactgaaaactcagaatgggaaactttggaaagggtgagacctttgtagaaatgatttaatcctttctcttccactcccaccactcatttagtaagccaaggtataagtccttgctaagagaaaggagtttagataaaccgttgctaagaggcaggaaggtatacctatagaaggtttcctcagaggccatagagaatttagggagaacgagatgttgacatgaccctggtccctaacttgaaattatagctgtgagagtttccttttctgtgcatcggaacattctcaagggcaatgacagagaagcacaagggagtaagctgccatatcatttaaaccaataaacaaactatttcatgaaaataaaaaccatttaagattgtaaaaagccaaatgtagtaaaaagtccttttgtaataaaggtggaaatacaatctcatgtatagaacagaaacaaagtaatactttaagaggaaaaaaatagtttccaaattctcccaaggtttttttcactcataatctttctttccatcacttgcttgttctgtgactgtgagcaaggtacctgcaaggtacatacctctctatgcctcagtttccttatctataaattggggatgataatagtgatatctgcctcacaggttgttaaggttaaataagtcaatattttaaaaacaaaaaagtacctggaaagtactagggacaataaatgcttgttaaataaaatttaaaaataatatatttactaaagcacatttatatactttcttttaaaatatggccctgttggtaaggtgtttttcccagcttgctttgaactatttgtatttattttttgaaattaaaaaaatacctgcctatctgtacggtagagagaaagaagggaaagaaagaaggatacagaaaaaatgaaggaaagaagtgaaagaaatagaaaggaattactaagttttctttaggaaaaggggcaaaaactttgacactgctcagaagctaatgtttcactgattcttctcactttctactttctgttatgctatcctagggcctgaaaatggttataaatacaataagaagtcactcccatataattctaaatgtttattctgacaaatataataaaatgattatagcagtactctgtctgctaatataaggctactgctattgtcatgcacagaattctcccaatattagagttttattttttgttatcagtaatcctcaggttcagtgtcatccctttctaaccaagttactcatctggaaattagtacatatcctgagaattgaagacaatacagtgttaaaagtaagaatagttgacttttcaatttcatgtttttaggcatatgataggcaggtttatattataatttttaactaatctgtcatttgaattctctattttcccccaaaaaatcttttcaaatgattagcaaagactgttcggtttcttcctttgccctgtctcaaaaaattagaggaaaggtttggaaaatgcttttgaagactaatacttttatgtaactattttctaaactacattaacctgctacatttatttataatgagtttttaataatgttatgttttgttttcccaaaagtatcacctattttattcaactaaaagttctatttatatgtaatacataaaactcagatataccttagacttgaaagaattggaataaagttggagaataaagaaattaagggaccttcaaactttatatagttggtgttaaatattgatgtctttccaaaattcatatatagaagccctaactcccaatgtgatgatattaggacttggggtctttgggaggcaatgaggtttagatgaggttgtgagggtacatctcccatgatgagattagtgtccttataagaaaaggaagaggccaggctcagtggctcacacctgtactcctagcattttgggaggccgaggcgggcagatcacaaggtcaggagttcaagaccagcctggcctgaacatagtgaaaccccatctctactaaaaatacaaaacattagccaggtgtggtggcatgcgcctgtagtcccagctacttgggaggtggaggcaagagaatctgttgaacccgggaggtggacgttgcagtgagccaagatcacgccactgcactccagcctgggcgacagagtgagactccatctcaaaaaaagaaaagagacactagagcttcttctctgccatgtgaagatacagcaagaagtagtcagcaaggcaggaagagagccctcaacaagaactaaatgtgctagcaccttgatcttggacttcccagcctctggaactatgaaatatatgcctgttatttaagccatctagtctgtggtattttgtagtatagcaactgtgctaagacattcagattttcaggttctgagagcttaatatgaaataaaaaactgttgctgacatggtaggtaatattttaaggatggtttgtattttttccctatggctgtccacatagctaccccacactattgtcttatacttacaagcaggacattaaatattagtgcaacattagttcttacctttaaatgattgtttttctctagtggaacttcaaattggtctgaaaacttaaatacataggttgtaagtttaaactttttaaaaagttaaactgtccttatatggactgctggaaagcataatatcctaagaaaacgaagtaaattattttaaagggaaaaggattagtcttcaaaatgggaaaaacttgagttcattttttccccttttcaacagaatctaggatggcaaaatgacataggaaatgccacctcaaaatctagacagtatacataatcagtcttacatcccgtgggtcacaataaaggagctgtttcagcatcgtaaacattgttgcaaaatgaatttgaatgggttttggcagcaacagagcagagaaaataaccacctttcagaatacataacttaaaaattcacttgtaagcccacaagctatccaccatttttacattcttaaaacatctcattgcccatctttaatttaaaaatatttcaaaatcagtaatattttcaggtaagtttcaggtatttgttgttatgctttggttaaactgaaaggatttgcaggcatacaaaatcagagcccttcaaataatgcctcacataattaaatgcaatcttgtgtttggtttgagttatttccatctctctttattctgcaatctgttgacaatagccagccaacttacattctttggactgatgatggcatattttttaaatcccttcagtgttggcattactaagctttataaaggtgttatatctctcagaggccactgttgccagcattgcagtaaaaatgtgtaagaatcttgtctatgttacttctttaaccttttcatttcttttagttttgtataaaaattcataagcttgtaaaagtattaatccagataacttggaatgatttttctttttcattctggatttctaacagatagatgttagccttgcatgaagaggaaatccagaacattgttgattttggttaaaaaaaaagaaaacacaagtctataggatttattctagggcttaaaatttttgcaaaaaacatggagtttttatggtcacactaataaaaattatttgcttgaatttttattttcatcctgcaactatttacttccaaattgaagatgtttttccctgatagactctgtgatcctctgtgatcacttttagaaatagtctatcttcttactttctaattgtgttacttagaaatgtttcatttcctctattgcatttcttgtctttttaaaaaatatctgtgtgagtgtctttagatatgtgttacaaattggattttaaagatctgtgccagtgtacctgcctgaaattctttactgcctctgccagtgtatcaagtttaataccatgaacagccgtgaataacttcagtctactcttcattttaaatcttcctaaattaattgctttgtaaaggtattgctaatcccttgcaatccagagatataaaaaatattatactctaacacttagtacagcacagagataatttacagcattagtcaaacagttccaaagatgtcatcatttataatgaccccaccctagggccattattttactacataatatgattaatgtgctgtcatttctttctgcttaaactgtagccgaaagtaaaaagtaacacattttggccttcagttttcttagcctgaaagaactggttatttttttaaaaatttagcagcttatttcacttcaggtttttcaaaatattcatatctgagataacatctccattgctgaggatagtgaatgagttatattcttgaatgttacttggttgattctgaacatcatttaaatgccccctttttcatatgagatatagatccagtgtaaatattgtttgaatgtatctggtgtggtaatatttgaagatatgggatcaaaatttacaagatccaaagtcaaatcttcacatttattttagctatttactgcctttaaaaaaactagaaaagtttatttctatcatccataattttctttatggccgtgtcctcaaaggacttaacttctgttgattctccaatctggctgcctacatctttttacctatatgactttcctcacatttttctctttgcctagaataacttccattcccccatgttcaatgtctatctaacacttaagctcaggtcatatgacacttccttcaggaaaccttcctggactcccccacaaacaataataagtctgtttctcatctgaaattatatggtaatttatatatatatttttaactgtgcatattttctaaataggttcaaataaataatgtacataccactaaatattctaaagtctaggggtcctgtcttattcatcttcatatgccctagagtaccaagtaggtcctcaatctatgtttgtcaaataaataatgtatatagaaaaacggtggtcattttgggggaaaagaacgatcttacctaaattggttgattaaaaacatttttacaaatatgctatataaagtgttaaaatatcaataattaaaagcaaaattatatatattacagacaacttcctagcattagttgagggggaaaaagaaaacagccaaacaaccaaagaaacccttgccaccaatgtaaaattatgtttagcataagctgttggaggatctaagaatgaatgtagtaagatattgctaaggtaatttttattaaggtttgatttttaaaaattagatttgttgcttttggccacaaatgatataagttacctaggaatcaattgaatcaaagatgtgaaagatctctacagggaaaactataaaacactgatgaacgaaattgaagagggcacaaaaaaatgaaaagatattccatgcttatgaatttgaagaattaatattgttatgacaagcagctcacagatccaattcaatccctatcaaaataccagtgatattcttcacagaaatagaaaaaaaatcataaaatgtatatggaaccaccaaagaccccatatagccaaagcaattctgagcaaaagaacaatgctggaggcaacccactaccttgacttcaaaatagactataaagctatagtaaccaaatcagcatggtagtggtataaaaacagatacatagaccaatggaacagaatagaggacccagatataaatccacgcatttagagccaactcattttcaacaaaagcaccaaaatatgcaatggggaaaggacagtctcttcagtaaattgtgctgggaaaactggataaccatacacaaaataatgaaactagaccccatctttcaccatataccaatatcaaataaaaatgtataaaagactcaaatataagcctgatgctatgaaactcctgaaagaaaactttggggaaatgcttcaggacattggtctgggcaaaacatttttgtatgagacatgaaaagcacaggcaacaaaagcaaaagtaggcaaatggaattacatccagcctaaaagcttttgcacagcaaaggaaagaatcaaagtgaagagacaacctacagaatgagagaaaatatttgtaaactatccatcaacaagggataagtaactagaatatataaggagctcaaacaacttagtagcacacacacgaaaaatctgatttaaaaagggcacggctgggcactgtggctcatgcctataatcccggcactttgggaggccgaggcaggcagatcacctgagatcaggagtttaataccagcctggccaacatggtgaaaccccgtctctacaaaaatacaaaaattagccgggtgtggtggtgtgcacctgtaatcccagctacttgggaggctgaggcagaagaatcacttgaacccgggaattgcttgaacctgggaggcagaggttgtggtgagcagagaccgtgccattgcactccagcctggcaacagactgcgactgtatctcaaaaaaaaaaaaaaaaaaaaagaaaagatctgaacagacatgtatcaaaataagatatgcaaatggccaataggtatattttaaaatgctcaacatcgctaatatcagagaaatactaatcaaaaacaaggagatatcatgttatcccagtttagatggttttatcaaaaagacaacgaaaaatggatgctggcgaggtatggagaaaggggaaccatatatgtactcttggtgggaatgtaaattagtagagtcactatgaaaggactatggaggtttatccaaaagctaaaaatagaactaccatatgtagtttcactactggatgtgtagccaaaagaaaaatcaacttattaaagagatatctacactccatgtttactccagcactagtcacaactgccaaaatatggaatcaacctgagtgtccatcagtgaatgaatggataaagaaaatgtatacctacaaatggaacattattcagccttagaaagaatgaaatccaggtgggcgcggtggctcacgcctgtaatcccagccctttgggaggctgaggtgggcggatcatgaggtcaggagatcgagaccatcctggctaacacggtgaaaccctgtctctactaaaaatacaaaaaattagccgggcatggtggcacacgcctatggtcccagctactcgggaggctgaggcaggagaatggcttgaacctgggaggtggaggttgcagtgagccgaggtcacgccactgcagtccagtctgggtaacagagactctgtctcaaaaaaaaaaaaaaaagaaaaaaagaaaaaaaaatcctgtcattttcagcaccatggctggaaccagaagtcgttatgtttagtgaaattagcacaaaaagtgaaatgggcacaaaatttagtgaaatgggcacaaaaagatgactattgcaggttctcacttatatatgggagcttaaaaaaacgtggatttcatgaagatagagagtgattggagcttaccagaggccaggaagtgtagagggaaggggggaaatgaagattgattgattaatgggcacaaatatcagtacagtgactacagttaatattaatcaattgtacatttctaaagagctaggagagaacaatttgaatgtttctagagtaaagaaaagacaaatatttaaggtgataaataattacccaaatttgatatgaatatatcaaattatcacatacactgcaaaaacatgtacaactatgtgttaataaaatataaatcaatttaaaaagaaaaaatatgtattttgataaaatgtgtaatatatttggcaactttaaatagagggctacactggtaaacctgaaggaaagcaaatttaccatggattttgtgacctttccataccattttgatggataatttgggccttctaatccataagttgagagaagaacatcaattacctgtaggctcatacagatcactcaccttgcccaggacgctgcctccaaacaggtaagaaacatatatcacagaagggcatgattactggcattaacatcagccaatggccaggaacttgatccaacatatcctggctattctcttcctactctaatgaacaccttcctacttattcatccttcaaggttgaaatcaatgtcaccttctttggaaagctttcccaagcctaattaattactttctcctttatgcttttaaagcacttctacctatatctgtaaaataacttaatccagtagctttccccttatctgtagtttcactttccacagtttcagttacctgtggtcagtcattgttcaaaaatattaaatgaggaattccagaaataaacaattcataagtgttaagtgctatcttatgatgcctgtgacattcacctcacttcatctcattacatcagcattttatcttctccaatcatcacaaggaaaagggtgagtacagtacaataaaatatttggagagaggccacattcacatagtatgcaggattgttataattattctgttttattattagttactgttggttatctcttactctgcctaatttgtaaattaaactttatcataggtatgtacatataggaagaaaacatagtatatttaggggttggtactatctgcggtttcaggcatccactgggggtcttggaatgtatgccccattgataagaaggaactgctttatttatatctctgcatgatctctaactgcctgagactcagagacaaagtctagttttctgtacaagtctaccttctagcatagtttttggcacttgtgacttttccctttcattataatcatagtacttcatcttatggtacacatattctctcatcttttaaagtttttctaattttcatttctgtgaaacctgcaaagaagtgtaaaagatcacatgatcaaggacacagtgaatagacagccagcttcccatgcctcttgaaatcttttagagagaagtgagaaatttggtaagtcagagaaacctagattcccagtcgcaagtcttttatagaattaggcagtatggggatcactgctctcaggtgcaggctattactatgtgatccttgctgtgtctaaattccatccttccatagtcagtttcctatttcatctagcttacagcaggcctaccatcacttactatattacataggttctagcatgcataccaaatacttgtattttggcttcagttttcacttctttccagttgtctaatttgatggttcagtaatttcttactcctctacaccttaaacaagtcacagcatgcccttctaatattcccatagtgcaattcctatgctttacccaactcatcagcctttctccaaagctttgttgaagcttcacttggtcctggtttaaatatgtattgctgaagcagaatgctttgaccctactaggtactcacactcactcaaataccctttgctccaataaataaataggcccaacttttttgtctcaaattcataacaaatattctgatagaaataacaaacaagaaaataaaacttacaatggctgaattttacctggagaggacagtaaagaatcatgacgtctttgtgaaaacaacagtggcccagggaaaatcagatcttagtaaaagtaatgaacacaaaatagaacttacaccaactaaaacagtaacaaggtgtcatttgttgtggaacacaaattgacagaagaatcaaagcttggtactatttagatcatgtacagtgaaatttcatataattaatggccaaacgtacacatttataatggtagaattgtagttgataattcttgtctataattgataaaacttgatatgggcaaaaagttttccatgaatcaaacccctatttaatttacagaaaaatgatagcattggagcattttagaaagataaaaatgaaggtgaacaaaaagtgaaaatggttcaagtgcattgaatagacaattcatctagtagttaaattcatttaatgaaattcactctggaatataccttttccacaaaaattcatctatgtcagtatacttattgaaacacttgtaattttaagcatggggtcaaaacatctccatgtcaaaatagctggatcaaaatgctgtttgcccatttcatgccagaagttcctccattataaccactgatgcttcccttagaagtctgtatgtaaatgatttgggacttcactgggccatatgtcaccattaataacagaaagtgtttgtgggtttgcttttcttctttagaaaatgaagagattgtttttatggataatggtatttagggatttttttttctattgtttaaattaatagtcaatatattttaaaggattaggtgttggggaggaaataacaggaaaattaagtttactctgccaaacaggcattatccctgagaagtagttccttcttattctgcactataaatccttttatcaccatgtatatttctacaggggctactgctatcttgctttggtagttacagtaaatcaagataaagacaccagtctgcttggacttgtggagaggtagcaaacaggtatggaagacctggaatcgacttcagaaatgctcacgatgcttgggtaccctgatgtggtactacctagcctacttgggtcaaatgacttttgcaaaattctataagatacttagcattctcctgtggcaattatttgttaacaaaatgctggaaggaagagctctaaagattttcttaaatatatctgtcccagggatatcaaatgtttaggagaaatagtgtagtaacagaggtaagctatcaatttaatttcacttgacatctaatctagttgtgttaccatgatgttccctgactacgtagggcttctgcctgccattggacactaaataattaagaattagtttcttgggttgttgattatatcagaaagtcccaggttataaacgggattaaacagtgaacacactaaaggtataaagttatttattcagtatatttataaggcctcaacataatttatagaatttacatttagctatgtatttatccaagagagatttgttaagctacatttcagaaagatttactaactatatgtgtacatcaaattcaaagtaggcttatacatttgagctttatattggacagaattattctaatgacatagtaagctagacaattgagttctcctatagaaaacttatacttttttaaactaccaataaccattaccctattaaaaatggcttcacaaatatgacagtacaggagaagactcataggagaacttctcagtgggtagactggccattctgatctgagtgcaaataacaccaaggcagagtttacttaagcttatgtctataaaatttaagtgttgaagtgggaagatattaatttatatgcatggcctgttaaatggctagtttagagctatcaaataatcttgtatatgatgttatactatgttattctttgtgaaaaggtaataaggacagtgtaaatttcagggctacttcctactcataccttgttgataaaaatgtagattggttgaatacttcgaagagcagtttggcaatattgaatatgagctgtaaaaatacataaccattgtaacatgaagaccttatgtaaattaacaagaaaaactcatctgcagtaagccttatcgaaccccttgcctgggctaaatgctctattccaaataaataaataaatagtttgtaattagaggagggtttttatgttcaattgtgagatcaatctttaagaaattttaaggatttaatagtcttatataattagagcttgaagttaaagggaaaagatgttaaatgaggtgaaagtgagcagaaagaaatcttctgcatatagaggtaacatctcaatcagaagaaagaaggttaaaaaaagacccgcatcagttaggaagtggtaattacactaatatttcattattaacttcaatcgtaattgattgacttttttgacttactgttgtgatgaaatggcaacagagtagattattaactttcagacagaaatattaattttccctttgatcaatagcttaagatagagataaaataaaatgaataaggagaattatgcttgttcgtgttaaaaatttactaaccagcaaaggcatgagaatgatataatggactttggggacttggggagaagggtgggagcgggatgagggataaaagaccacatattgggtacagtgtacactgcttgggtgacaggtgcactaaaatctcagaaatcaccactaaagaacttattatccacgtaaccaaagaccatctgtaccacaaaaactaatgaaatacaaaaaaaatttatgagccaaagggaaatatcagtgtgtggctatattctaagtacatccagtttaaagtaatgaatatcgtttctcatctgacccatttaaagctgggcttccatgtgccactgtgtatcaataaaggcatctatgaaagagcacgggggaggaagtcagaatctctaaaaactagctactcattctcatgtacaagttagattatttggggatttgatttttctatccattgtgtagtcataccatttatgttttagatattaataagcaaaactttggacataccaggacactcatagatgatttaaactttgtaatttatgttacccatttgacccccattcaaagactcactaatgaacttttaacccttaacttttcttggcaagagcattatatttaaactggaaatgcatagaaatcatcattggaacatttataaggatcattcctactgtaattcgctaacaactcactactaggtggattgctttttgttcagttttgctcttttctggtttacttccaacctgtttactgagactgtcttggtaatgcaaatctttcttctttgttagtccacagacagtttgctcatttcggaagaaagctcctgactgaggttctttagatgcgtttaacggagggacagctgtgcagaagcatcactgtctcactcttttccagactgatcaaatgaagcgtctgtcatgtcacacatatggagttctctaccaacagcaaaggctatttagtcaaggttagaaacaaatattgtgttggatttttgcttatgatatgttttggatttttctttgaagctctgatttgaaagatatacagaaagatatggcttgagggaggaaatatgaatattatcctcaactactcccatgttcataccatcctgagagttggaggcatcatgctgcaccttgggtatccttgaggagaaatcctttggtaaagactctagtcctatggattggcagaaattcccagtctggtgtctgacagctcctcctgtgcacgttttgaatttactgggcatgtgtcagactcctgaggggaagacatctcctgctctccaaagaactgagattccatcacaacggatttcaattgttcgagaataacaagtagaattacctttattttaagttggcttggcaattataattcatgttgtgccctatcacaattatcaaagtgaggaactcctcacaaagtaaacaaaggtctttcaatccataaaattagtatctcaattcaacttattttgagtttatttattttgcttttgagaacaaaatgtctagtgtgtagatagttaaaaattaaatgcagtagctatttataatgcctgcatttttctgcataccttatgctatatattagttacataactcaaatactcaagtctaagagtcagagtgttggaagggacttggtctgtacttctgagtcttctgagccagcaaggccacactctttccccatcattgccttgccagcagttattctatatcctatattcaagttcatcagataaagaaacttgaacagtttctaatgaaggagagcaggctcaatatcctgtcccgctttctaagaggtgagtgtgctatgcagggtccagggatgagatgtagcctgctttgtaccagatgcctgtcagtcacagaaataactgcttgctgtttgactatatgtataactggatgctatgaagtggagaatatttaagaggacctgaaaccatgtctcttctgggacttaagagtgtgtgggcttctgagagcagaggaggtaccaagaaaaccccactgcaaggatagctgtgaaagaaaataaccagggaatttgctaggccaatgtcctcaggaccttaagttagcagtgtgtgggaaacaacaaagcctggtaaatattaattaaattgcacaccagaaacagagataaagaactatatatttgcttcaataagcaagcacctgcaagatttcttgttttctgcctgcatagtagcatcctaatcgtcaaccatcaactgtccctagtctccctttccaggtaccagaatttcttacttataatgcgttaaatcaagtttagcctaaagttgcctccttacatatttttgagttcaacctaaacttttctctgtacattgtgaattataacaagtggaggtgtaaacagactgtagcctacacttgtgccagtcactgagttttggccaatcaaatgtagccaactgttcgaaccatgttcaaataaggcaaacaccaagatgtaaccaatccagctgtttctgtacctcactttcattttctgtatgtcactttcctttttctgtccataaatcttcttccaccacgtggctgtgctggagtctctgagcctactctggcttgaaggctgcccaatccatgacttgttcattactcaaactcttttaatttgtttgaagtgtttcttatatcaaatgcaacttacattttcaaatggcattggaatacaaactattttttcaaatatcttttatactatgttctaaatgcagccagccctctgtatccaaggggttccacctccatggattcaaccaaccataaaaatgttcagagaaatcattccacaaagttacaaaaagcaaaaacggaactggatacacatcaagtattatgtttaatccacaagaattaagtgatgtataggcattatattaggtatcataaataacctggagatgttttaaagtatatggaaggatgcacataggttgaatgaaaatactaggccaattaatataagggacttgagtattttgtatctgtaggggatcctgaaaccagttcccctcagatatcaagggacaactttaatgcacaagatgacccaggatatatgtcttatttctactttattataacaattaagaaatcatggcttggtggcctctgatctctttcacaagttaaaatgtgatccttcagggctctacatgaaaggtgatggtgatgtgggttccttccctaattacaggaacagtctagactacggtagccccagacaactacggagatgtctagataatgcatttacctaagaaaacatctcagctcatacactataaacattaaaattataaattataattgatatctatatagaaaaaagtgttactgtttggattcacataaaaattagaagtccatggaaaacatgtgctctagttaagtatctgatatcgtacataccaacctatctatttaaagatcttaaaagtatgaggcccatgcaccattgtattgatgctgtatatatgcaaaatatgaaagtatttattccattataaactatgtaacaatattattaaagtctccataaggctagggatcctggtggactagacagataacacaaattacatggctcaaaagcttacacttgggtgtacaaaaacacctagttttcctgaaaatccactgcacatttctgaaacaatcagactatattatggtgacagatattaaggttctgttggtacatgttttaaagtaaataggtattcaggcagagaatgttccagggagtataagcagaaaatctataaatcatctcataataatgttaaattttataaagaaatcaattatttcttcccttgttcaattggggaaactggattcaagaagtatctagattcataggaccgtctcgctgggtgttacctttatcttaccaccagtatcctgtgaccctgtcttcaggcatttaattcccagaacaaattgtgtacactggtgaacatgaacaaaagttttacaggtatttttataatatattcaaaaataacacataaaactgtgatttcagagttactagctaaagataaaattaaaaagaaagcttgaagcttgtccttaaaaaaatgaacaatagtatagatgatacaggagtgtgacaaaaatcatgatccttgcctaaaaacatgacaggagtttggaaagcaatggaagagaggcatacaggggcgctgagtgtgaggagctgcggatgtgtcttgcttcagtgtatgctgcagaaatctataattagtgtgaagcactgtcagagtacatcttcagtagtaaatgttattcttcctaaactgccatcaagtttgttatattgatgtggaatataaaaatcgacaaactttttaacacatgagagaacacagtaagtgaaagtatggatcatctcactgggaggattttggagatttagacatcagttagaccatttctagtatttatcagattatagatactttcaaattagattgactaaaaaaagttttccacactgtatttagagatatcagaaaataggtcaggctcatgcctgtaatcctaacactttgggaggcccaggtgggaggattacttgagcccaggagttcgagaccagcctgcggtacatactgggaccctgtctttacaaaaacataaataaataaaattagccaggtgtggtgacaggctcctgtagtcccagctacttgggagcctgaggagggagaatcactacagtctgggatgtcgaggctgcagtgagccatgatcatgccactacactctagtctgggtaacagagcaagatcctatcttggaaaaaaaagaaatatgggaaaataaatgaaaaagagacaaaatatagttgaaatgtgttccccaacttgcttgaattgtttacttactagggatgcagacttaaatagcataatttgttgttatactctcaacctaaaatcagtttcacagtgatgttatatgcatctacttttttttttttttttttttttgagacagagtctcactcttttgcccagctggagtgcagaggtgcaatcttagctcactgcaacctctgcctctcaggttcaagtgattctcctgccccagcctcctgaggagctgggattacaggcacatgtcaccatacctggctaatttttgtatttttagtagagatgggggtttcaccattttggtcagactggtctccaactcctgacctcgtaacctgcctgcctcagcctcccaaaatgctgggattacaggcttgaaccactgcgcccggccatacctacgtattttaaatatattcgtatatgcctctaatatgtaaaaatgaaccccaaagatcctgatataatttatctaaaatataattgtctaaaatataatttggacaaattattttaccatataaatgacttcatcaattttcagatatcctgcccacattggccaaattctacattttgtggggaaagggaaaagaagaaatagacatagagatggccaagtgctatggtttggatatggttgttttcaccaaaactcatgttgaaacttgatttctgctgtggtgatgttgggaggtggggcctatgggaggtgtttaggttgtatggtcagatcccccatgaatggcttgctgctgtcattgcagtagtgaatgagttctcactcttgtgagactggattagttcttaggggaatagatgagtttccttgagagtgagttgttgtaaagccaggacgccactcaggtttcctcttctttgctcctgtgtgcttcccctttggtctctgtggcaccacacaaaagccctcaagataaaccagggctatgccattgaactcagcctgcagaactgtgagctaaataagcctctttttatttataaattacccagtctgaggtatttttgctatagcaacccaaaacagactaatgtacaagaaatttgcaaagcccctctccctctatgccagacacttgcctaataatgttcaggaattatatgtaatgtatacaagctgcagtaaaaacaaaaaaaatctatatgggactctttaactgcaaagaccttgagatgacacatctttttcaatgtattttgattttactacaacaactagctcagagggagctttatagggagcaatattactcattaactctttgttgaatgaattaatgaactagtgagtggattaataaaattaggccagttaagggaacacactgtttctacgccagttggctattttgggtttaaatatttttaaaattactgttggttctgctctttttttttgaaacaaggtcttgctctgtcacccaggctgcagtgcagtcgctccatcataactcactgcagccttgaactcctgggctcaagcagttcttctgcctcagactcccaagtagctgggactacaggagtgtgccaccatgcccagctagttgtaatttttcttttttttttttaatagagacaaggtcttgctacattgcccaggctggtctcaaacttctgggctcaagcaatcttcctgtctcagcctcccaaagtgttgggattacaggcatgagccaccatgcccagcttaacgcttctctcttgaaggctgagaactaataaattaatctgcctttgattggctaattttctcaataagaaaaacaaaaaaccacatatcagtcatccacatgcccatctcagtaatttattccccaaatattattcttctcagttacaaaatttgagaggaaacttagttttttcaccaaagataggtgggataaaaataatatagtgtgagggatttcaattagacatattacaatatttaattagacattttaaaaccatataataaggtatgttcatagtaacaaaccttaatacagtttgataaaattttgtaaaatcctcttccctggaagtcattataaaggcattcttagtgattttaataacttaatgctttagtttccggtttaaagccaccagctgtctaatgacagccgaatgcactgatctttaaaaaactcccttaaagttttatgattcaataaacacaagacctagcatttatttaggatttcacgtttcacaaaagcccttttaaaaacatttttatcatttaatcattaccacaatcctaattagtatgcctaattatgtccatgtctttactgcagaaacttattcttgattgagtgattttcataatgtactacagatttgtgcagcacagaccttggattcaaactaaacttagtcacatccaattacatcatgttttatcgtgttgctgataatcatgatggcaaccacctctactctacagagaaataagttcactttaagacaggctttcactgtttaacaggttttccctcagctataaatagcatagtataaaattccattctttcacattgttgcacttaaaagatcaagtcttatctggtattaaaaagggaaaggatctgccttttcctgtatgtaaattttatctgaatgaaaagattaacagaattattaataaccaataatgctatgaggtaaaagctactcagtaataggagttattgctaacaaaatgaactctggaatagagaatccagaaatagacccacacatatatagtcaactgatctttgacaagagtgaagacaattcaatggaggaaggacagtctttttaacaaatgatgctggacatctgcatgcaaaataatgaatctagacacggagcttgcatctttcacaaaaattaatctaaaaaggattatagccctcaatggaaaatgcaaaaccataaaactcctagaaaataacataggataaaacctgggtaaccttgggtttgatgatgactttttagatacaaagccaaagcaaaatccatgaaagaaaaattggtagttgaacttcattaaaaattcaaaacttctgttttgtgaaagatgctgttaagataatgaaaagacaagacaaaaaaatctttgaaaagcatataaaggtctctacaaggagaactacaaaacactgctgaaataaatcacagatgacacaaacaaatggaaatacatcccttgctcatggattggaagaatcaatatcataaaaaatgaccatacttcccaaagcaatctacagattcagtactgttactattaaaataccaacatcatttttcacagaattagaaaataatcctaaaattcatatggaatagaaaaagaccttcaatagccagagcaatcctaagcaaaagaacaaatctggaggcatcacatcaccagacttcaaattatactacaaggctacagaaactaaaacggcatggtattggtataaatatagataaacagatcaatggagtagaatatagaatctagaaataaagtcagatatacccagctgatctttgacaaagcataagagcaaataaattagggaaaggacatcctattcaataaatggtgctgagaaaactggatagccacatgtagaagaatgaaactggatccctctctctctcaccatattacaaaaatcaactcaaggtggattaaagacttaaatctaagacgtgaaaccataaaaaattctgtaagaaaacctagaaaaaactcctttggaccctggcctaggcaaagaatttatgattaagaccccaaaatcaaattcaatgaaagcaaaaataaggaaataggacctaattaaactaaaaagcttctgcacagcaaaagaaataatcatcagagtaaacagacaacccacaatgagagaaaatatttgcaaactatgcacctgacaaaggacttatatccagaatctacaaggaactcaaacaaatcagcaagaaaaaacaaatagtctcatcaaaaagtgggtaaatgacatgaatagacaatcctcaaaagaagatatataaatagccaacaaaaatatgaaaaaatgctcagcgtcactaatcatcagggaaatgcaaactaaaaccacaatgagataccaccttactccagccagaatggtcattgttaacaagtcaaaaaaaacaatggatgttggtgtggatgtggtgaagagggaatgcttataaactgctggggggaatgtaaacgagtacaacctctctggaaaatagtatggagatttctcaaacaactaaaagtaattctaccatttgacccagaaatcccactactgagtatctactcaaaggaaaataaataattatgtcaaaaagacacctgcatgtgtgtgtttatcgcagtatagttcacaattgcaaagatgtgaaaccaacctaagtgcccatcaatcagtggataaagaaaatgtgctactatacacatggaatactactcagccacaaaataacaaaataatgtcttttgtagcaactcggatggagctggaggccattattctaagtgaagtgactcaggaatgcaaagtaaatactgtatgttctcacatataggtgggagctaagctacaggtacacaaaaccatgcagggtggtataatggatattggagactcagaaggagggtgatggataaaaaactatatattgagtacaatgtacacagctagggtgacaggtgcactaaaatctcagattgcaccattgtataatttgcctatgtaaccaaaaaccacttgtactcaaaaagctattgaaatatcatatatatatataatttatatattatatataaacatatctgataaagggctggtatacaaaatatacaaaaaaaactcttaaagctgaacagtaagaaaacaactcaatttaaaatggggaaaaatctgaacagacacctcattaaagaagacatgtagatggccaataaatacatgagaaattgccaacatcatgtatctttagaaaactgcaagttaaaacaataatgaaataccactacacatctattagaatgactaaaatcacaaacacaacactgaatgtgacgatgtagagtaacaagtggtctcattcattgctgatggaaacgcaaaatggtatagctgcttgggaatgcagtctgacaatttctcacataactaaacatactcttaatataagatcctgcagttgcactccttggtattaacccaaatgaattgaaaacttatatttacacaaaaaactgcatgtgagtatttatagcagatttattcagaattaccaaaacttggaagcaactaagatgtccttcagtaggtgaattaataaactatggtaaattcacacaatggaatattattcagtgattatcaatccacaaaaaatcatggaggaaccttaaatacatactgccgagtgaaaaaaaggggatctggaaaggctacacaccatatgattccaactatataacattctgaaaaaggcactcttatggagataataaaaagatcagtggttgccgtgggcttagtggggaggggagaagggatgaataagtgaatggagagggcatttttaggaaggtgaaactattctgtacaataccataatggtgggtacataatatatttgtcaaaacccacagaacacacaacacagcgtgaaccttaatatgaactatggacttttagttaattatgtatcaatattggctcatcaattttaataaatgtaccacacgaataaaatatgttaataatagaggaaatgagcagtattgtggagggcagcagtaagagaagggtatataggaactctgtattttccacttaatttttctgtaaacttgaaactgttctaaaaaataaagtctattcaaaaatctacatgattcaaggccaggctggcaaacattttatctctatttataagcaagatagacttagtatagtgtgattattcagaattagaaaacatacatatatatttgtttatctctcccaggaaaatacaaaaaagtatcaaaactgtaagaattaaatgactacttcttaagaaacccaaaccataaagatttagaatattcttacaaaagtatagtttcagttgtcttgaagacattgtatttatgttcttctgtttaactcagtatttactaatccagtttaaataaggagaatttgatttattaaatatgtcctaaccacaaagagaaaattttctggacaattaattttgaaattagcctttttctcatgcttattttatccataatttagcttttgagaacagaggatgattgtcagaacatttcagtaatcagtatttatcaatcctttattagaactctggtcctaaaatataacagttatagaagaaaatctgtgtagacaatcacccaagacttttcccaccatacatacattcccagatctaaatatagtagatctataaaattctaaataaaaatgttcaaagaatttcaaatcaatatttttttttagggtggaatgagttcccagtgggcccaagatcaactctataatttgtcttggtagttaattatcataatagactaactatattacattctatataaaaataagacttgtgcagcaacattcatttgaatttgttagtcctcagtaggattttatttctgttgcattgtaaaactggtgtttcaatttgtgtactcttcatcctatttacgtagactgtacatacttaatgttaagctatgaatattgtaaatattataaataccaggtaacttatttatgttccagaacaactcgggaggaattattattttttgtgtcaaagtacttcaaggcaaaggtgataacaaatatcgaaaataaatgatttgatgaagagctatgtttcattacaacagtgcttgacatgtatatattaacaggtatttgtagaatgaaagactgggtgaatatatactcctaaacttaacaaaacaataaaggaaggttactacatttattgaacatctactatgtactaggcagtctgcacattatcatgaaacagcacagcaaactaccattatataaacaattaaagatgaaaatggtggctcatgcctgtaatcccagtactttgggaggccgaggcgagcagatcacgagatcaggagattgggaccatcctggctaacacagtgaaaccccgtctctactaaaaatacaaaaaaaattagctgggcgtggtggtgggtgcctgtagtcccagctactcaggaggctgaggcaggagaatggcgtgaacccagcaggcggagcttgcagtgagccgagatcacgtcactgcactccagcctgggcaacagagtgagactccatctcaaaaaaaaaagaaaaaaaagatgaaaaaggctaagtaacttgcccaagtttacacagctgttaagtggcagagttagaatgcaaactgggaatgtttctgacccctgttcttacttttactcattctatgttgcctaatagagatgagtagttggaatcatatggtctgtagatctgaaaatttgaaatcataacatcctcaaacttgggtaaaaaaccctctcttctccaagttttgggatgtactctgtgcccaacagaagaaggtagaattaagagcatgctaacagtccttaaaatactgcagtgagtatatctacgaatacctgttaatatgtacatgccaagcacagctgtaatcaaacatagctcttcatcacatcatttatttttgatatttgttatcacctttgccttggagtactttgacacaaaaaataataattcctcctgagttgttctggaacataaatcatattttgacttttctttggtacaacacagcagataaggtataatgtccagaggaccccaagatgggtcatcaacctaaccactttttcacaaaattttcaactaagctatgggaaatatttttattttcaaagagagctttgttaacatgcatctatttctcattgacataaaacagaggtgagattttgacaaaaactggaatcacatttctcatattgcttgcccaatttcggcttccaccaattcatcaaatttctcctgaaagtcaagacagtagggatgagcataggcacttttctccacctcatctcctccaatccactgtcccaatcccaaaggttctctgtgaactgcatgtttggaaggctgttcaaaactaattttattgacctaatgacactaggaaaattgttgcagttgctgtgagttttcttttgctacttagaactgacatgagctgtagaagtcagtagacttactttacagacactgtcaatgttagtcacctttactaattcaaaaactcagtgatagtcacaggtttatcataatccaaacatggaacatagaaacaaaccctattagtggtgtgaacctttcaaccctgattaactcatctgcctaagacttgaaattttatgccaagcaaggatgattatcctaccgaaggaagtctgactgacatactcatttaggaccaaaatatgcctatcatttcccacttcttcagcccctggggacttcagcatcttcccagtctttgcaaaactccgtcttagaccttttttttggtggctcctatattttagtctacactttccctgccttttgactaacagggttttttctgtccttctagtctggcctcagtcagctgctggcagtcttaagttattaccttggtccacttccttatttccattcttgatatttagggtaaggcacagttagtcccaaaagacacaaaacatcagctgatgcatgaattctcctgttcaggaaccattgcagtgaactgtagcaactcatagctccaaaccacatgccactgtacccaaacagaaagaatctatccgcagtccatgaccaatactaatcatcataacaattttttttttgagatggaatctcgctcagcaccatgcctggcctataatgttttttttttcattcgtcagtaggcatttatttccatctttcagttattacgaataatggttatgagcatagatgtacagatacctgtttgtgtccctgccttcaattttttagggcatatgcccagaaatggaattgctagatcaaatcgtaattctatctgtaattttttgaggaactgccatactattttccacagtgattgtaccattttacactcccacaagcagtgcacaagggttcaatttctccatatctttgccaacacttgttattttattttgtcttcttttcctttttgatagtagccctctgtattagttcattctcacattgctataaagaaatacctgagattggataatttataaattatgaagaaaagaggtttaattggctcatggggttctgcagactacaggaagcctgatgctggaatctacttggcttctggggaggcctcaggaaatttacaatcatggcggaaggcaaaggaggtgccatggccagagcaggagcaagaaagagagagggtaccacacacttttaaacagctgaatctcatgataattcactccctatcatgaggacagcatcaaggggatggtggtaaaccattcatgagaaatccactcccatgatccaatcacctcccatcaggccccacctctaacactgaggatttcatttccacatgagatttgggggtaaagtgatatctcattgtggttttgatttgcatttccctgttggttacaaatgtcgagcatgtctttctttatttgattttaaatgctgaatttgagcaataggaattgtatcaaattagcaaaatgggcaccgttcacaagtaccttaagactgtccctgttcctcatatcccttggcatcaacatttgcgattggatcatgggagcggatttctcatgaatggtttaccaccatccccttggtgctgtcctcatgatagggagtgaattatcatgagattcagctgtttaaaagtgtgtggtaccctctctctttcttgctcctgctctggccatggcacctcctttgccttccaccatgattgtaagtttcctgaggcctccccagaagccaagcagatgccagcatcaggcttcctgtacagcctgcagaaccatgagccaattaaacctcttttcttcataatttataaattatccagtctcaggtatttctttatagcaatgtgagaatgaactaatacagagggctactatcaaaaaggaaaagaagacaaaataacaagtgtcggcaaagatatggagaaaatgaacccttgcgcactgcttgtgggagtgtaaaatggtacaatcactatggaaaatagtatggcagttcctcaaaaaattacagatagaattatgatttgatctagcaattccacttcagggcatatgccctaaaaaactgaaggcagggacacaaacaggtatctgtacatctatgctcataacatcattattcataataactgaaagatggaaataaatgtctattgacaaatgaatgaaaaaaaagtattataggccaggtattgtggctcagatctgtaatttcagcactttaggaggccaagacaggtggattgcttgagctcaggagttcaagactagcctgggcaacatgatgaaacccagactctagaaaaagtacaaaaattagcaaggtgtggtggtacatgcctgtagtcccggctacttggcacactgaggtgggaggatcacttgagccaaggaggcagaggttactgtgtgttgagattgcaccactgtgctctggcctgggtgacaaagccagactctgtctcaaagataaaaataatgtagtatacatatatacatacaatggaatattatttagccttaaaaaggagagaaattcaaattctgacacatcctacatcatggatgaactttgaagatattatgctaagttacatagccagatataaaaggaaaatattgtatgatttcactcatatgaattacttagagtaggcaactttgtgtacagagagaggagcatggcagtttccaggaactgggggcagagggaatggaaagttactgtttgatggggatgaagttttagtatgggcagatgaaattctggaaaccggtgatggtagtggatgcacaacactgtgaatgtatttaatgccacttaagaatgattaaaaaggtaaattttatgatatatatgttttactgcaataagaatataataaaaatttaaaaatcaaataaaaatacaactggaaatgaccaaaaagattcacatatcaatgctccttgatttttgtgtatgcagaagctgaggccacaagagattaaacttctgagttaagaaaacacatctagttagtatggcagagctaaaacaagaacctcatgatcctgagactccaaaaccaggatatttccattatcccagggttatcgccctttcctgctaagttgcttatttcacttagccactttgatttctggccttctcacaaagctctggtgtgtccccaggcatgactctacataactatggtctctttttggtgatggttgacattcttgatacatggccctttctagaagaaggggaggattgctaatcttcaacaaaaatactagtggatttccaattctcaatactattacttatggctggataatattctgagacaggctagcatagtttgacatctggtaaggtgtcttaaccagcatgccaacttagtgaaagagccgggtgttaaataagcacaaggaccagtgatctgatcttttcctgtcttgttaatttctttttaaactatatgaccaaagtcttgcaacacactgtgatgaggggtgatcacagcaagctatgaccctgataggtgaatcctagcaccttcattaatccctgtgaaactcccctgccccatcctaacttgggtgaacctattctgacattggttctcatgggagactcctgccaatcatacaaaatagtggtatgtgacagcagtcatattcaggagtacccctgttcaattttctcctagttggccgagcacggtggctcacgcctgtaatcctagcactttgggaggcctaggcggctggatcacctgaggtcaggagttcgggatcagcctgaccaacatggtgaaaccccgtcttactactaaaaatacaaaaactagctgggtgtggtggcaggcgcctgtaatcccagctactcaggaggctggggcaggagaataacttgaacctgggaggcagaggttgcagtgagccaagattgtgccattgcactccagccagggcgacagagcgagactctgtctcaaaaaaaaaaaaaaaaaattctcttagtttcaggcatttcccttgtagctaaaatcttgcaacattggagtcttcatctgactatggcccatcagtagtggaattatgtaaagccccacatctaggagccagacattaaggagcttcctttactctatctctactcctaagatcagttctgcaagcttaatctcattttgaagattgagaaacagagactcagatttaataagtttcatcaaattccttataaacaatcaatatacccttgagttctagcctctcacacattctaatcatggctggcccgtaatcattccttcagcattcctaactccagatggtcattcacaccttttccttgtccagaccagtgcttctcaagctttaatgtgcatgggaatcacctgaatatcttgataatatgcaggttttgattcattaggtctgagatggagcataagattctgcatttctaacatttttccagccaatgcgtctgaatccagataataaattgtgcttcccaacaaggtagtcttcagccacaaattgtgattacacacttgaaatgtactagtttgaactgagatgtgctttcagtgtaaatgacacaccagattttgaagacatagtctaaaaagaagtgtataaaaatctcacaatttttatattgatcacatgttgaaataatattttgaatatattgggttaaataaaaagtataattaaaatcaacgtctccttttttacctttttaaattgaagattagaaaatttaaattgacaaatatgtttcatattatatttctattggacagtctgctttagagaattctcctaaatcttctctacccatttatcatttagcacatactgctttgtagtgataaaagtcacatatgcacatcttgctggctatgcagtgagctcttgaaattccaggcttgtatctcattcctcattgtgtaagactatatcttattccttcttgtatctacagcccccaaaaaagtacctaccttctaatagattctcaatgatcaccactgaataaaatttgaacccttttgaaattttgcagtgcttagcacaatgcatttctaatagaaggtcttagattaaggtatgggtcagttccagccaacttcagtgctttacttacagtgtttatggattgcctgacctgctgtactctctactaagggaattctcaataactataatataaacctaatcaaaacataattagaaggcaaactactgtaaaaaagccatcatctaatgcattcctaaaagagatttggggattatatctgcaccactggttttctccttcaggataattaaaagttgattgaaagagaattgcttaaaaataaagaaggtgactgtttctttttcagtaccattgtcatgattgaaatgtggatcttgagaaggcacttggctagaagtaaggggcacatcgcaaatgttatgtccaacaggatttaagaaacatttactcatcttcaattagaggttcaaaggtcacttcctcttagagttaaatgtacttcctggcacatcttcattcattccttattcactcattcattcactcactcacttgcttactacttattcgccccctcacttaactcacaggctcattctttcaacaagcaattttctgggcacctacaataaaccaagtgctggtgatttcagcactcataagctagtctagtgtaagagacagacacatataatttcttaagtaaaagggagttttcagaccatcctctttgcttactattctctaaactaaatctggtagtttgctctacttttctgaccaatcatttacacattagtatcatcatataaagaatttatagtattctctgatggtagtttgtatttctgtgggatcggtgatgatatcccctttatcattttttattgcatctatttgattcttctctcttttcttctttattaatcttgctagtggtctatcaattttgtcaatcttttcaaaaaaccagcttctggattcattgattttttgaagggtttttttgtgtctctatctccttcagttctgctctgatcttagttatttcttgccttctgctagcttttgaatgtgtttactcttgcttctgtagttcttttaattgtgatgttagggtgtcaattttagatcttttctgctttctcctgtgggcattttgtgctataaatttccctctacacactgctttaaatgtgtcccagagattctggtatgttgtgtctttgttctcattggtttcgaagaacatctttatttctgccttcatttcgttatgtacccagtagtcattcaggagcaggttgttcagtttccatgtagttgagcagttttaagtgagtttcttaatcctgagttctagtttgattgcactgtggtctgagagccagtttgttataatttctgttcttttacatttgctgaggagtgctttattttcaactatgtggtcaattttggaataagtgcgatgtggtgctgagaagaatgtatattctgttgatttggggtggagagctctgtagatgtctattaggtctgcttggtgcagagctgagttcaattcctggatatccttttcaactttctgtctcgttgatctgtctaatgttgacagtggggtgttaaagtctcccattattattgtgtgggagtctaagtctctttgtaggtctctaagaatttgctttatgaatctgggtgctccggtattgggtgcatatatatttaggatagttagctcttcttgttgaattgatccatttaccattatgtaatggccttctttttctcttttgatctttgttgttttaaagaaaaaatgctcatcattagtggctctcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgcggaagacagtgtggcgattcctcaaggacctagaactagaaatatcatttgacccagccatcccattactgggtatataccccaaggattataaatcatgctctcctaaagacacatgcacacatatgtttattgcggcactagtcacaatagcaaagacttggaaccaacccaaatgtccatcaatgatagactggattaagaaaatgtggcacatatacaccatggaatgctatgcagccataaaaaaggatgagttcatgtcctttgtagggacatggatgaagctggaaaccatcattctcagcaaactatcgcaaggacaaaaaaccaaacaccgcatgttctcacccataggtgagaattgaacaatgagaacacttgggcacaggaaggggaacatcacacactggggcctgtcatggggtggggggaggggggaggggggagggatagcattaggagatatacctaatgtaaatgaccagttaatgggtgcagcacagcaatatggcacatgtatacatatgtaacacacctgcacgttgtgcacatgtaccctagaacttaaagtataattaaacaaaaaaataatttaagttttttttaacatatctaatcttgaagtcgctttgagaatttaaacttattattttccaatctgcaatttttaaaagtctcctcgtacttgtataacagagcaatactatggaaaagagtaccttaaaatttaacatatgcaactgttatattctaataacatttggaatttcgcattcatttcatttttaagacttgcctggctcttgccagtagcattctcctacatattttcaccttacccacgcaagagctgcagtttcactgcaaggcgagggcagatgctcagtcaaaatccttgtctgcaacgactcaggcctgttgttctcatgcatccatttactctgtcttccagataggaaggtccagctaatagtgattatctgaagccacgtttattaaagaaaactctgtctgttggaactttaccttatttatcatgtaaaaaaaggatgaaatgctagtttggaaactcattttcagtaaaaaatgtgtatttgcatgtgttatatgcatatatcagtgtatcttgatgggatcatatatcccctgccataatataagttcttgtctttttcagcattgtactccccagattatgcacaagaaagttttctaaattgaaatggaatctatgaccacataagctaggcatgacagaagggagaggcattttatttctaagtctcatttcatcactatcatcacaacaaatttaacattccttattttctgagaaaaataatctatttgatatcccagtataatcatatctttggagaaaagggattctgctcatttttctggagccacacatggctgtgcatttggggagttccctgcagctaggctttacacacgacagtcattggtctagcggtgacactggaacaggacaaaattaatttcttgccctgagaaatatggaaggaaaaaaaagaaacataaaaatctattatttggacagctttaagctttgacctactcaacaaagctaatgcaatagtgatgttcactcattaattaaaattcttctaatatgaattttatattaattatgtattttatattcatattatgcattacctgttagaggcttgtatgcccgcagcactaatgctagtaattaaagatctgttggcaacctgctttttagcaacacggttttgaatcataggaagctgaaatctggcatacaatttgtcattcatgctgaagtgggtatttttcttcaaaacgcaattagaattagttcatgtcattttagtttaaaagcaacaaaggcaaatggtttgttgctttacgttggcattgagtccagtggatcgattttcaaattctgccttaaaatataagtttttggttttccatgcgtatgaatcaaatcccctttggtattcaaagaataaaaattatcctttagtttgtatcagttttcaagttactatattgtataatatgtttatttgttttagccataaaaaataggcccaacaggttatttcagacctgagatctggaggatctggggtgctaagatgatcagaaggagacaatgcattgcttaggaggtcagcaatgggagagaattctagggcctcatgcccttgccaggggtcaactgtttacaggagaatgagatactccagagatcagatatatagttgtgatcctgacctaagatacagtcttacacaatgaggaatgagatataagcctggaaagttcccttttgaggactttaaaaaaagtcttttattttataaggagtgcaacgaagagcttagatacttgcttaagatcatagggcttattaagaactaactcctgattccttcccagtccaattttctgacacaagcatacactgagaatttgagtaacttaatgagttgaaatagttttaaattgatgtgaaagttttcaatgtaatttagcaaatgcttattgagtaccttctacagagagagggtaatgtaggcctaaagcccaagctccctcaaatagttctggacaacaggctggagtagattataaagaaggcaggagggctgggttggggacatcagagctcaacatatcatggggagaggctgaagaccacttggatgcaggaatgaaggtgggcacctaggagaggggtgggaagagctccagagatgctccatgggtgcactaggtcaatatgccagggctgaggatctgatacatgtgcctctatgagccaaggctgacaattatgtcaattcagccagattatggagtagaagatgtggaagatgtttacttttatttatttatttttattttttatttttttatttttgatacagagtcttgctctgtcacccaggctggagtgcagtggcaggatctctacccactgcaacctctgcctcccgggttcaagtgattctcctgcctcagcctccggagtagctgggattacaggcacctgccaccacacccagctaatttttctatttttagtagagatggggtttcaccatgttgtccaggctggtctcaaactcctgacctcaggtgatccccgccttggcctcccaaagtgctgggattacaggcatgagccaccgtgccctgccagatgtttacttttaaactgtcagaacttactatgagctttttcactcataacctcgagactctcttttctggaataatggagacccacaggacatttatgcacagattcagccccatgccagtcttgccttagctaaggaaaaattaagaggccatactcaatcctaagaaaatacatcctttgaccggggtattaaataccaataacagtttctccttgttcctgagatcaatccctcccaaattgctgcatccctacacaggtcccaatatctacattggatttctgtgtcaggattcacctgacaggacatcccatctctctagagatgggatcagtccccatctcccttacccagggctgacacagtcccctggtggcagttgcctaagctcttccaatagcacctacttctgtttttgtttttgttttctttttttgagacggagtcttgctctgtcgctcaggctggagtgcagtgacgcgatctcgactcactgcaagctctgtctcccgggttcacgccgttctcctgcctcagcctcccaagtagctgggactacaggtgcccgccaccatgcccggctaattttttgtattttcagtagagatagggtttcaccatatttccaggatggtctctatctcctgatcttgtgatcctcctgcctcggcctcccaaagtgctgggattacaggcatgccaatgaatagcacctacttctaatcctcatggtgttattctgtctagccatgaagatacccattacatctgaaacttgctgaaatattataggctttggattcagccagatctgccaactaaatgccatcagaggtcttgttcagaggaccagctctgccaagctttttctgccataatgaatcatctcatatctggttgcatcacaggatctcacaaaagatttaggaggatgatctactaaaaccatgaactttgaagtttgttagaccttattaaaatatttgggttactttttaaaattatttattttctaaaaattgtggtaaaatatacataacaaaatttatcattgtaatgattttaaagtgtgtagttcagtggcattaagttcattaacgttgttgtgcaatcatcaccatcatccatatccagaactttttaccttctcacaccgaaactcaacccattaaacatgaattcctcattcctgcctctccccagccctggcaaccagcaatctactttctgtctataaatttgcctactctaagcaccttttatgaacagaattatgcagaacttgtcctttgtgactggttcactgagcagaatatctttaagtttcatccatgttatggcatatgtctgaatttcctccctttttaagctgaataatacttgactgtatgtgtatactgcatttctttatgtgtgtctctgtctatggacacttggattgcttctaccatttggctattgtgaataatgctgctgtgaacataggtgcacaaatattttatccctggtttgtttctttgggatatatatcaaaaagtggaattgctggatcatatggtaattctagttttaattttctgagaaacttccaaactgttttaggactaccttttagacctgacattgaacaaaaacattttaccatttccacttcttcacatagatgtacttcggaggtaacagtaaaatgattttgaatgcatgcatgcttattggggttaagagagaagcttacttcattatctttaaaatagagcttatgtgtgttgaagtttgggcaaataaaagtatgttacagcctattagaaagtaaaaacaaaacaaaaaactctatctactaagacctaactatgtggatcatctagagaacatgtcagctagagcaatccacattgtctcactggcataatatgatgttttttagataaggacagtaggagttaaaaattaaatggatcactaggcttaaatgcttttttaaaagagaaaatttaaattataatgagaacagagtttaaaagattataaaatgtgttaatatagagaaagatacccttatttaaattatacctaagtctttctaaaaataaagtgaaaatcttcaatctaagatacatgggttgtgcacacatagatgaaatctacttttacaaaatgatttactgtgtacctaaagaatggattcactcaggggaaccaaataccaagttatggtttattgcagaataataaatctgcaatttggaaaagtcttgggtcagcatggcatggtttttagcaattatgaaatggctaggttttaaatcttgtgatttaatcacgtattaaaatactctcttaaaaattgttgcaagacagctctgttaaaacaaacaaacaaagaaccacagcttctaactggatttctgctaattgtcctgaagcttagcattaggagaagagcccactctttatttctgtgctgtttactgtttaaattgtattggatcttgagtatttgtagcctcagtttgaaatcagatgctcttccagatatgaaccaactgactaacttccaggagatatcagggaatcattatccaatatgtgatttcatagtttgttctcagctgtgatttattaagctggtggctattgtcattaaggattgcttgtgtatggtaatagtatagattcagcatagagaattgaaaaattatatttgtttcactttgtttcaaaggctaattgtttggtgttttcatcatttctatgataggcgaaacgccccaagtgaaagggttaaatcatcaaattatatttttatccttataaaaagtattaaatacttattctaacacactccattatgtcatggtttaagtctcgtacccacaatatatatggtatagttgaaatgtcatcaatacacacacatgcatgttatatatatttagtgattcataatgattatacatatttatggggtacgtgtgatgttttgatatatgcatacaatgcttaatgatcaaatcagggcatttaggacatttatcacctcaaatatttatcatttctttgtgttgggaacattccaaatcttctgccaaatttgaaacatataataaactattgttaactacagttactacactgtgctaccaaatactggaattattccttctaactgtatgttttatccattaaccaacctctcttcattccctgacccttccctttctctgataaccataattctaccctctacctccatgagatcaactttttaagctcccacatatgagtgagaacatgcaatatttgtctttctgtgcctggcttatttcacctaacataacgacctacagttccaaccatgttcctgcaatgataagatttcattctttttttgtggctgaatagtatgccattgtgtatatatatcacattttctttgtctattcatccattgatgaacacttaggttggttccacatcttggctattgtgaatagtgctgcaataactataggggttcaggtatctgttgatatactgatttcctttcctttaaataaatacccagtggtgggattgctgcatagtactgctgttctatttttagttttttgagaagactccatggttttttccataatggctgtactattataatttacattcccaacagtgtatgaatatccttttctctgcatccttgtcagcatttcttatttcctgtctttttgacaatagccattctaactggggcaagatgctatcttgtggttttgattggcattttcctgatgatagtgacattgaatatttttttcatatacttgttggtcatttatgttttcttttgagaaatgtctattcaaatcctttgcccattttaaatggaattgtttgggtttctcttttttttttgctgttcaacatctatattattactaatcattactctaatgtgtttctacattcttggttaacagaattatccagacttttctcatttcatcatacaacctttattctactatgtgttgggcagagtagtgggtgctggtgaaatatagataaataaaattgcaaccaggcgcggtggctcacgcctctaatcccagcactttgggaggctgaggcaggcagatcacctgaggtcgggagttccagaccagcctgaccaacatggagaaaccccatctctactaaaaaaaaaaaaaatagaaaaattagccgggcatggggcacatgcctgtaatcccagctattcgggaggcagaggcaggagaatcgtttgaatctgggaggcagaggttgtggcgagctgagatcgcgccactgcactccagtctgggcaacaagagtgaaactccgtctcaaaaaaaaaaaaagattgcacttttgtcttcaagacactcaacatctaattaggcagaagttggataaatgttgatggctattatttgatagatttgaactataatatattgtactgacagaaaaataagtgagtgcctgaatgatgctatttgttctacaaattttcttcaagagcttattaatcatgtcatctttgccacctgaccccagcctttaggacattcctgacatagccatcaaggtgttcatggtctcttctaccctaatgtcaatgtccttttttgctaagccagtagtctcactgtttcttgacttctactcctagagatttggtatcctacatgctactcatatggctcccttcgaacttagtattccctcgtattgcacagtaagagatgagtctggttcgatggttgtgaatgttctccaggaacattcaatttgaggataaaaagaagtatcaaattctgaatcaaactgttctcaactgtctctgaagggaaaatctcatggttgtgctcttaggctgtaactcaaatgaatgattttagccctatttgggtactaaatgactctttttaaattaatctatcctattaagactatattttattacagttatttgtttatgcatctatcactcctatttagaccaagatttgcaagtgtagaaacagtgttggtataatacaatatgtgagaaaaagttttagcattttcataatttccatcagtaactctcctctgccattttaatattaatacaactgatattttctcagttttatggaaaatatgagtgaagacatcttcataaaactttgctagttttttaaattaatctataacatataatcttaaactaacttcacttgaaatgcaaacacagcctcatgacaaatcccttagctcctaaattaccgtccctaaacttctaaacagaaattctggagatgccatggggcgggagctgggcatttttcatctttggatcactaacttgtaaattcatgccaagaagacagtaggctctccttacatgtttcctaaaaaatttaggttcaagagaaatctgtgtatcaagagctttcattcctttaaaagaaatatttatggtttgccatgatgtaagaaacttttgggagtgatatctacaaggagggaatttcaattgtgagagtttcaatttaaaaaaaattcatccagcagttggtttctcttccaaacttccttgagaaacagcctcaaccatatcatattgcgctgggttttattttaggcatcctaacccaaaccaagtttatttatcccctcattagtttatttgaaaagcagtaagtaaagaaatcttacatcccagccttaaaacttttcacgtgttccaggaactccctttgcactaattatacttataacactggaactagattatttcctttatagaactcagaggcttccaaagaatacctgaaactcttaacctgaaatcaaatgagcagtttgaggatctcagtaacaccataacaacaatctttacccttttatttcttttgttaatacttttctcagctctcagtttcatcagttacttaataaccttgtttatcaatttccttattaataaaagaaaacttcattcctaggagcttaggtgaagtgaattgcctctatcctcctcctcattaagcttttggaaggcaccttggacaaatgagcctaaattaccgtgcctgccaacagcaaatattttccacaagaaggcctttttaaggagaaatttaggtcaaaagcagcaaaatttaaagagtttacagtttacagtgactactgaactagcgctatgagagagagagtgagagggagagagagacagagaaagacttctttataaacataatgccatttaataaatgtggaatgaattgatataactaaaacaaaattcccattttatacttctcaatatgaataaatgattaaggcaagattaagatcaatgatggattacaaccattagctgaaatgttgttctgaaactgagtgttcaaatggtcacaaagtttctccatgcatgttacttacgaattacaaatggaaaacgcccctttataccaaagagatccagcatgcatcatcttacaactacgtgatcaaacttgctctcacccacagggaacccatctgactttatttgccacctgatgggatgcaattagtactcaatatcacgtatgtagttttcttgctaaaaaccagagcctgtatcaaattgtgaagaaataatcatacacatctagaatgtggaacattcttcaagacactgatctggattcaaaaaaagtgaatgtcatgagaaacagaatagggagaatactgctcctgataaagtgatcaaacagaccaaaacaacaacagcagaaagcaaagtacaaatcttgatttgacccaggattttttaaatctatgaaagatagtattaagacaatcaaaaaatttaaatatagcccgtgtaaaatggtaatccatgtatttaattcttatgaatagttaatggtattttggttatatagaagaaagtgttaactcttaagtaactacacagttcagcataaacatgcatatctgtctgttttagatccatttgtatgtacacacagaaacacatacatacatatacatagaaagaaagcaaatgggtgaaatgttaatttgtgaatcttggtgaaaggtatacggtattcctattcaatttgttaatatttctgcaggtttaatttttttcaaagtaaaaagtaggggaaaaataagaaaagggatgtacactttttaccagaaacattgtatggctgtcaataccttaataaaaattataaatcagctttttaaaaaaagtcttatttctcctgtctctgccatttcatatgtgtgtgaccatagatgggctattaagttctgaataaatttttctaatctgtaaaatgaggagataatgctcattttaaagaagaataaagagaccaagaagatcctaaaacttgtgtttgctatcttctcctacgtactatggtatgaaagggaaaagtgctcacattacttctctcctctcatccctttcctttctcaagcaacacttggatcaaacgatggaaaatgttattttcatttttcattaacatgggaattctactattcttgtcttttggtgtgtgatgacacgtgcagctcacagggtagaagatttgaggtggaagggctaaaacatggtcgccctatgatcatttctattgttgcatcacaatagaggataagggttaaattcaaccattttttttccaggtttcaaaaaatgtttttgtttttttttttttctgctgtggccagcagaccttgatttctgttgctaggaaacctggaaggtactttttagtcctcatagaaaccatgttttaatgcaatcactttcaatgactctttattggctgttttgcttggtgccaactcaaagaaggttcacatcaaacccttacaaggtgaacctgatcgtgtcaaactgcgctagccctggggactttgtggaagtgcctcaggggtttcttggggataggaaagggtgggagccagggggcaatacccctccccacttcaagcagagcaattctactttgatctgctttaatgttaggctttctttgaagaaaatgctttatgggagggagtatttgaaaagccttgacctaatctaacacacaagaaagctgaatttctgcgaagtgacttgcccaaagttacccagttcccaaacaccaagactgggattaaacctgagtgttctgattccagatctctttctattaccccacacttcctgctcctcctcaccatgcctacctggtccttcctttcaccatgttccggagatccctggcctgactctgtgcccagaactgtgaaggacagtagaccctggagggcagtgttgtagtgggcccaaaactgttgacccctggatattttcctgaggatgctgcgatctctagttaactactgacagcactttccccaggttcctttcagagagaatggctttaagcagtcgtatggaaaaacatttttttctactgtggctgtgagcatttgggaacttgttcctgagaataaataggaggatctggctcagcaatactggggatgatataatctgaaccacctcctgtgacgaacatctagtaattcttttttttttttttttgagatggagttttgctcttgtcgcccaggctggagtgcagtgacaagatctcagctcgctgcaacctctgcctcccaggttcaagcgattcttctgcctcagcctcccgaatagctgggactacaggcacgtgcaaccacgcccagctaattttttgtattgttagtagagacagggtttcatcgtgttagccaggatggtctcgatctcctgacctcgtgatccgcctgccttggcctcccaaagtgctgggattgcaggcgtgagccaccaaaacacctagtaatgtttttaagcatttaaaaaatgcctagcagagctcagaagactgaaaaaggttcaaaagcaaagcaggaaaagaaagccagagcacatagatatgatctgattttgctactttaagaaggtggggggcagtttattaacccaattcaggtgtcaatgtcaatttaaggacagcagttgagacatgttcaagatggaggtgaagctgacccaatagtcccatagaccagaggtctccaaacctggggccatggaccggtctgtggcctgttaggaactaggcggcacagcaggaggtgagcaacaggtaagcaagcattactgcctgagctccatctcctgtcagagcattgatggcattagattctcataggagcatgaaccctgttgtgaactgtgcatatgggaaatctagattgtgtgctccttatgagaatctaactaatacctggtgaggtgaaacaatttcatctgaaaccatccccctggtcccccaacccctggctgtagaaaaattgtcttccacgaaactaggccctgttgccaaaaaggttagggaccactgccatagacagttgttttgggataaacatagaaattgatccttctggtcttaaagcttgaaacttatatttgttttaagagttccttcctcaggaaaggatccctcgggccaaggatccctcgggcctctcaaagtatcaaacaagcaaaactcaccagatcaccacatccagacaataagatactggacccattaattcatcatgattgctttcttacccctccctagttcctgttttcttacacattgttgcatttctccctgctatataaaccccaagttttagccgtcagggagatggatttaagagtgatctcccatttcctccattgcagcacatgattaaaaccttcttccttggcaatactcgttgtctcaggcattggctatctgtgtggcaagcagcaggacctaaaccaagcccctggtgttttggtaacagaaggctggaactgaacaagctcctaacccctaacatacataacgctgggacttatgaggactacacacacaacaaaagggtaagccagaaaaattcagcacagggtgaagacaaggagattgctctcttcctggctaggcttcaggtagaagcatgaaaattctactctgagaattcataagtatgggccttatggatttagagtacaaactgatgctttctaaacatcaggaactcccctaacctggtcaattaaaaaaaattgatctcagccaagtgataaatctaaaagagtacattttggaagcagaagtaaacacatttttgaaaaaaaaattttaaaaatttttcactggattcccatagttaaaatctcacagaagttgttttagcctcagacctgtgtgtgctgtgtgatcccacaaaccccatttaaaaaactttaggaagaaaaaaatccaccagtagaaaaagaagacaaagcaataccacatttagagttcctaaaattccagataacataacattctggcagatgagaaaataataatttttaaaaggattaaaagtacaaaaaataaaacccaaagaaataagacactcttacaattaagtagattaaaataggtagataaaaagccaagtaaaattttgagaaataaaaagcaatcattatattaaaaattaaattgacagattaaataacaaagtcagaactgaagcaggaatttgtgaatggcaaaatagttctgaggatattatgcagagtggactaccaagaaatggtgaagaaatgtggagggtagaatgaaaatcagcaatacatgtcagacagaaatgtcagaaagaaatgataaggatctgagaggcagaaatttctaaaatttatgaaattcataaatgctcagattcatgtagtacaattaatgccaagcataataaaaagaaatttgcatctagacacatgatagtgaaattacagaacaccaaagacaaggagaagatcttaggagaaaccagaaagaaaaagaacaaatattttatcaatagcaaacttctccaaagcaatactggaggctagaaaagaatagaataacttaagaatgctaaaagaggccaggtgcagtggctcatgcctgtaattccagcaatttgggaggccaagacaggcagatcacctgaggtcaggagtttgagaccagcctggccaatatagcaaaaccccgtctttactaaaaaaatacaaatattagctgggcatggtggtgtgtgcctgtaatctcagctatgcaggaggctgaggcaggagaattgctttaatctgggaggcagaggttgcagtgagctgagattgggccactgcactccagcccgagggacagagcaagactttgtctttaaaaaaaaaaaaaagaatgctaaaagaaaatgtctaaaaagctagatctctgtatttaactaaacaataactatgagtacagttgaaatatagaccagtccagacaaaaatatagagagttttctactcacagatctttgcccaaagacataccaaatttggctgggtgctgtggctctcacctgtaatcctagcactttgggaggccaagggaggattgcttgagtccaggattttgagacaagcctgggcaacacagtgagaccctatctctaccaaacattaaaaaattagctgggtgtggtggtgtgagcctgtagtcccagctacttgggagcctgaggtggaaggatggcttgagctcaggagtttgaagttgcagtgagccatgacagtaccactgcactccagcctgggtgacagagccagatcctgtctcaaaaaaaaaaaaaaaaaagaagaaaaagataaattttatccagagtgttgctcaggctgctctcaaactcccgggctcaagtgatcctcctgcctcagcctcccaaagtgttggaactacaggagtaagtcaccacatccagtcttgttttattttttatctagtatttcttcttgagtcagttttaagttatagttttctaagacagagcttctaaatttatcaaagaccaacacttttgtaaaatacaaaattatgtgcttggatgctgcagtagggtaacaacaacaacaaaaaaatgctttaacaggttttaagcacttactctcggtttctgtacttactttgtggcagagtggcaagaaataatttgctgatcagtcagctgaccacactttgaatagcgctgttctaggaaaacatctggttgtcaaagttttcaaatctcttaatagagtactgtgcataatattttcatattaaacattgttagtgatgtgtagttatgttgttttaccagtcctaatattgtttatttccactgtttttctagatatatcaggccatagttctacttcggtagtctcttgaaagaaacaaatttgggatgtcgattctctttattgcatttttgtttagttagatgactaatgtgcttgttaaggacatggactctagagtctggggtatgggcttgagccccaatttctctacatactagctgagcaagttacttaatctcttcatgcctcagatgcctcaactgaaaaaaggtgacaggccaagcacggtgggtcgtgcttgtaatcccagcactttgggaagcctaggtgggtggatcaactgaggtcatgagttcaaaaccagcctggccaacatggtgaaaccccatctctactaaaaataacaaaaattagctgggtgtagtggcaggtatctgtaatcctagctactcaggaggctgagacaggagaactgcttggactccggaggtggaggttgcagtgagccaagatcgcaccattgcactccagcctgggcaacaagagcaaaactccatctcaaaaagaaaaaaagaaaaaatgcaataataatacctatatataaggttattgtaagaaagaaaagggttaatatgtgtaaaacatgtagaatatttctcaggatattataagttcttaaaatattagctttattttcactatcgcattaatttctgcttttcctttaatgatttttcttccattttttgcatttactctgctattaatctaacttcttgggttgtatactttattatctgaaatttttttcagtatgggcattttaaggctgtctactttctataattactgccttaacagaatctcaaaagctttgatatgtaacattattattttatgtagtttttaatttccactggtgtattagttttcttttgctgctgtaaagaaattaccacaaatgtagtggcttaaaataacacaaatgtcttatagttctacagatcaaaagtctaacactggtgttattgggctgaaatccaggcgatggcagagctgcgctcctttctggaggctccggggagaattctcttccttaacctttcaagcttctcgaggccctctgcactccctggtatgctgcatctttcagaccgcttcttctgcctctctcccaggcactttaggaccctttcatttacactgggtgcacctggataatccgggttaatctctttgtttaaggtcagctcattagcagccttaattcatctgctaccttcattccttttgtcacgtgacctagcatttcacagttcccagggattacaaagtggatacttgggggacagttttgtttttttttttttgcctaccgcaactgatttatacatttttaagtgtcccaatatatgtgaaatttttggttgattttgatttttaattttaaagcactgaagttacacaatgcactaataataaaaataataacaaaaataaaacaaaaacatggtgtttaagattacgagtgagttagtttgtcagctatcattgtttcttttttttttttttttgagacagaacctcgctctatcacccaggctggagtgcagtggcgcaatctcagctcactgcaacctccgcctcctgggttcaaatgattctcctgcctcagcctccaagtatctgggactacaggtgcgtgccaccacacctggctaattttttgtatttttagtagagatgaggtttcactgtcttagccaggatggtctggatctcctgacctggtgatccgcctgcctcagcctcccaaagtgctgggattacaggtgtgagccaccacgcctggcccattgtttcttttctgatggtgcaaattggaggcaggagaggttaaaaagttaaactgattagaaaggaagaaaaaaaattcattcttgatattatcgtccacacagttaatcctagaatttatgcaaactattagaacaaataaaaaatgttggattgtatttagatacaagatataatataaaatattatttgcattacaataactaagcaacaaataatcagatgacataattttgaaagacacaatttatgttaataataaaatctaaaagctgcccagaaaaaaaagtaatgaaaatgtccaatatctctaaagaaaccgttttttagagatagagtctcactttgttacccaggctggagtacaatggcacaatcctagcctttggcagcctcaaactcctgggctcaagcgatcctcccacctcaggctttggaatagctgggactacaggcatgtgccaccatgccctttttttcttattttttgtagagatggggtctcactatgttgctcagactggtctggaactccaggcctcaagttatctttctgccttggcctcccaaagtactgggattacaggtgcaagccactgtgcccagcccatgaaaacatttttaaaagacatgcaagaagaacttattgagagatgcattgctttcacaatggaaagactaaatatcataaagatgtccattctcccaaaattacttaatacatttaatataattgcactcatagtctcaataggcatttttagggatctggacaagctgattctgaaatattatgaaagagtaaatggccaacaagtgccaagaaaatctagaagaaagaaaaataggaagagggaaaaataggggaaaaatccataagactttataaaatttagtaattttaaaagtatagaactgattcagagatagaaaagtaaatcaatgagcaaacatagaaatcagcacacaaaatagggaaacaatatgacaggtagtatcataattcagtggtgataaggtagactcttcaacagatagtgtagaacagttcattacatacatgaaaaagttaaatccctatttcatgatatacaaattcacattcccagattcaggcttaaagattgaaattaaaaaaaagaaagtcttagagtgaagcatggagaaatcttcatagaactaaaaaaaggatgaaatattgatacaggctgggcccgatggctcacgcctgtaatcccagcactttgggaggccgaggcgggaggatcacaaggtcaggagatctagaccatcctggctaacacggtgaaaccctgtctctactaaaaatacaaaaaattagccgggcgtggtggcgggcgcctgtagtcccagctactcgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaatattgatacatttaactacattgaaaattaaattttaactatattaaaatttaaaagacaccataaacaaagtaaaaaggaaaatcatatactggaaaatgtgtagaaaccacatataaattgcaaatttattttaaaaactctgcaataacacaatagaaatgtcgcaaagtatgtaaatacgcagcttaagcaaaaagctcaaatggacaacagcatatgaaaatatgctcaacttcactagttctcacggaattgaaaagtcaagcggccaggtaccacttgaaaccgtcatgtcagcaaatacaattaatcgggtgcactaagttttggtgaaaatcttgatcattgctggtgagcttgaaaattaacatagccctcttggagagcaatttgtcaatatttggcaatgttgaaactgacctatggcccaggaattctacttctaatttctttctttctttttttttttttttgagatggagtctcgctgtgttgcccaggctggagtgcagtggcaggacctcggctcactgcaagctccacctcccgggttcacgtcattctcctgcctcagcctcccaaatagctgggattacaggcacccaccaccacgcccggctaattttttgtatttttagtagagacgtggtttcaccgtgttagccaggagatgatctctgtctcctgacctcgtgatctgcccgcctcggcctcccaaagtgctgggattacaggcgtgagccactgcgcccggcctctacttcttcgttctttagggtctactcccatatacactaggcatgtgtgctagtgtaaatgtacaaacatgctaattgtattctttgtaatttaaaaagtggggaaaaaagtcatgctcctgaatagaatcgatttaaaaaataattgtttttattgaaaagtttattaaacaatcttaaagctagatttacattgatattcacaatgataaattcctaaagtggccggttaagtgcaaaatgtaaattgtaaaaagatatttaaaggatatcatttacataaatttaaaaaccatgcaagatcatatttaaataaaactatgcatggaaaaaataagaaaaatcacgtgggaacaatatagacaaatttaaggaggttcactctggggaggggagggatgaaggtggggccttactgtatcttcaaagtcttacttatttaaggagaaaaaaaagcaagttgtttccagtaatactaacatctaaacatcttggtgatgatatatttgttacttttattgttaaaaacaaaatttctcattttattttgcattttgaaaaaggagacaggaggagagaagaatcatggactccctgggcacagcaccgcaggtggctttgccagttctcccagccccgcgctgctcctgcgcctgcgctgagcctccacgtgtcctcaggagacttagcctagcctgggtatcaccagcagtgggccaggccgctttgccttcaactcccaacagtaaccttgcagaggtcagcctggggccaccaggaggagttagtaagagcttatcctgtgggggcactcactggggctggtggccgggaaatcccaggtgttttgttggtttgagttttgttgtgtttttatttttcttccgctgagatcaggactgaagcagggacgcagtgctcagcacgcccagcccaccgcgggccactgcgcggagaacctctgccagggtcgcctgctcacgtcccctaatccgctcctggcgcgcgttcctgtcctcctcctgctgtgactagtgtgcatggaagggcacagtggtggcagaaagacttgtggcgagatatcaagatccacaggaagtcataagagaaaaagcattttgtttgaactccacccactgaccttttgtgggtgagctttcggtgaaacagcaacatcctcagaaatcttagagacacggctttgtaacccgggggagagacaccgcttccaaatataattgacgtggctttcctgccttaattcggggtatcctttttccaccacataatcttccctttgtccgcgctgattcctgtttagtttggcagggccagctgctggcaggctcccccagtgctgaatgctccgcgctccactgtgctgggcctgctgaaaaagcagacagcgctccctctcccccagaatcaggagccaaatgccacaccgattgtgcaacttgtctctggttaccaggaaaacgtaaagaaatgccaatgaagcagaaaggtcgacaaaattctttccaacgcttgaacaaaaaaggtatttttagggccctagatttatggaagtcaattcttccactcctcgccaggctttcaaacctcctattctttgcactacattatttgaataaaccgtaaatacccttagttgctctaatagcaactgctggtccatattgtgcaaggcggccatggtctgaagaccttgttgaatttgaaagacagaagttccgtttctggcacataaacttgaatcagggctatagttaagagtgccagtgaggtccacattttgacagctagataagcaggtcatttattcaaaaggactttgaatccatgcccagagtcaaatgcagtcctttgtaaagcccagcaggcttgaaataaaaacttcttaactgagttgatcagtgtcctgcattttaggggtcaggaaagtatttatgataagttggaaatggacagggcaggaaattctgggcctggaaggatggcttcctcaccagggaccgcaccaccatattttctaatttgtgtcttgagggaaagtttatattttttgctgaaaatattatctccttgtgacaaaaccacaagtctgggaagagaacacaaaaggaataaagaacaaatgagatctgtgatgcctcctggataaaactttaaaaacccataggcattgatcaatccaatttactgaataaatatgtaccaggtgttgtgttaggttctaaggggctaaaataactaagatactgaactaaagtagaactattgggctcctaatgtgatagtttttccactatagacagccctcttcttccaagggtccctgccagggcttcccctaccctaaacagtgccttggtaaaaattaggaaagtcaccccttccttaagacacttgactttccaacagtgccttggtaagaattaggcgagtccttaagacacttgactttcctctggcagaaaattgcaaagaaagtgtgcacaaacctacaatgtgaatgatgccttcctgtgtgtgtgtgcctttgtttagggcacaacctgaccggtctgatcatcagacacggtgatccacactcaagatgggaaagaaagccaggggcacagcctcctggaagcccctactccctgcctcatccacaccttgttgcaaaaaccgcaccatcctttaagacttctccatgaagcatcacttcagggaggctgttttctttttctcttgtctattccccttctgggaatatacccattcaccctggccatcagacagccctgtatatgtcaacccaaggtctcactcaagctctctctcaaagggctcctgggccccatgcaaatttagaatggagtaaatttgcattaaacagtttaatgtgttgcagaaaatatcagagaatggcaaactcctgtggcctggacttctcagagtacacaaaagaccgaagactgttctaacttcacagatgttctgtcaaaggctcatgtggccccccagataatctgttatgcaagtaaaaacagttaataagttgcctaaaggctcgtcttccagtcattttttcctctttagatctgaaagaactcttttgagcaacttcaaagttcaaattgtggtattaagtttgagttgaaatgggtcctttctctttttctcagaattatactgaaatgaatgtgctctgctgcatcctggcatgcactggagatgggggttaggtcaaaaatgaataggatggttcctgccttcaagcagccaataggaataaaaatactttgcatgtgtagtttccaaattgttttcacatatatcacaacacccacagcagctttgagagggagatgttattacatatattttataggtaaagtggatgaggctcagaaagggtgagtctaagcttacacagtagtgaattgaagtgacacccgaaactctgctctaaattttatctttccccaggctgaagctatagtccacagagcaaagtagtgtgattagtgtcaccttagtagtgcaaacaaagttgtgggcacagaattagagggagtagttttccctgagggtgcagtaaggtggtgtgaggaatggggaaatggaagagagaagagatagggttgcaactggtgagtcccagaggaagggcgaatggcagcaggaatggcctggcttagccaagcacccagaaaggagaaagtcaggccttggtgaatgttgagtggataaccaagcaccattggtctggaagcttgagggctggtctggaggcttgcaggctgtcaaactcttgaaggagtgagagaatgaaggtcctgacaggacaggctttgagcataaagtgatttcagtggacgtgggagccactcggatagtgacaagctcagatttgtgtttggtggagaaatgttaatttagcagcagggtgaggaagggattatcagaaggggtgggaaaggacacaaaagaacttccaggtccttttagggctaaaagtgcagatgtgagatctcaacccaggcagcaacagtgggagcagaaggcaggggagaagcatgagattacaaagaaacacacctcagctgttttagggtgttcagatggggacttctaagtgcacatgaacatagtcagttgtattcttttccagtggagggatcctagctttcagacatccccttttgtggaagccaattaaatgttttaaaattaaagcagattaaagcagagctgatctggccgaagaggggtgcttggatgcctggtgctccagcttcctgaggtagagcccttggcaaccagctcagcttgaaaaccagagctccagtgctccagcaggacccgaaggctgcctaaatagaccgtatctctatggatacattctccgtgtgtgtgtgtgtgtgtgtgtgtgtttcttggaaaattggaattagagtctttcctactgtctgtgattgattgcagccaaatattgctatgtaaaagtttcagaatttcaggatccagaaaagtaactggtccctttgagaccaatgttgaccctacttgcattttcagccagctggtgggccacaggtgttcactgagtgtggattctgtgtccacccttccgcatgtcaggggtgctgcactgactggcaaagtctcagagctcaaggagcttctgtattagtgggggacacaggcaacacatatacgtgagcaaataatacttttaaacataatcaagtgccatgaaaaaaacaaaacaaaacagggtaatgtgattgagagccaaggaggccagacaatctgacaaggtggtgtttgacctgtgattttcaagaagcagaggctcccaagtagatctgggggacatacatttcaaacagcaaggccagcaagcatcaagtgcatgagcctggtgctggctcagtgtgctagagggtcaaagacaaggctggggaggggtgagtgagtgcaagagggaaagaagataggattctcgttaggcaggcaccgatcacatggggcctggctggaccaaccagtaggatttcattctaaatgtttttggaaactgtcagggtccagttgacatggtagggctcacccaagctgccaggtgcataagggactttaaaggacaagaatagaagaaaagaggccagttaggagagggaggatactgacttggacaacaatttaatcaacaagagaatagggttagagatatattctggaggtagagtcaacagaacttactaatgaatttaagtgggatgtcagggaacaaaagcaatccgcaaaaacccctgtgtttttgcctggagcaatttagtgggtggtggtgtcatttaaagagatggggggacttgagggtgggagtcaatttggcctaaggcaagggttggggactgtgggcagaagccatggttctgctttggctcctaagtagcagaggtacaggaggagatgctgagtgtggacagctggttgctgatactcagaggaaaactggactggacatatggatttttaaacttaaagatccacaagcattatctttgagtgcttactatgtgcttggcaccactgatttacataaaaagtattttccattgttggagaagtgcttctctgctgagaactggctcccagaatagcacagagctaagacagaactgggttgtgccttgggctggatagtgagatggaacaccccacctgttaccgagaagaaactttccagggtaaccatctggcatcctctgcagcatgccagatctttggcacaaatctgtctttaaaacaacaacacaattaagcttctgcaaagcatggtgctgtgcaaatccagtgttagagatatcatcatgacatccaggttcctttccaatagcatcgctctgcacccaaagaagcctttcagtgtggtttgtgtttaacctcagatggaaataactatgtgggaaaataaattactcaagggctcaaagtactattcagaccaattaatactaattgcgtacctatagtattgccaagtgtttaatttctttggaataatgcttgatgttgccagtccttaaatgaatcagcttgatgttgagaatgtcataccatcatttgtataatttgtattatttattttgtgttgtattatttaacatttgctagttctgtcgaggaagccaggcaaagcatattaaagacacatttcttgacagaattagatttgcttaaaaaagaaaaaggaggaaaggaaggaagacagggaaaaagagagagagagagaagcaaagaggaggggagggaaatggaggggagaagggagggaaaaggagaggagaggagagggaaaaggggaggggaatggggagaagggaagaagggaaggggagcagggaagggaagagaagggaaaaaataaagcaagaaagaaagaaaagaagaaagaccctctctagcaccctcacgtaaagtgagatctctagggacagcagtgtgctggtggttttagtagtcagcaagaagcagataatagacaacaaagactttctgctcttccgcatattttccattctctgaatgggaatctcagaaatctagactggaagagttttgagaattatccatctatccttctacccatccatgtattcagtcactaaggagaaaatattttcagccatggtggggacaaggcatgggaaaagtctatgccatccatggcaaacactgtcttaggcacttgggtatttgttcattctctttacgtatttatattgtgcctactacaagccatacatggttaggctctgaagatacacttcagaaaaagatagatatagcctctgcctttaaatttgtttatgctgtagtaattaagtaattacatgggtattaataaatcacaaaatacataactagaaaaatagtctttattttaattgaatcagaatccataacaagaggaactcacatgggtctgggagaaaggacaggtcgggaaaagtttcctcaaggaaataatgtgtcttttgagacctgagtgataagtaaaatggaccaggcaaggggacttgggtagggagcgtccctaaggaactgtgactccagataatgaggatagggtacatctgtcaacaggtggaacagcaccctatgttattagtgccattagcgtggtttaaaatggaactataagcgttgagtgcttttattcttagtttatcctcctttccctgggtttttgttttgatttggttttgatttttaaaaataatttaaactgcctgggggctgaatcataatttgatcacttagtttgtgatcatgggctgactcaataacactataaggtggttgtgatgactaaacgagttaatagtgcctggtaccatgtacagtgtatattaggcactcaataggtttggttccctcctcccatacataagcaatcagtgcttgtaaactgcacagcaaagaggtgatatctgagactacttaatagttgaagaggcatttgacttagcccttatattactatcaagggcacaggaacagaatgttatattcaggaaacattacactcacactgtactacaataaatccttcttgtattttgaatcttttttactttgtcctgtgctgcaaaagaaaattatctgctttgaaatgactcaaataattaggttcagctcacccatatcatcattttttctttaacccaactgattagtaacctgaactacatcttcaaagaacctttgaaatgttggataacataatcatagtagtaacagcaggtggtagagatcatggggccatcttagaattctgcctatgaccagaaagattttttgagtgtctactgaggaccaagcactggtataggggctgggctttacctcgaagagcccccatgaaattccagctttcacagagcttgtcacctgggaagacagataagacgatgcatatgtaaacataaaatagagaggaatatgttctctcaaggaattaaagcatgatgttatgatagaaaattggcataggtggtcctattttagagcaggaggacctctctgaaatggagacattggagttgcattttgaatgatataaggaaccatccttgcaaaaagcaaagatgcaacagcaaagtttctaaggcaggagaaagcgtcacatatgtaaatgatgaacagaaaaaggattagtgttgctgaagtgagcattctagttgttaatcaaaaatgataggatactctaaaatgactctcccataaaagtattaactctccattaatggattttacacttgttagacttttttcattatcaaatttcagtaatagtatgctagatcatcctgaaaaatctatcaatcaactctaacaacaaacatttattaagcaacttttatatgtcagtcattgaataaatcagtgaacaaaacaaaatgtcatgtcctcatggaacttgcattttagtgggagtgaaacacaaaagaaaatttaaaatgggtaaaatataaagtatgttagactgtgaaaagtgctaaggagaaaaaataatgttgagaaaagacttaacaaatttcttctacccatcccttcagtaatccaaatgtgcatacatccattcatacatgccccatatatcttacatcgatggcttgcttactatgagccagatattgaggatacaaattaaataaattgtgagacttcctcttctagctatgatacagttactgctgccagatttgctctctggcatatcataaaactggagagaaaaaaactgaatctttccatcattgaacagcaggggaactgaggtaaggaaacgtcagatgagccccatatttgtcctagcttcttgttgggggcatgttttgaactgcagtgcagggagatagagcccaagcagtgcacagtgcttttgctgagctgagaaggctaagatcagacttcaagatgacagaagcatctggaactctcagggcagggtactgaaaaggagggttctgaggagagctgggaccataagaatctgtgtgtgtgtgttttgtggattcatggccaagggatataccgtgcattcagaggaaaaaattccatgagtcctaaaagaaagtgattgcttcagggctgagagcagaccatgaaatattagaagccatgtaaagttagaagacagatttctggaacagtcagttgacaagcatctctgaaaaccgtgggcatttcgttcagaccccaaaagcaccacaacctataagcaaagaccacacctcagataagggacctaacttagaactaaagacaaaactgtactcaaacagccctaacaaagaaccaaaccgagcttgacagaacagggaagattccaagtagtttacttgtttgccagacaaaataatactctctttaataaaagacactgcaaactagactggctctgttctctagcatactgtaaagctgcagaaaaaatatgaatttttccatcattgaacagcagggaaaactgagataaggaaacatgtttgagccccatgtttgtcctagcttcttaagtaaagtagtataataattgattttactttaaatgaacctaattaacttaattttaaattaatagttttttgataagactacattattgtaattcttagaacatccactaaaaagatagctagctgaaagtataggtgtagataaaaagccaatagagaattttaaaagaatactaaaaatttttgattttacaaaaaaggtagtgaaaaaagggtaagaagagtaaaaaataaacaaaatagatgggacaaatgtaaaactaatcaataagaagatagatttgagccaaaccatatcaataataatattagatgtaaatacgttagaggccggttgcagtggctcacacctgtaatccagcactttgggaggccgaggtcggccaatcactttaggtcaggagtttgagacaagcctggccgacatggtgaaacctcatctctactaaaaaataaaaaaattagctgggcgtggtggtgcacagctcacctacccaagaggatgaagtgggaaaatctcttgaactagggagccggaggttgcagtgagctaagatcgtgccactatactccagcctgggcgacaagagcaaaactctgtctcaaagaaaaaaaaagagtgggtggaatattcttcatcaaatccatgaccataattggagattttaacacccctctttctgttatttatacaactaatagacaaatagacacaaacacaaacagtaaagaatacagcaaatttgaaaaatgctatcaacccacaagacctaattgacattcaaaaaacagtatacccaacaatgcagaatatgtattctttttcttttttcttttttttttttttgagacaaagtctcactctgtcgcccaggctggagtgcagtggcgctatctcagctcactgaaacctcttcttcccaggttcaagtgattctcctgcctccgcctcccaagtagcaaggattacaggtgcccgccaccacacctggctaatttttgtatttttagtagagacagggtttcaccttgttggtcaggctagtctcaaactcctgacctcaggtgatccacccacctcggcctctgaaagtgctgagattacaggcatgggccaccatgcccggccagaatatgcattcttttcaagtacacatgctgcattcaccaagataaactttgtcttaacacatttcacacacttaaaatcttagagtaatattaaattaaaaataaatgacaataaaatatataaataataatacatctagaaataaaaagaaacaatatagaaataacagctatatgttatataacatatataacagaatatacaaatatttgtatagataaaatataataaaaaatttaatacatagaaatgccaaaaatagttggatatttaaaaacacattatataaacctatggatcaaagaataaatccaaaaggaaatattagaaatcttaaaacatattttgaattaagtaataatgaaaacacacagtatgctaaaatttgtgagatgcagctaaagaagtgtttagaagaaaagttataatattaaatgtttatattagaaaaaagatgtaaaaccagtaagtcccatcttaagaagtagaaaaagaagagcaaactaaacttaaagtagaagagtgaaaattaaaaaagcatataaactgaagtagaaaatgtgtaaacaataaagaaaattaataaagtcaaacagttttttgaaaataataaaattggtaagcacttagcaagaaaaagtgaaaacaaattattaacatcagcagtaacagaggaactattgctgcatatagaagaatagtgaaaatatattagaaaaaagtttcttttaataaatttgataatagataaaattaacaaactctttgaaaaactcatcttaataaaacactaaaaaaaatttaaaaactggccgggcacagtcgcttacgcctgtaatcccagcactttgggaggccgaggtgggcagatcaccaggtcaggaggtcaagaccatcctggctaacatggtgaaaccctgtctctactaaaaatacaaaaagaaattagccgggtgtggtggtgggtgcctgtagtcccagctactcgggaggctgaggcagaagaatggcgtgaacccgggaggcagagcttgcagtgagccgagaacacgccattgcactccagcctgggcgacagagcgagactcagtctccaaaaaaaaaaaaaaaaaaaaattcaaaaatctgagaagcttatatatattaaaagaattgaatttataattcaaaacatttccacaaagaaaaactgcaggcccagatggttgcacttgcaatttttttttcttttttttttggacgaagtctcgctcttgtcatccaggctggagtgcaggggcatgatcatggctcactgcaacctccccctcccgggttcaagcgattctcctacctcagcctcctgagtagctgggattacaggtgcccaccaccacgcccggctaatttttgtacttttagtagagaaggggtttcaccatgttggccaggctggtcacgaactcctgacctcaggtgatccacccgccttagcctcccaaagtgctgggattacaggtgtgagccactgtggaggcctgcacttgcaatttctgtcaaaccttataaaaaacaaaaagaaaaaaatcaaccaattccaccaaatgttgtcagagcatagtggaagaggaaatatttatcagctcatttatggggcgaaaataaccctattaccaaaacctgacaaagacattagaaatgaagaccaccatctgtatgaacatagacataaaatctaacactttaatctagtaaatcactccagtaccgtgtaaaaagaataataagttgaccaaatgggccaggctcacgcctgtaatcccaacactttgggaggccaaggcgggtggatcatttgaggtcaggagctcgagaccagcctggccaacatgtcgaagccccgtctctactaaaaatacaaaaaactagtcgggcgtactagcaggcgcctgtagtcccagctactagggaggcagacgcaggagaatggcgtgaacccgggaggtggagcttgcactccagtctcggcgacagagcgagactccgtctcaaaaaaaaaaaaaaaaaaaaaaaaaggctgggcgtggtggctcaagcctgtactcccagcactttgggaggctgaggcgggcggatcacgaggtcaggagatcgagaccatcctggctaacatggtaaaaccccatctctactaaaaatacaaaaattagccgggcgtggtggcgcatgcctgtagtcccagctactcgggaggctgaggcaggagaatcccttgaaccagggagtcagaggttgcagtgagccgagatcacgccacagcactctagcctggcgacagagcaaaactctgtctaaaaaaaaaaaaaaagaaagaaaatgcaaaaatcagctgggtgtggtggcacacgcctgtagtcccagctactcaggaggctgaggcaggagaattgcttgaacctgggaggcggaggttgcagtgagctgagattgtgccatgcactccagtgtaggcagcagagggagactccatctcaaaagtaaaataaaataaaataaaaataaattgaccaaatggattttatctcagaaatgcaatcagtgagatcgatcagataatttaccacatttaaagaataatattgcagaaacatcttgaaaatgagatataaaatgttttaatgccattttcaatgtcataacatgcacaaacattattttgagaccccaacataaaacttaaaaccacaaattttgtagaaaaataatacaaaatatttttcaactttgaagtgggtgaaatttgcctagaaaagacacaaaaagccctaaacataaaacaatgataaattgaacctcaataaagtaaaaaaaaaaaaaaaaaaaaaaaaagtctgcttctgaaaaggcaagtcacagaccagaagaaaatatttgttttctgtgtatgtatgtacatacatacaaaacctttgtcaggttttggtaatagggttattttcgccccataaatgagctgatattatttacaactacatctacatatttaatttacatctacatatttaattatctgcatctacctgtctatatactaaaaagacaaccaaatcaacaaatgagctgatattatttacatctacatctacatatttaatttacatctacgtatttaattatctacatctacctgtctatatactaaaaagacaaccaaatcaacaacaaccaaaaaaagtgttaaaaaaagacttcacaatagaagctataagaagacccaataaactcatgaaaagatgctcaacaccattcattattagagaaatgctattaaagacaccaagatagccttttacatggactagaatggcggaatattgaagagattgataaaacagtactcccagtatcagagagttgtagaataactggagctgtcatatgttgttgaagaatgtaaaataaattacaaacattttggcaaagtttggcagtgtttttgtaaaactaacatacatactacaccttccagcaaatctgctcctagaaatgagtatgtacgcctacaaaaaggcttattcaagaatattcatagctactttattcataatagttatgagctggaaaaaaactcaggcaacccaaactagtaacaacccaaatgtcctccaacaagagaacagataaacaaattgtggtatactcatacaaggcagtactaatcagcaataaaaacaaatgaactactgatgcatgcattgctaagatactgactaaatgtctgtaagggtgatcttggacacttgtgggccccgctgcgggcagagtgaggcactgcctctgtgcttttcagtgcttgaatcccacctgtgctcatcaccatcatggtgctgaaaacagcactatcagcatttatgtatttgtttacttccccatctccttacaccaagagttccttcaagttggcaatggtcttcctcacatctttaattacccaatgtcctgcccagcattggagatctagcacagactcaaccaacatttatgaaagaacaacggacactcagatgcagcttttatttcctttgagcctcctaaggccagtacaatagctattcaacagtgtctgttaaatagcaagtgagagtcattatttggatgtaggtaattggataaagtttctatcttgccagcagtttgtctagattagttatagataacttaatccaaggcaacttgcccaaggccacccagctggtcaggtgtcagatgtgggtgactgactagttgttcttcccacctcactgcagctgcctcctctcataatatgctcaaggagtcagtgcctaaaagtggtacttccttccatgcagaacaactgcaagctgtcagaatctgtacaaggaagatgtcatcctgtttggctggggtacctcggaagcagtgggaggtggagtccctcccacatgccatcctgagggcagcagtggcagttcttttgcttcctgtcccttctgaggggcagagcagagccttttctgagaatcaagtcagagcaagcctaggcacaagagtgagtggaggaggggtagggtcacagacattttagcctcttcatgcttgagaaagaaatgagaactcatcttctcagaggcaagggcagaggtagaagcccagcctgtcctgaacgagaagggtgaccttggcagtactctaagaagtagtcaagtccgggtgtggtggctcacgcctgtaatcccagcactttgggaggccgaggcgggcaggtcatgaggtcaagagattgagaccatcctggccaacatagtgaaaccccatctctactaaaaatacaaaaattagctgggtgtggtggcacacgcctgtagtcccagctactcgggaggctgaggcaggagaatcacttgaacccgggaggcagaggttgcagtgagctgagattgcaccactgcactccagcctggcgacagagcgagactgtctcaaaaataaataaataaaataaaaaagaagttgtcaaaacctgggtgtctggccttccacagaaaatcgacaataatgtctgagagcacagttaaacattaggttaattctcttggttagaaagagaattaacctaatggtacccttttttttttgagacggagtctcgctctgtcaccaggctagaatgcggtggcaccatcacagctcactgcaacctccacctcccaggttcaagcgattctcctgcctcagcctccctagtagctgggactataggttctcgccaccatacccggctaatttttgtatttttagtagagatggggtttcaccatgttggctaggatggtctcaatctcctgacctcgtgatccgtgtgccttggcctcccaacaagagaattcttaaatgtatatttctcccagtgtcactaagaaaatccaatttaaaattattctgttctgacttggccttttattctgcctctcatgaatgtaaatataaaacttttatatgagagactcttggcattgtctatagatagaccatagctacatcagaaacacacacacacacatctgcacatgtgcatacacacacagagtagctatttgagaaacagctgtgaccccttcaaagacaggaggagaaagggaggaatgggagattagtgtaaggacaaagtcaaactatctaatctttttatcctctcagctaaacagattttgtcttccttcagtacctcacgcttgacctccatctctcaaaccattctattatttctaccttatctttagctatacatgaatctaattatagaaaagataataatgcataatgatcaaatgcatgggctgaacctccaatatttgagaaaattgttggtgaaatcttcacctaccttattatctatctctctaatccatctgtctaataaaatgaaaaccaaatcaataaaaatgagcaaaataaagaaaataaagctgttattacatgcatctccagagaaagctattactgcaagtgactctcttattttagaaagtgtaggaaagtatttttctgtgagtgggattatataatctttacctactcttggaagccaacctaagaaacatgtcatccactccccttcctcatctttgcaagtggtgctatatgccagcaggctgagcattgtcattactgtaagaaagagtatgaattaatccagcacacatcccaaattcagaataacaaatctggaatgtggaggcccacctgtctgtgggtccatgttgagaagtctacacttttgattacatgtttgcctatttgtaaatgacaagatttgtcctgcactagcaaaaaaataaaataaaataaaaattctggccatcaggactaaagaatccataaaacttagaatagtatagttacaaaattggttctgataaagggaaatagaataaacctgcttcaaacttcatcaatcattgttccctttatcattttcagatcattaaaccagcttttaatcacaaacactaatattttattgtatattttctgcttaaatctagacagtgttagcttggcattgactttcccaagtagcagaattagtgatattttgaatgatataaagggtatttatctattctttcattagcaaacattatgtaagtagttactatgtgtgtagcatagtgctgtattgtaaggtaactgtcttcaacatccaggtaggattagtttctccacttgtagataggtacatctatgctataacatatgtattatgtccttggctgggtatggtggctcacgtctgtaatcccagcacttcgggaggctgaggtgggtggatcacgaggtcaggagttcaagaccagcctggccaagatggtgaaaccccgtctctactaaaaatacaaaaattggccgagtgcggtggcgggcacctgtaagtccagctactcaggaggctgagccaggagaatcactcgaacctgggaggtggaggttgcagtgagctgagaccgtgtcactgcattctagcctgggtgacagagcaagactccatctcaaaaaaaaaaaaaaaatgttcttttctgcctcaagataggttgagattgtccttcatggccctggacatggtccaaaaggtggagaggcctcagtggtcctttctgaatgtgagcacccaagcctgcccattggcctagcccttaatttatgtacatgtgtcatttatggcccatcctccagggctgcaccgtggggctcctgccttttctgacgtacagcaaccacaatagtgagatgaacatcgaagctattggagaaagtcccaccactatagtgtaaatcagcctagatttactttgcgtaattttaggctatttcttttttttctttcttttttttttttttgagacggagtctcgctctgttgccaggctggagtgcagtggcacgatctcgactcactgcaacctaattttaggctatttctaagacagtcatcttttggttgaacaaggtaatgagttgggataaatatatcttttttcattcctggactctctctcttgtaaaacacacacacacacacacacacacacacacacacacacacacaccacatgcatcatggacacatatacttctaatgtttttcttttatttatcccagaaattgaactagggatgcccctgtctctattctttctgctctgtacctggtactaattaatttattcattagtattaataacaagcctggtcacttttcatccagtcatgtttgttccctccacatcagaaagaactcttgtgaccaacatcaaaattcaagttcaggtatgtgtacgagtcagaatgggtccttctttttctcagaattacattgtaaggaacctattctaataggcattaaagtaactagctttggcttcactcagcaggaatctcacataatcagaattgaatgtgacaaaactcaatccattctgtataaacaagagacaccttagagaaatcaaatctctttgaaggactgaagtaggaaggctaagaagaaggtacacctgatacactctttctttcactctaacaggcacctgaacctccgtggcacagcagatgggaatgactgacgtggctgagcattcatctgccccagggaggcaccgcattgtaggggatgaacagagacttttcaatcagatagacctgcattcaaatcccagatcagtctcctactgccttttgatcttaggaaagttgcatcactcttcaccagagttccaaccctgagtttcattctctgtcaactggaaatggaaatagctatgatggtagcgagggttacatgagatgctatttgctcagtgccaatgatcaatagcagatggcagttatgtgattacgattactgtgggatcttttcaaaagagggtcgccagcagcttcttagctatgttgagcttgattgtctgtgaaggcagaggcctgggtggtagctgcataaagagacagctctacttcttgtatgtcttgggttgtaggccaggtccccagttcaactcctcctctacatgaggctaccccaactccacgggccaaacgccataggaaagcagatattacatttagaagtcctgatttcacttttaactatacttcattggtaagacaacaataatgtcagctcattagcaaatcaacaaataacactttaactggaaattactggacactattacttagactgtcctggaagagggctctaaagtgtgtctccatttaaacttataagaaaattgccaagagcttatgtgttgtcttgtttagaagtgaatacaatgctgccagccatatgtcttttagattctagcttgtttgttagagatttctagatagagccaaatttgtggcttggccttaacataaatattcaaatgattcataaggattttttactgggctttcactttgtctagaaactaatatgcatgtgttctagaaaaaacactaagttttgagattaaatctattttaaattaagtaagagataaatgtgagaattatgtatgagactatatggcattccttgttataagcatataacctataagctggtgtctttagatgtgtaagaatataaagcaaacagaaaagaaatactgctgaattttaacatcattttttgaactgtcaagagccaaggaatagctgggcaaaaaatcaatactgtctcattgcctctttccctgacccctttctatctgaaacactatctccggttgtaaatgtttaatttacttctaatgtggcaaaaatctcaggtttgcagttttctagatgagtaacacaagctcaatatcatttagtttatgaatataaaaaaataaaatgcacgtcaaaggcaaatgaaagccttttattgaatctgatataatttacataatatgttctgatagtccttgttattctttcacatttacataatttttgtatatttacaaaagtcttcaagcttgcttttatggactgtttctcacagccaccctatgaagtaggtgtagtagcttgctttaaagcaaagtgcaagaggaatagaaaaatgaagtgtttcccagagcgactcagcaaagcagctgctgatccagattgcaaattcctggtcctgcgtccctccctcattagccactaggtcccagctcctctcatttttttgcatcctcagacactcctttccctctgcctattttaatgaggcccctgagaccctcttttggccagctttcctacctcttcaccactttcctagcccctaggaagcttttctttaagcctaggaaaaaattaatttgctgatacttcttccaaattggcctgctgccgccaccacataatgattttcccttcagaggtgtagattgcgtaccttgcgtgcagagattcaacgtagtcactctgcaagatgcaatattaggctctgaaccacatttcaccaagtccctagtgacctatagccactttgacttgctaatataattttatccaagagttatgggtaggaaaaattaaatgaagaggaagaatttttgtaaagacccaagtctgtggaattgtatcttgttcttcatagtgctggatatgtgctagccggtagagccacctactgaaacacaagttttcttgtacacctttggtactgagagcccatgagtcccaccatcctaatcctccttcaccttccctcatcatctccttggccattatgtggtagatgcaagaaagacatttgtttctcttctaacacgtttcccatccttgtcttactggtatagttactgagatagaaagattcagatcttcctaagcagtaattaactcattggcattcattatgaatccctttgagatatgagcctgcatttaaaaacaaaaaccaaaaaactcagtctttgtaaattagatcccatgttctgctgtcagcccagtgtgcattatataccggtggaaataatcagtgctctgtccagccctggaaagtgttaaataaatcacacagttttatgagcttacaacaagactcacttggtagcctctttcttacccaataatcttttactaataaaagcactagggatttataaacactacatgtacttttagtgatcttccaaaatatgttaccctccttccttctgaagaaatggcaggttgacacctatctatctaaaaccatttatccagttctcaaaataagcaggtattgtgctgaactaaaaccaaaattgtccggagtattcataaaatcaggtagacatttaagagtatgatttccattttcttttctaaaagcacttagaatagcctcttcatgttcttacattggtaaatcatgtataagagatatggtttcatcttcttggtgattacggaagtgctgagcattccaggtcctaatgctgatgcctatacctcatggtacaagacatgtgaatgcagttatgagctttgggctcaacagtgcgaaactagggaataacctagaagatttgtgtttgtttattttaatcaaatgtctatgatagttatatttgttgaatttgattaattgaaatgtagatttctggagtacaacaacaagatgctattaatatatgctatgattttttactttatttctttaaatatctatgtaaatacaaaagcttctagtattcaaaataccatattcagagatcaggttaaaatattttcatgatatctggtgagcacataaaagtaatttgcgttaaaaattttggttacagtaatgggaagaaagaatgcttcatggtaacacacttccactaaatttgaaataagaagaaaatcacccatcataaaaatttaaatagagtttatcaggtaatggtcacaataaaaattcctgatcgtagtgttgtcaaaggaagccagtttttgccatttaatggaatcattactttgcatttactagctttatttagcaaatggtgctcaatgatacaagttgatagtgatactatccatctatagttaatacatataatcaacacactgtaggcaatttacttaaagccaaagaacacatatgagtaattgaggataggctaagacatgaactcttgagctctcataaaatcacatttcctgagccattcctcttgcttgctccctatggaaaatgttccggtacattctagcctagtgagccaattcatcaccaatattcagcactactttgacccaatattttatgtagaaccttgtgaatgagtctatggtattcttccagaattatatagttatagtttgatataaattataaggtgaccatgaatcatattcagaatatcattggtaagccaacttcctttccactatgtctatattgtacctacatgtctttatatcaacttgggtgtattcaagggattttgctccaaagtatcccttaagttcagaaaatgggttggaatctaagtgggagcaaaagcttttggtgctttcgtagaaaaaagatattcacaaaattatcaccaaacttgaccacttctcttcactggcatatattttattttctagccttctgatttgtgggttttactctgctagaaaaatgtatttcaggggaaataaatcaattggctacctactttcctataagtataaagtctcattgtttttctacagattgatcactatgccatgatgttctatattctttttttttttttcatttctatttaagaggcaataagcaagacgtaatttctttcaagagcacagtgatcattcatggaactgaataatgatcaatgaaatgataacccaagacctgaataaacatagcattaatgctagaaaatgtcagtgctgtcacttcaaaagggcacagtgtcactagaccaggctgttattttttattttgttcaatggacttatcttgaaattctccaaaaatttatttaattcctactaagaggggtatgttgtaaataacaataatgataaaaagtgcttgataatattggctgtagtattcagcatgccacttactgcatttgacccttgtgggtacttagaaagccctcaccttctaaattcctcttgtcatccaaatgctgcctagtgctaaggaaagatttgatggtttcctttattcacttgatatcctcttttttatggtacataaatggaagttctaaatgaatgctagagcctcatattagattcttgtaaatggaatcgtagatcatctcacttctgccttagtcacaagattgactccaagtgtacctaacacaaagaaacaacatatactggcctctaaagatatacatatatacttagtcattatccagtttagtggatattaaattgcaggaaaaaagtggaagaaaacgcacatttgccgctaaatgtccttcacagattgcatctgcagcttccttttttgtgtttagctctacatgaatgattggcataacttttaaaatgtaatcactgcacataacaactaggttatatttgattgcatcttctgaataatgtttaaaaagtaaaaggcagatgttatcatgtactttcctctcaggctggttccaggtttttttattcaacaattttatgtgaaaggcaattgcagaatggaagaatttagcatggtttctaaggtcacaaggagaaggtgacgtgactctgcaaacagcacccccagtcttgcctctctgcccagggcggtgttattaaatgagtaggcacagtggagggctcattttccctcctgaccaccctcttggggctccctgtgtgacctctgtacactgggctttcagaaggccacagagatgacaacaagaccacatttgtttttatctttcagtcaaatagattcatcagacagtctagacactactcttttgtctatcagaggacaaaactacatttgatgattcaatgatcatttttaatgtattgaaaagaatttttgttaaaagatggccatcatataaacatggattgtttaaataacctcatttttctcttacctcataacagaaaggaagatttcttacataccttattcatgttacaacctgatttatatccctgagctaagaattctgagtggcatcatagcatctgaaagcttttgccaaagacatgtcagaactcctttaaggagcagatcaccccatgaattactgacttacccagcctcagttacctcacagttaaagtatgccttcatgatccaatgggagaagctgttcagtaaatgcatagaatatttctcattgtcatcagggggtgtttcccagaactttggaaccgtttctaaacccatagccccagggtgttttcaaagtttgatttacaaaataaatagacatctaaaagagattttagtcccaagctatttttttctttttgcagaagttattagatttgaatagatacctcaaagccattttttgaaatcaaaattctcctttcttacatccaaaatcctgaaaggagcctcgagaggtcactacactgcttctatgttgtaccagaactgaatagttcaaattactgttgcgttttgataaacaccgccctgccccgccgccacacacacacatgcacacacacacagttttcttctcctacttctctctcgcttggttgaattaccccactgacagagagaaaaacaacattcactggcctccagggaaagtggtgtcgctgcgaatgaagggtggatagaggtggtgaaccagaagacatgctctgtgttggctgcaaaggctctggctctgtcatttccccagaatgtcccctgcagatgcctggcagtggaagatcagcagtgaagggcaggagagaggcagctatgcaccagctcttctttggagatactaccaaaggggaacatttgagatgcattcaggtctttttaaaggcatttttaaaccatatgttaaagaaccaaacaaagtggatatggatcgcttacgaagtaaagccagttcttgccttcgctttagaaaatgcttccctaggctcagagaaaccttttaaagtgcccactctgtggaccctccacttcatgtacaggatgtacaaaagaacagcacagcagagcagggcactgaccatagcaccagactgcccggggttaaaatcccgtttctaacatgtgctgctctatatccttgatttagtttccctaataaatggaaactaaatacctacctcacagagttgtgagaaaatggatataaaaacacttagcaggccggttgtggtggctcacgcctgtaatcccagcactttgggaggctgaggtgggtggatcatgaggtcaggagatcgagaccatcctggctaacatggtgaaaccccatctctactaaaaaatagaaaaaattagccgggtgtggtggtgggcgcctgtagtcccagctactcgggaggctgaggcaggagaatggagtgaacctgggaggcagagcttgcagtgagctgagattgtgccaccgcaccactccagcctgggcgagagagcaagactccatctcaaaaacaaaacaaacaaacaaaaaaaacacttagcacaggctgggcgcagtggttcacacctgtaatcccagcattttgggaggctgaggtgggcagatcacttgaggtcaggagttcaagaccagcctggccaatgtggcgacaccccgtctctactaaaaatacaaaaaattagccgggtgtggtggcgggcacctgtactcccagctacctgggagactgaggcaggagaatggcgtgaacccgggaggcagagcttgcggtgagctgagataacgccactgcacttcagcctgggcgacagagtgagactccatctcaaaaaaacattagctgggcatggttgtgggcacccgtaatcccagctactcgggagtctgagacaggagaatagcttgaacccaggaagtggaggttgcagtgagccaagatcataccattgcactagcctgggtgacagagcgagactctgtctcaaaaaaaaaaaaaaaaaaaaaagcacatagcagaacttagcagagatcatcactcatagtaaatacactaaatgctcagtatatggtagtaagactgattgcgatgatttttgtagcccctgacacttgctttctccttagtcttctattttaaagaacacaagaaacatgatttgtccctgctctcctagaaaggggaaacttggaggctcagcagcttttctcgccatgactcttgctgtgattgcattttgagtagggaacgtgtaaaattcattatccaaacccggctactttggagagtgaaatggagtgtgaatgcgatgggacaccagggcaataggcataaaccgggactctcccaggaacactgggagtttggttaccctaattatgggactattcaagaaactgaaattctaaaccttcttcctgtttcaaagtctgaagctcaactggaggctaaggtgataattttctcagaagtctattcctgtatctccagaagaataggagataattgcacttgctattttatcttatacttgccattttacccagaaactatttttaaaaaatgagtcacaacaagaaagcattattgctacttttatattcctttgtcaaaaaccttggctgggtcgtcaggaccctggatccattgccctgcttggattatcacaatcctcgtccaagttataccacttacacaaccaggcagctggttctagggacctctgagacctctaagggtttagaattgtttttaatctcctggagtattattatgtaataatgtcagtggtgttatcttttctaaactcagattttgcctccttttggaagtagagttcaatctaggttgtgagcaacacactactcctgaaagcaccatgaaggaatgaatagtacccttactcatccttatttggaatgttttatgtgccagacactataatttcatgtaatccccacagcaaacctctgtggtaggtactgtcatcatctggaaagaggggtcactgagacacagagagaaggtaaatgactaatcaaggtcttacgactagtaagctgaagcatggctttaaatggagagagtgtgacttctctggccatgttctaaactctgagccattcaacaaagtcgggtggcctgaaggaggggaagaggcctctacatttccaccaccacattacaggaaacaaaatttattttgatcttagaagctgaaatagtcatttgcatggcccataccctcaaagtgctaccttctggcctagggggtaaatgagaacaaaacttgtcgtgagaaggataaacagccacagggtatgttttaacacatagccctctgaagaatgctgtttccattgtgtaactggaaagatctggaatatcaatattattttgatttctctctgtgctcattgggaactcatttcaagggctcaccaatctgtgttgcagaccaacatgtgatccaactttcaactaacatggcattttctatcaggcttcttagcagttcacacttactattttgcagctcattcaagggctatgataattaccttgtcaaagactgaaaaatagtttctaatcaactcacacattttatcctatggaaagaaattcaaggaagttacaattaatgctaacccagataatttgcttcaaggaaataattaaaaacaggagttaaattgacttgaattatattgctaagtaaaattcttataaaatgtaaaataaatgggtctgagttttgaattttaatttttgcagagtcaactttattaacaggttaaaaaaattcatgaaacatcagctattgaactcaattttccagatttctttagtcacttgatttgcttcagtcatagtaccaatactgtcttttattctgttgatgaaaagagtcaaactctgtaaaatatttgaagggatttattctgagccaaatatgagtgactaatggcccatgacagagccctggctctcctagaaaggagagaattggaggctcagcagcttctctccatgactcagaagatcctgaggacatgtacccagggtagttgggctacagctcggttttacacattttagacataagacatcaatcaatacatgtaagatacatgtcatcaatacattttagtgagacataagacataagtgagacataagacataagtgagacataagacataagacatcaatcaatacatgtaagatatacactggttccttccagaaaagcaggacacctggaaggaggggagccttccaggtcataagcagattcaaagatttccttattggcaattggttgaaagagttattatctaaagacctgaaatcaatagaaaagagtgtctgggttaagataagggattgtagagaccaagttccttatcatgcagatgaagcctccaggtagcaggcttcagagagaatagattgtaaatgtttcttttcagacttaaaaagtcttttctatcagtcttaaggtctctgttttaatgttagtgctggtcatctgtgcctgaattctaaaaggaggaaggcataatgaggcatgtctgacccgcacttcgcagtacgtcctgaactagttttttggattaactttggaatgcccttggctgagggtagggcccatcagtcacttgggggtcttagaattttatttttggtttataatttttttgttcaaagctgttagttttaaacttctaaccaaacttgtggttatgttttatttattcattcattcacttacatactttttttagctaacctttttttttggcatctaatgacctcaatttacaaattcattctttccgcagatatttgtgaaccagacatttttctaggggctggagataaagtagtgaataaaagtgaaaattttctgctctcaagtagtttgcagcataaggggaaaagaaaggaagaaatgagaaacaaatggacaaataagataatgccagatgatgaccaatgctgcaaagccataacaagggtgagatgatgaagagttggagagttaacaggaggaggttgcttaagttcgagtggtctgagaggcctctcaagaagaattagggtggaattcagtcatgggaatacttgtaccaaggccatgtgggactgagggagaagcaggtcccaggccttgagcatctgctatctgccagggctgtctgggagacggatgattcaaagttgcacaagaacagccgtggtctttgcccttgtgaagtttattgtctgcaggaaaataaagtcctgcctccaaggaagtcctgattggttgagaaaatagatatgtaagtcactgtaatatagaaaaattctcctagtaggtaccaacatgaaagcagaaagaagggaatgatccagtttccctggtgttaaattatgtttagcccaaagctgcctccttacatatttgaagtttagattaatggtttctctgtatgtagtgaactgtaacctaactggatgtgtaaacagactgtcacttactcctgtgccaatcaccaacttttggccaaaggcagacaactgttcaaacttcattcaaataaggcaaaagccaaactgtaatcaacccagctgttctgtacctcacttccgttttctgtacatcactttcctttttctgttcataaatcctttccaatcacatggccacatggagtctctctgaatctattctagttggtgggtggcggggactacccgattcatgaatcattctttgcccaatgaaactttgttaaattgtacttgtcaatgggtttttctctcgacattgggtagagcaatgggtgagaggagaccttctaggggaatttgcctggggatagtgagtcacattgctggcttcctaaagcaggtgtacaatctaccatgagttgctgttttcagtcatagagaaagatattctccttgtgcttctgcctagttttcccttaacaggcccacaagggtgtcagtgatttctgtgtcttaggcaccatttctcattgtgatctctacacagcaggttgtggtgtgcccagagcttctgcaagctgcccgtatctgcaagctgcccatatctttgtctttaaaccagaatcctttcttgaaaacaaatgagctttccctaaaccctgtaattcgactacaaatgcaatattcaaatagcctgtaattggaatataaataacttctaataggccatgtaaatgagggtgttaatgtattatgaatcagctgaggaaaatagcaaggactgtattctcttccctcttcactctccctccagcctggagttccattcagtgagtgtttcactgaaaacataccacctccttccttccctcactaagcacaagagacccagagtccctgccatttaatcatggatttggcagatggttttgttatttgtcaaataaatctcattctatcaattacttgtgagaatcttcagacaggagatccttcagttccatgcaggcttgtaaatgtccctgctcagaaatacaatttgaggaaagctcttaaggcaccaagaggaagtgagtacatgagaatctcctggttgggactgatcccaatctcagatcaaggagtgaagggagggaaaaacactgatagtaggtggagaataggaattgtttttcttttttcctccttttctaatataagggaagctgggaggaatctcttggcctccctgaagttcaaaggtcactgatatgaggcacatgaataggagaaaaggcatacacatttatttaatgtgtatacacaggagccttcagaatgaagacccaaagacacagggggaattgttcatctttaggcttaggttcaacaaagtatgcacagccatgtagaaataggactagacacaaagggtatgatctaatgctgatagactgagtggggaaacccagcaaagcctgtgtgtctagatcctgcttggcctctatgagcatgcattccttcattctgagtatggggcaggactctctctagaatagggttcttatggcctacagtcaaacaactaagtcagatcatttcctttcttttcttttttctttttcttaaacagagacagggtctcaccatgttgtcaacgctgctttcaaactcctgagctcaaatgatcctcccacctttgcctcccaaagactgctgggtttataagtgtgaggccaccacacacagctcaggtaatttatttatggccagtttttacacagaaaggtggaaggaaacttagagtcatattttaggttttatggctagctctgggaatgagagttctggtttctatgacccaccttggggaagagtgattctagtttctatggctagctttgggaaagaatgggattgagagacaggagggcaggagaagatcagagaaaaagttttgcttatgaaactacttctgaggtcttcattttggggtattgttttctgagccccaacaagcccatactttattgagtgtctactgtactcctggaaccgtgctgtatggctgttttctctcatttaatttccagaagaagcctgtgatatactgattattattctcatttgttcgagatcaggaaaccgaattccagaaaatcgagcagctggatcgtgtaacttttggtagcaaaagtttttgtctactctgtcccatacaaactactggaatagaaatgaacaggattgtgatatttttgtcatgctaatgtaaaaaggaaaaagaaatactgactctgttaattttaagctataactattgcataacaatgatagatacaactattatctaccaatggtggtgctcattctagactctaggctctttgaaaatagtaatttgtctttttcatctttgtgtcttcccttcttttctttcccgtcaccctactgaaaaacattgtattgatacagagtactggcaagagggtagttggatgaatgactaaattaatgaattgatgagggtgattgatcttttctgacgtttacctaggagaaaaggataacagtctagagggtaaagcttgggaggtagggaatgtgaataaattagagctcaaaaaataaacacctggatttaacaaatgcttaagtgagggaggtgtgatcagcaatgcagacagaaggctgcattcagcagccaatttaagaaagatgcttgagaagtttcaagacaaagagaatttgagcaaaagttggtgggcctggagcaaagctccagccagggagaagagtctgtggcaagaacacaggacggctgtgggtctggtcactcaagagtcaggcacttcctgtgcttcaggccccctgcagaaacttgtctcttcttgaaggcttccaaacattccaaggggtgactcccaggagccccgtttacaagttaatcagcagaagcttacaagatccagctgcttaattttctggacttcagtttcctgatctcaaacatccaagaggccttaaataacctgccctgagtcacacagtcagtaaatggcgcaggtgggatttagtaacatctggctgactccagcctctcctgctctgtctatcgccctgtgtttcctcaaaggccggatgacagtgggggctgtgagatccccagatactgcagaggaatgctgggaacaaacaaacaaacattaaaaaaaaaaaaaaaaaacctccctacttgcttcagaacaaataaagctgagatcaaggaagccaggtttggactgaggcaagaggtcagggtgaactcatacacaaggacagagtttccacacaataaatatttattaagcaatcgccctgcaatgaaggcctgcaagagatggatcactgcttccagctgctcgggaaaggagagccatacagctttctcacaaatatgcatgcatgtataatacgaaatgcattgctgtaccttgagattctcttaaataccagtgaagtgagttgggtactttacatagaacatgcacacacacacacacacacacacacacacacacacacacacacagatagaggaggacttttaggaagagcttgactgtcttctctggttcctcctgcagaaatcttcagcagtccctgatgcctaaaagaacgctgcgtatttgcctgttttgcctccataagggaagtgtcctgcccaccacgccttcaaaaggaatggccttcaggccttgtccttggttccatttgaccctgtcctggccacagccagctggactaggggtgggcactcagcaccagcagccaagccaacagccggctggagactcatagtgtggcccagaataaagtcagggctgagtcaaccagactctatcttgggaatgtgaattgagaaatatagacttgagatcagtttgttcacgagacacaataaaggaaattagctttggagaaagttctttgtcaggaactctcctgtcgcacacccggttcagtttggttttgcaggtcagcatactttcagctggtgaacgggtgccagtctgccatggggcaggcatcctcacttccccccagcgcctctctcacctggtctaagccgctggtgagcagctcacactgcacgcttcttaaacttccccaacaactctcctaactcagactactctcttgcatcagtgaactctccatgccctccttgcttcccccaggagattctagacatctgctgagagaggctggatggggagatgggctaagattcaaaactccagtttggacacctcttagcaagggctgcaggtaggagatatctggctgctcctccaggttctcctttaaaaattgaggactcttcctacttgttagcttcagttttgaggatttaactaaaattatgaaacaacagggaaattcccaattggcaaccttttacaaaaggatgggagctgaacctgcacagttgagaagctttaaggacaagaatggaccacccatgtgcaaaacaaggcagtgcgggagaatcggagagggttgaaagcatgggctccaggggccccacagtactggactcaggcctggtctggccatttcttgggtgtgtgacttgggacaacactaacatctttctagcctaatttcttcacctgtaaaatggagaaaataatagtccattcagataattatcacaaagttagtccaagtaagcaaaagctacctataacaggaagagccctggcccttgggggtagcatcacataggcagagatgtgaatggtgcctgattcccgaatgccgggaaaatgaattgggtactttgcacagcgcacacacagagacacgcaacactcacatacacatacagagatgacagaagtttaggaagatcttgttggtagagaggagacagagaaaaacagagatacaatgagaggcagagagagttgaagaggcgtcatgcggccatgaaagagagggggaggtcagttcctagagctgacagatttctacttccagctgttcttccactccaagcctataattgacaaaacaaaacaaaacgaaaaagcactagcaactacttgtgggtgagtctgtgttccaaaaaagcagaactaaaccaatgagcaacctcctgaaatgctccactccctcccctgggagtttctctggacagatcttaaatatgggcttttctaggaataatgacactcaaatgttgagatggctccaatataacaatatgcatgtgacagacttgcatcattagagtacaaaaccttcaagtcagaaatagtaagctaaaacacatggaaattttctttctgggcagaatcttgctgtggttttattacaaatactttggtagtagttctttgtggtagattgcttccaaagatggaagcaggagtctcttgcaacgtgacctcgccgttcctcccactaagagggggagtctctttcccttccccttgacccttggctggcattgtgacttatgttgactgataagatgtggcagaagtgaaggtgggtgatctacaagcctccgttacaagatgtcttgcagtgttcattttggccctcctgcaggccctgagacctccatgtacaaaggccttgcttagccttcttgaggcctggaaaccacagggagagaaaggcctcactaacagccagcatcaactgtcatcagtgaggccatcttagacaattcacagacagccaagctaccagatgatgtgtctataggtggattcacccagctgagctcagcccgaatcacttgcccacagaattgtgagtaaatagtgtcttcaagccacaaaagtgaggggtgttctgttacacagaaacagatcatggactcaaggatataccactttcctcattgtaagcaggtgctcttttaactatgaagtaggaaggagggcagcacattcacataaccaacctatagtagaatttgggcagccaaagtctaaagggattattgtgttaggaatttattatcattaaacaaaaaatgattgtttagccatgtgaacagcaggtgttggccctcagttctatctcttaaagatagaagcaagtggctttagagtggggtggcagagcttgctcttggggctgtttgatttgtccaaaagcttgcccacaggaatgcctgtgggggtcaacttctccttaagccagggtgtcacttaaggtggatcttatttgcaagtatcagcagcaatatcaccaaggggatttcccttttcttttccttctgacaactattgcaactaattaagaattctgtgacattttagctggagaatattacccagaaaacacatctgagtaataagggacacacggacacaggctattgtcacagagatagtaatgtttttaacacggacaaaaagcttatcaaagcaaatgcaaaatcagttaatctggttaagtccaattgcaagagtaaaacctgtaatgactgcacatactcagagagcatgtcccaggtgcatgcttttgactgtcagataggtcccgttctttttcattaaataactacactggtctataactagtcctcacccaactcattttcctttttggccaaggaaaataatctccatggtattcatataagatcttaaaacgcgacatggtaaaataaatatcctgttgctctttttgtttgtttgaatctttctatcagtggtccctgtaagggaaaaacattctgcctcgggatatacagaggtaagtggcggagaggacacgaagcactcatgggttcagtatagaggaatacaaggactctgggaagttctgcgaattcccacacatcatggctgtcggctgctcagcacttgcctaagctctagcagacctcagcaataggaaaagtcaggcatggtgtctctggggataaagttgctattggctagtttgtgatgtcacacatagaattttgctttgccatagggatgagacacaggaatcaaagctgtcattttgcagctttgaaatcacacacaagtttgactttttttttttaatgaaatttaggtcaactgtaactattctgaaattctggcaaaaggataggaggagagtgttaagatattacattcctgcaaaattcaaatcagtgaaatgttacatgc

SEQ ID NO: 318 - DNA, 39158 bp, Homo sapiens
cgttacctacgtgggtccgaagctgtcgccgacctgcgcggggcggaagtcccgctggactgcctcctggtagggaagtctctccggcgtcaggaagctggagagcacagccacagggcagctggccccaaaaagcctgcgtgggacgggccggtgggcacatgctggaggccgccccgtttccgcctgggggccagctggccggtggggccgcactttccctggatcctccgccaagagggctgcctggccgctccgcggcacagtccattccctaccccctcctccccggcccctgccctgcccgcggcgggcactttgtcccgcggcccgggtggctgcagcttaggtttctccccggaaggaaagcttgaggcgcacggttgcggtcggccggctgcgggggaccaggggccacacctgccgcggaggttacagtcggtaaagtagagcggcgacacgaacttctccacccgctccagcgtggtgcgccagtgcttcaaggccggcgcagccgccatcgccgggctctcgctcctctttccggaaggcccctggcgctaccgttccgctccacggcaggaaaccaaaggttccggcgtccagagggcgcctcccagtcccgggcagcttttcttggaacaccggcggctctcggaagcccagctgctgtctgaactttgagccgagttggaagctagaaactgtttttgaggctctcctatgttgtccgaaatagtgggccgcagggaaaatctcaaaataaaatgggaaatttgacgattagaactctcgaaagtctcaagacagagacttaggccattcggcaagacaggcgggagcctcagctgctgcagacccagcctcagaagcagcaaccgggagacctctggctctagctgtcggtgaacacggaaagtggtgtttgcttaacgtggagccagactacccggaataggtgttttcataccggacggagatcagggtgttagtgagcagggtggtagagctttacgcccaagttactacgacttactcgattacacgctttactgaatgtatattgctaactcttgcacatcaccagaaactctggagtttgaggtggcagaacagtcatggcattgacgatcccaatggaaaaatgtatttcaccatacaggactgtagagtcccgggaagccataataccagaaacagacctccagtttcattctcatccctagtactccactgacagctttattttttttctcctggggttgccaagagtctttgtctataaaatcattaggaacaaaaaaaaatacacaagattagccctgatattttaatggaaatactgaccaagtttacaacatttcaaatgcagatcacacggaaaggtgactaagtacagaataacaaatgtgatttaaaacaaagataacctgctgctgcatataatacaggttgggtttagagcttggagctcagatgtcagacagcaggaggaataaaaatgctacttgtgaaaacccaggctgtaggtaaaacttactcttttgttggttgcactggtgggttgggactttctcctgaactggccttgaaatcctatcctgacctgcaggcaagtgctctggacaaaacactgcaggggcagcaacagctggggctgaccctgatcacaccccaccaatttcccctatggttccaggtcaacatgacctttcttgagggaacacggggataggtgaattatttgagaaaacctcaagatctttcccctaaatcagtacacatgaccaccgccaagtcagacactgccccagctttgccctaaaatctcatcccacaaagctctttttggcaccctacactttggctcacagtctcttctccccagtacaaaaaaagcctaaaatcaggccagggtggctcacacctgtaatctcagcactttgcgaggccgaggtgggaggacagcttgaggccaggagtttgagaccaacctgggcagcatagcaagaccctgtctctacaaaaagttaaaaaattagctgggcgtggtggcatgcagctactcaggaggccgaggtgggaggactgcttgagcctgggaggtcaagcctgcagtgagctatgatcgtggcactgcactccagtgtgggtcataaagcgagacactgtctttaaacaataaaagcctaaaatcagagaggtctaccatgtgttttgaaaatccaggagccaaaaaattttgtttttctttttggtggtggtggtgatttttaactaaaaagcaaacataaaacacacagaacattgctggttacaactaagacttgcgtaatggttgctgaagaaaaatccaccagagtactgggaggggctcagttggtctttgttcagaaagtccaggttaaccacatagaaaaatcctaatcattcatgtttaaatgtctgctagtttaaatttatgtaattaaaaaaataggtatcccatttcaaattctctccctcccaactccatttataaggtataccacatgccttatgcacacttttttttcaaacactggtttggtatttaagttgctcacccccatccatcaccaatgtgaataagaaaaaatatatagaaatacaaactacatagcttgacaacttacccaaatataaaatattttcagattatttgaacaagggaaaaaaacacgtactaaaagacttaagtattctaagattttggaatattttgatttgggacaagtaacaagtattttaagcaaaatcctgtttctaccctggataaggaactgaagtcaaaatccctgcttcacagtattttctggtgaggacaagggacgtgggttgagagtttattccttaagtaagaaccaagctttatttatttacaaaaaaaaaaaaaaaaaagttgggggcaaaggggaagacaagttttacacaaaagtactacaatggtaactccctttggtaaaaagtgtaataaatgtcttgtacatctgttcataggtactaaatctgaagccacagtactatggtacacaagaagctagagcagttatgctagcacatcaaagcatatttcttttaataaaaaattgacagtatgtacattatgtacaaaaaaacaagttaaaattgtgtgtgtgtgtgcgtgtgtgtgtcagagagtaaagctggtggatggcactaaggtagactagtaaagaggcagatacaaaacagttccacgggagctaaaaaggacaactgatttgaactcgttgaggttgagaaccagaggagagaaaagggtaggcagcaagggaatcgtcaggaataaaatccacaagatgatcaatcccaaagccaaactgcaggtcccagataaaacctaatgggtgatcttagatgtgctcgagtgaccagaaaaaaaaaatcaaatccagcttttttttccttttgtggggaggggagaggagcagtgaccatgatagttccaatccatctgagtattaagtccttctccagtctgttttgtaaatgcatctccatccagtcaaagtgtgaacagcatccggttccctcattgaaagttaggccacaggagactccagtcttagctctgctggtgtgtgcaagcaaactgcatgtctttgcttgcatggacttccttcccctccagggcaggctatacccaaaaccctttgggaaaagttccagcttcagctttgtaaggtattcatgttcctaacaggtagcccacttggtgccaggctgcaccagccacacacaggtcaggtggccatgtcccagagaggcccagtgaggcttgaaaggcatcttccttgtttcttcagtgtgtgagtgcataggcccacacacacatccccacacacaccccaagttatctgctctggctttgcagttaaggggctttgaatactgtgccgtatttgacacgatacttgttaatgctcacaaaatgcagggtctctgtatcacaggtggtggtacagggcaccaggccctccagcccctcacccatgagccacttgctggtctctgctgccatttcacggggcacatgctccttggtccatttatctacccaggcctggaatctctgatgtagacgcttgcttacacgctcatgggactgcaaaacagaaaaaaaaaattttattaaatgaagcagaaccaaaaaagagcccttcaaatacaaagcctaattttcttctaaaggagcaaaggaaagatgtgggctcaagtcttagataccactgtttttttcttaaaagaaaaaaaaaaggattctctgtttaaagagaagttaaagaggtaagaacatagaacatgtgagggcatgaaaatccataaagcctccaaagaaatgcgaacacaggctctgggctgaaaaagctcgctgttctcaattttagcatgcgttagtataaccgagggaatgtgttaaaaaatacacatttctgaccaggtgcagtgactcatgcctgtaatcctagtactctgggaggctgaggcaggcagttcgcttgagctcaggagtttgagaccagcctgggcaacatggcaaaaccccatctctacaaaaatacaaataataactgggcgtggtggcacacacctgtagtcccagctacttggtaggctgaagtgggaggatcgcttgagccaggaggtggaggctgcagtgagccaagatcgcaccaccgcaccccagcctagatgacagagccaaaccctgtctccaaaaaaaaaaaaaaaaaaaacccaaaacccccaaaacccacatttccttggtttaccaatgtgcattttaaaccagcaatccagctgattctaatgtatcctgggtaggacccagtgagccattgatcacttctatcagcatggagatccacctctaagccagacagtgcaaagcaaagggcttaaaaccactctccctccactgtgttaccccaccctgggaagcagagtccaggcttggcagatgttctgcagggggttctgttcccaccaacacattcaataaaaatttattggtgtccacatgcaaggatactagaagagatacaaagacaaaactggtgttgcccagtgtcccaaataatgtgaatcagagacaggcagacacacaacacatagcaaaaaaaatgagccaggtgtggtggtgcacgcccgtaatcccagctactcgagaggctgagacaagagaatctcttgaacccgggaagtggaggatgcagtgagctgaaatcatgccactgcgcttccctcagtgccatgagagaagtagagcagactcttgaacaacacagctttgaacagcgcagggccactgataggcaagttttcttccacctctgccaaccctgagacagcaaaaacaacccctcccttcctcctccctcttcagcctactcaacaagatgagaataaggaccctttatgatgagccacaaccacttaatgaagagtaaatgtatcttctcttgcttatgacttaacattttcttttctctaacttactttattgtaagaatatacagtataggctgggcacagtggctcacgcctgtaatcccagcactttaggaggctgaaatgggtgggttgtttgaacccttgagtttgagaccagccctgggcaacgtaaggagaccccgtgtctattttcattaaaaaaaaaaaaaagaaagaaaaaaagaatgcagtatatataatacatacaacatacaaaatatgttgtttatcagtaagccttccagtcagtagtagactatcagtagttccattttgggggagtcaaaaattatacacagatttgactgtgcaggggccagtgccccaaaccccttgtcgttaaagggttaattatacattaaactgtctgctcaacatctcccatttgaaagttttgtagtcctttcaaacttaaaacagcacttcatctgtctcccaaacctcataaccctttcctattaacaggtgagcccctaaaatctccacttaagcaaaacaaaacaaaccaaaaaaccccaaaactaatcaggcaccatccttgatgtccttcttttgcttacccccacatttgatccaacaccatctcttgtcaattaaatatctaaataatatctacatctgggcgtggtggctcacgcctgtaatcccagtactttgggaggctgaggagggtggatcacttgaggtcaggttcgagaccagcctggccaacatggtgaaatcccatctctactaaaaatacaaaaaatcagccaggcatggtttgagacacagcgaaactctgtctcaaaaataaatgcataaagtctacaatgtaattcttgcaattccactgccaccctagtagtacgggtggcccccacatctcatttggacaagggcacccttttgagtggtctctgctcttccaactttatatatacccatctccactgtcctcacagaactccaagctatctttgtcaaatgtcccagtgcatctcaaacaaattacaaaccatggcctatcattagacaaagtgatgtggcctctgcctacccttctaacttcatgcaaccttgagccacaatggtgtttgtaatttcttgaatatgccaagtcctttcctcccagccttgtactagctcttttgtctagaaaacacccatcctctactcttcaccaggctaattccttgtcattattcaggcctcaagcatcacctcctttgagaagcctcctccagtgaaagcaaggcctgtatgctagttacccttgatcacttcacctgatttgtttccctggtagtgcatatcatcgcattacttcatctgctctacttcatggctgtagtcccagggcctggcataacaccctatacgcagctgcaccaggaaggtttcacaattgagacagaatgtaaagacaggtaggattcatacaagcaaaagatcagatactacttgagatgtaaatactgggagtaaattcaccaaaaaggtgccaccgggtatttacgtgctcttacaggctgaactgtattctccttaaaattcttatgttggccgggcatggtggctcacgcctgtaatgctagcactttgagaggctgtgtcaggtgagactctgtctcaaacaaacaaacaaaaaatcatacattgaagtcctagcccccagtacttccgaatgtgacctcatctggaggcagacacacacacacaggtaggaacaccatatgaagatgaaggcagggatctacaagcccaggaatgccaaagattgccagcaaagaaccagaagctaggagaggcctagaagagattgtccctcacagtcctcaaaaggaaccaacactgctgacacttgactttggacttctagtctccacaacttttgtcatttaagccacagtctgtggtactttgtcacagcatccttagcaaccaacatacgtacttcctcagttaagtctcagctccaagaacaggtttgcataaacaaagaaaaacaatcagaagactctgggcctcccctggtcctagctagggtgggagatgtgtacagaaatttcagttactggttctcacctgatgagcccggagcagggcggtcctccgatacatatagtcctctgatttgatcacatacaccatcttgtaggaattcagcttgaatctacactccagcttatccagactatccacattctccatggtcttcttgctgtttccttccttcccttccttttcctgctgctctcgaccacgttgacacttccggatccgccgtagattcctattgcagaaaagccccggaggatgagagctcgtccagatgcagattcccgtgacttccccaaagtgagttttctttattatatgcttgcatagtactcatcccaatttgttaaatacatacacaaatgttcagttgtttcactgcaaaaaaaatttcaactgcaaaggtacacagaataaaaagcagaaatcttcacccatcccctacttgacttagcagatgtagccagttaagagttttaatgagaaacttctaggcctctgtctgtaaatttacacatgtaattaccagctacagttctgctttgggatttgtttttaagacaaaataggatcatactatatattttgtcctcaacttttcacttactgtcatgaatattttttcatttcatgatagatttgtcttattctctttaactgctgcagaaaaatgtaccccaatttaccattccttaacagtttctttcaactgaggttcctcatctgaaccacataacaaaaatttatttgaatgactatttttaaaaattcccccagatgatataaactagtgccattctacatacacaagaaagaagataattcacatgaatggatgccctgaggggtggtaggcttgctaaatctcaacatccagtgaaaaaagttatcagctagacaattatattgtttctcataacttgctattaaaaacactgcttcaggttggccactgtggctcatgcctataatcccagcactttgggaggcaggtggattgcttgagctcaggagtttgagactagcctgggcaacatggcaaaaaccccttctctacaaaaaaaaaaaaaaaattaggcaggtgtggtgacgtgtgcctagagtctcagctacttgggaggctgaggtgggaagatcgtttgagcccagaaggcggaggttgcagaaagccaagatcccaccactgtactatagcctgggacacagagccagacactgtcttaaaaaaaaaaaaaaaaaaaaaaaaccaaccagcccaaaatattgcttcagtgagaatctttgtatacaagtatttctgtagacagcagttctttgtccaaagggtcccaggaccctttcaggagatctgtgagatcaaaactattctcataataatactaaaacattatttcccttttttgctgtgttgacatctgcactggcaccattaaagtaatggtgaacaaaaatgctggtggtggcgccaaactgtatttgcaatatcgaacaaattgttaccaaattccaatatcaatttgtacatcactgagcttttcatacagttgtcaaactctgttggtttatcttgtaccatcaatgaatccattttacttccatgattttgcaccttcatgcgactgcaattcaagtctttgaacttcacactgaccatacaatgacattaagtgaaaaaagccagtttcacttaagaatgtttctgatgggccagtcacagtggctcatgcttgtaatcccagcactctgggaggctgaggcaggcagatcacttgaggtcaggagtttgagactagcctggccaacatggggagacctcatctctaataaaagtacaaaaattagccgggagtggtggcgcgcacctgtaatcccagctattcgggagggtgagacaggagaatcacttgaacctggctggtggaggctgcagtaagccaagatcgcgccactgcactccagcttgggcaacagagtgagactctgcctcaaaaaaaaaaaaagaaaaaaaaagtttctgatgaagcagtaacattttctattaaatcccaacccctcaatttacatctttttaacatgctgtgtgataaaatgggaactacacataaagcacctttgtgtgctaaagtacaatggtattcttatagaaaagcacttgagcaattgcttgagttgtaagtggatcatcatttttacccgaaagaacaactgactaaatatagtcaatctcagccaagtatttggcagatgttttctcaaaaatgaacaagggagcctatcacttcaaggaaaacaatgttgccaatggtaagactggaattttcaagcaaaactatgaattttggtgaactggtatcagccaccctgagcttgacagcttcccaatacttaaagatgtgtttgatgacctagcgatagcgatattaaatcaatgtgatttcttttggagacactgtaaaatatatcaacatttagtaggtgtgtataacttattttccaaatagccaattgcgtaaagttacaaaatcatagaggaaaaaaagattcattcatgatacaaaataaatcaatggatttttacaactgcatgaaaagcccactgatgtataaattgatattccaactaacctttaagaaactatcactggggccgggtgcagtggctcacacccgtaatcacagcactttgggaggccgaggtgggaggatcacctgaggtcaggagttcaagaccagccagaccaacatggagaaatcccatctctactaaaaatacagaatcagccgggcgtggtggcacatgcctgtaatcccagctactcgggaggctgaggcaggagaatcacttaaacctgggaggcaggggttgcagtgagctgagatcacaccattgcactccagcctgggcaacaagagcgaaattccgtctcaaaaaagaaaaacaaaaacaaaaactatcactggtagttttgttgtcatatcaaagaatatccagttatctgaaggatctgaaaatattcctttttccagctacacatttgcgtgaggccagattttcttcacatatttcaatcaaacaacatacataatgcaacagattgaatatagaagcagacatgagaatccagctgttcttctggtaagccagacactaaacaaatttataaaatataagcaatgccactctattcactaatttttgttttgaattagcttttcattaaaaaatattatttaagaaaatataatagggatatatatatatatatatatattttatttttgaggcagagtctcactcggtcacccaggctggagtgccgtggtgcgatctccactcactgcaacctccgccttccggttcaagcaattctcctgcctcagcctcccgagtagcttggactacaggcgcctgccaccatgcccagctaattttctgtatttttagtagagacagggtttcactgtgttagccaggatggtctcgatctcctgatctcgtgatccacagcctcggcctcccaaagtgctggagttacaggcgtgagccactgcgcccagcccaatattgttatttttcaaatgaattaaagattgaaaacatttctttgtttttatttctaacttggtaaatattactagtataatccatataaacaaaagctttttggagtactcatgctctaagagtgtaaggggtctcaaggccaataagatgagccccttagctgtcagacaaatcattagaaactgaaattctggagggaagattccatacacttcaactaccctgccaccagaacgattatatcaatttccttttcctcacagtacataaatgtgcctccttcctcatatcatggtgagagacacatgatgacaggtttattgtagtatgttattagcatggagcctgttttgttgagaggaacctgacacagagcaactgctcaaatgtgttaaatgattcaatgaatggagaacccggcagggccctttttgctggtatctcttttcccatgttctcattaggactcaataagtctaataacactgggatgatactttcttggaaacctaagacataagatttcaattcaaaacttttaggaaggaagaaagccattctacccattttatacttcttaaactgttttcatatacttggaggatcagtatcacaatctgcctatacacagagggaacatttttaaaattctgtgcagaaaagagttaatgtagcaggcctaagattgctattctttgaaaagcctgcttataaaagttggcccttggctgggggctgggatcttggattttgggcaatgttctaccattccttaactcatataagtgtctcactgtacctaaactatttgtacaaactctatagcttatgctgaaaatgtgctttctttctgagagtttgggattttggtacatgctaggcatacagtgcctagatgactacatctcaataaaaatcctggcacagagtctctaatgagctgccctggtagacagcattttgcatgtgttgtcacattcattgttggaagaattaagagtgtcctgtgtgactccactgggagaggattctaggaagcttgagcctggcttcctccagctttgccacaggcaccttttcgctttgctgattctgctttgcatcttctcgctgtactaaatcagtctgactatatgcagagtcctgtgagtcctcttccatcgaaccatggagactctgacacacattcccatccaaagtacggaggttattgttgattctctacaactctcacctcccagatgctttgacacatgctccaggtaagctcatgttgtgacagccatataaaaccttgaattagcatccccagcagatagaacaaatgaataaaatatgtgaaggccaagaacgtgaaagtcatttaactctccattcctcaatcatgcacagtatggactgctgacagatgacatggctcactcacctggggagaaatactggtttctgtgctagatgttcacgaagctcaggcgaggtagtatctgaattcatgtatcgctccacgtagtctgaccagcgctaagatggcaaacacaaaatacaggtggaaggaaatcacaaaaacagctcctaatgcattgggcactctagtaaattctatgattacaatgccccgaattcataaatttcaagatcaaaaaagtccctttctataaagacatgattgttagtaggtattggaacacggattaaaaattctgttagccagcaatactgctaagtttctgaggtgctaaggttatgagaagtcataaacaggtagaagctggctcactgacaagtttcatttccccacagagcattttgttaaagaacaaaatttatagtggcaaatgtgtgaaagtttccttcacattacaatctagatttctgacatcgcttaaaaaaaaaaaaaaaaaaaaagatctgccaacaagccaacattcccaccaaaacaagtcatcccacacgaccccccccaacatcatacatatggcctgcatctcctgtgtacattatctgccataaccaactatgataatcacacctgtctattcaggggttgaaaactctggactttatcagtccaataaaaagtaaacatgacacaaagaatcaagatgacatgagaaagacctcatttgttgttttttatactttaggaaaaaacaggaaagctgccaaccataagacttccttagaggagatagctttactaagtgcaagatgaggttaacatctataaccaggcagcccgtctcttcagctgaagacatggctggattgacttgtactttaagcatccaggtcctgacccttaaacaggcctgaggtgccttggccttttggcagacagggtcactggacagactctcaaggcacgccagctctgcttggcacctggggtctgtgatgtacttgctcatacctctgcttccacagggtcatccgaattctcctcttctgtgtccagaagctcaatagtcagctggacctggccttggctctgaataaacataagctgcaaataagaaacctaagcgtaaacaaaagaccgtctctgtagctgtaatctatcttctcaaggaatgagaggtgcagaggcaataaacttagtaaactttgctccaactgaagagatgaggaagatactagatcttgggtggccagtgataaaggcaaaagtctacacttactacaagtaaaatgaaatatattaaagcaaaaggtactatttcatgtttcaaacttctagaattcgctaaaataataatcaatgtcagtaagaatgttttacaaaacaaatattttgtcagaaagaaatatggcacatgtagccagaaccacaaaatgtcaatgctctgtccattggtaatcccacttctaggacgtaatagaggaggtaactatcagaatcacatggagaaggtcagagcctggaaggaaacctgagaattttttatttcaaccttcttcattttacacagagacaaaactgaaattcagaagagttctggtttctcaaggcacaccactaatcaatatacatgcagagccagaagctagatctagctcagtgttcttttaaagctttaaaaattgctctctgctagtaaagcttacaacctgacaataacataatatatacacacacaaatacagttatttccaaaatagatttcggggtgggggcagaccctgcattttcacaatttataatttaagaattgcaaaatctgtctccagtattcataacaggatgtcattaaccagtccccatagtgggttggacgtctaggatgtttccaactatttgcttttataattatccattataatggtgaaaaattggaaacaacctaaatgtccaccaatacaggcattaattctctaaaaagtgaatatcaaatagccataaaaaagacaataaagacccagaagtgttgttaattgagcaaaaatacattaaagaccatttccggtcagatgcagtggctcacacctgtaatcccagcactttgggaggctaaggcgggcagatcacttgaggccaggagtttgagacaagcctgcccaacatggtgaaaccacatctctactaaaaatacaaaaattagaccgggtgcagtggctcatgcctgtaatcccagcactttgggaggccaaggagggcagatcacctgagctcaggagttcaagaccagcctgaccaacatggtgaaaccctgtctctactaaacacacacacccacacaagctggccatggtggcacgtgtctgtaatcccagctactcaggaggccgaggcaggagaactgcttgaacccaggaggcggaggttgcagtgagctgaaatagcaccactgcactccaagcctggacaacctggacaacctggacaacaagagtgagcctccatctcgggaaaaaaaaaaaaattagctggacatagtggtacatgactgtaatcccagctactagggtggctgacgtgtgagaatcacttgaactcaggaggcagaggttgcagtgaaccaagattgcgccactgcactccagcctgggcaacagtgtgtgtccctgtcttaaaaaaaaaaaaaaaaaagttaaagaccattttgtccagtataaactctttcaaaatatatactcaagcatagagaagtttagaatcatagagatgtcatcaatgataatttcaggaaagaattctaaggtgactttttttggttatctgcattttattttcatttttttgggacagagtcttgctctgtcacccaggctggggtgcagtgacgcgatcaggcctcactgcagcctcgacctcccaggctcaagcaatcctttttttttttttttgagacggagtctcgctctgtctcccaggctggagtgcagtggcgcgatctcagcttactgcaagctccgcctcccgggttcacgccattctcctgactcagcctccagagtagctgggactacagacgcccaccactacgcccggctaattttttgtatttttagtagagacgggggcaatccttctacctcattctcctgagtagctgagactacaggtgcacgctaccatgccgggctaatttttgtattcttgtatttcttgcagagatggggttttgccatgttgcccaagctggtctcaagtgatccgcccacctcggcctcccagtgtgctgagattacaagtgtgagccatgtgtgctgggcctatgttttcttttctataatgatcatgaccatggatttcatgtaccaacatttttctaacaataatatttacaaagcatactatgaaaaatgttcagagaaaaagaatacaaaattgtaaaaatcatatataactagttttttttttttctttaaaggcaggaaagaaacaaagtagattgtccaggaagacaattacttccactttgtagttctctggtgaactcattaaaaggtccaggagtagaatcacaggtcaaagtaccccggctttaacttctggttcagagaatcctaacaactgacattgtcaccagcaaggtcttcgactacctgaccaactctcaccttaaagcaattctcatctgacattagctgctcagctttccgctgatacgttgactccaggaggctccttgagttctgtgtgttcagctggcctccggtggccccattattattttctgccaggtaaaggtcagtcacctgcacacagatctcatcactcacgatatgctgcagctggaagcaaacaaaggcaagcttttagtgaacacagaaaacatttctccattatacagtcaacgttcctttgatgtagtcattcaactccaaaaaggtttttctttttttgggggggtgggggggtgctggcaattttagaaaattaatcacacaaaccactgtatcattttcttggagaataatcaagccaggattttcaaccatatcagtggtccatggtaaaactttcctatctatttaaaataagaaccatagagaactcaggataatcgtactatttaaaattctaagcatctttaaataattttctataggtcatatctttattgcattttaaaatcatttacaattggctctcatacatattctttctcatttgatcttcacaactgccctgggaaggcaagctagacagagagttggggccagttaggagacaaatttacacaatgcatcagaaaggtggctcacgcctgtaatcccagcactttgggaggccgaggtgggccaatcacctgaggtcaggtgttcaaaaccagcctggctaacatggcgaaaccccatctctactaaaaatacacaaatagccgggcgtggtggcaggagcctgtaatcccagctacttgggaggctggggcaggagaatcgcttgaacctgggagatggaggttgcagtgagccgagactgcaccactgcaaagctcaccgtgagctggggtgaggaagggagccttggagaatcatgaatgcagtatctatgtctatattcccaggccaactacaaagcctgaaactcattaagtatttaagaaatagctgctgaattattgcccaggggtgctcagctgaagaaggagggttgggactaaaagtcaaggttcctgactcctagcccaatacttttccaaacacatcacctatttttctgtatctgatagaaagtatagggcttaagttgtacataaagttaactcactttccatacaggccaatcatgattgactatcagtagcttttgtgacaatcttaggaaactaatgactagaaagttgaacgtttcagagttcccattctcatgtcatgctatttctattttgaaataaaaatccttccaaatgaaactttatcatcaaaatgacagaagtgaaaaatagatacaagaagaaagcaaaacgttaatttcaatattgatttgtctgtttaaaaaactttaagatgatcataaccaccaagccattctatttttaggaagacacattctttttaagtgttaggaaccatgataactatttattcttaagtcctaaatgaccagtatgtgtattagtagataactggacacagtgaaaggtcagaacggtgactgagtgtggcagaaagggcagtatctccagcaactacagatggataaataaatcacaatgagtccagataaaggattctgatacaaccattaaaataatgcttatgagtacctgatatcatgaggaagattaagatacagtgttttaggagaaaaaagaaaaggtggaaaaaaacagatggaaagcatgacttcaatcatacatacagatgcttccactttctactttctttttgagacagagtctcgctctgtcgcccaggctggagtgcagtggcatcgtgatcttggctcagtgcagcctcaacttcctgggctcaagcaaccctcccatacctcagcctcttaagtagctgggtctacaggcatgtgccaccacgcccagctaacttttttgtattttcagaagagacggggttttgccatgttgcccagtctgatctcaaacttctgagctcaagtgatccacccgccttggcctcccaaactgctgggattacaggcgtgagccaccgcctctactttatactttcttgttgaagtagactgtattactgattccccacccatactctctttttggatatctggcccctcctcgagtcttcagaaaagacagcactacaaatccagagacagctacggaactcccacccccactgctaagcagatcagattctctatcttgctaattggagatgacagagagggtgttcaatagattttttgaggaggagcatctgtatggaaaggtctagtaacactgggaccaggggtactgggagggcaagccaaagcctcagaggctggaggagcctggagcacatgccgtatgttcatctgcagagcaaagcacaagcatggagcagaagtccagagtgaaggcatgcaggagagaaaaatcacctcccagcccaatccttccatggtgtggtcctattttgagttctgtacttggatgtctgtgaggttgcctattgtattcttaatacaaatccctcttaagccagcctacaataggtaagataaatgtaatggcttcacttggctggaatgcagtggtgcaatcacggctcactgcagcctcaacttcctgggttcagatgatcctcccaccttagcctcctgagtagctgggactacaggcatgtgccaccatgcccagctaattttttgtatttttaatacaaatagtgtttccccatgttgcccaggctggtctccaactcctggactcaatatatctgcccgccttggactcccaaagtgctggtattagaggcatgagccaccatgaccagccttgactttgaaatatatgttgtacattcagtcagcagtggaatctgagggaacaccaaatatgaggagaatgagagaagagatacctccagttaaaggagttgagaagcttgaaaatgttttaaaaagtcactgtaggctgggcacagtggctcatgcccgtaatcgcagcgctttgggaggctgaagtaggtgaattgcttgagcccataagtttgaggccagcctggacaacatggcaaaactccatctctacaaaaaatacaataaattagccggtgtggtggcccctttggtcccagctacttgggaggctgaggtaggaggtcaaggctacagtgagctgatcacaccactgcactccagcctgggcaatagagtgagaccctgggttggaaaaaaaaaaaaaaaaaaagtcactgttttggggttttctggatgaaacctgtttccattaaaaaaaaaaaaaaaaagcggggggtgggtggagatagtatttattactgattcaaaatcataaccagatacagtaaataattgtaactattgtttcgaaaaccaacctcagaattattaaaagttagttttattggattttttttttaagctgtgctggtggtatgaaagacttcgttcctagctgaagcagcagcaagcctgtaatcagcaacataagcacagggtaactggagtctgtattttatataaatttcagggaagttaaggaagattagtctgaaaaagtatgactatgggtgactatgtatccatctaatgatttctgccagttaccatccagacctcttatgggaaggcctaacaacttcttcaacttattggaaacaactatctgacaactttcccccagatgttaaggttcatttatatgaagggctcttcctcaatcctgtgtagatactgtgggaggagtacagaggcatgcacccttccaaaaccaaggcaaaagcatgggtactttgcaaagaattcaatattttagcccaagagaacattaagcaacaagctctttccttctacagtggcagtgtggattctagaattagaaattgctttttacaagttttcacttaagtacttcaccgcctttctgctgagctattctatggaagagggctgtaggtagccacggtacccaggtggaacagcatgatcctaaagccctacttccacaaggaatcgcagtggcccatggccacgtggttcaaccagccagcccagaagatctgcagatgcaagcaaaagtataccacattgacctgcaccctgcatctggacccatctgacccatggtaagctgccccacagtgaggtaccacaccaaagtacaagctggcaggggcttcagcttagaagagttaagggtgaccagcatccacaagagggtggcattagtacaccatgtccctgtgggccaatgttcagcacctgaaggagttaagactccaagctcaacctcttctccaggaagctcttagcccccaagaagggagacagttctgaaaaactcaaatcagccacccagctgacaggaccaataatgcccatatagtacgtctataagaaggagaaagctggaatcatcactaagaactttaaggtatttgccagtcttcacacagcccacatcaattttcagctctttggcatatgggcaaaaagggccaagggagccacagaacaggatgctgaaaaggaaaaatgaagccctgctggggacttgcagtcaatcagcagtagagctgggtctccagaaaaagaaaaaagcagttaaccaacaatctctctgggagttcagaactcaagtccaagaagtagaaatgtgactatctgttacaagctattttttatatcattgttgtaaagaacaacatgtttacaagttcccagggtgccacaggaagaacacacaaaaccaaccagaaacctaacttagagggaaccgcagatgagtgaggtgggcagagtattataaaagatgttatgtgaaccctttcttataaaaagaatttcaaatattaaacaatgcaagtacataagagttaccaacaccttgaccaggcgcagtggctcgtgtctataatcccagcgctttaagaggccaagacaggaggatcacttgagaccagaagttcaagaccagcctgggcaaaacagtgacaccctgtctctatttaaggaaaaaaaaaaaaaacttaccaacacctatggaagacgcaatgttccacactgtgtgcttacccatggcagacaaggtaagagatagacaagttgtgcaggaagctggggtcaggaccactgcactctacaggtggccagcaagaaaggatatggggtaggcaggctcatacactgcaactttgttaacatgagaaatcaggcatcacattaacctcccctcctctcttcagaaccctacgttcataaacactgttatatgaaaaagttgcctttccttttccttgcgtggcccatctctaggtaaggatttcttcccttactcaccctagcctcctccatgccctcacctgtctgacaatgctctggatcagtttgtccatggtaaaggcaatgtaggcatgaatggtgaacatctctctcagtgaatcttcatactgtgatgagtctatgttgccatccagcaggctccgcaccatgtccaggaaagctgggtaataatcttctacatcaacatccactgtgggagagatgggattggtgaggccttaccttgctaagaaaagactagggatagagtacagggcaaatcccacagctggcctaaatggcatttgaaagtatgaacactaggtattcaaaatatactcactcattccaatgtaaacagagatgaattccgacaggtgactacaatcaccagcactatcagagtgactctgcaactttaacagtggcttctaatattctgactaccatgctagaaagatacttctttatggtactgctgggccactttcagagaggaaaatatcctagggaagccagtccttcaaagagctgttggctcccctgctgagagaggaacctactctcccagcctgcacaagagcattcctcacatgggtcacttgctcataaagctatttcaatgaagcataaagtacagatgaggaaaggcagacacagccatactccagcactgggaaacctcttgggaacacaaaaataggagtgcaaattaaatcctttatgaataatgaagtaatctgcatttgtcaaagtccttttgtttaaaaatggattcgctacgttgtatttcacaaattgcattaaatcatctgtagttgctgcacatgaatcatttcaatcactagctagaataaatctcatcagttgttaaagacatttggcaactagcagagggcacaaggagtattaaagagtgctgcctttagcttactaaagacccatttatataaagttcaaaaatagacaaatctaatctctagtgttagaaatcaacaaagtggaaaaaggactggttatcagagtactggttatgtttcgtttcttgaacataggtacgtctagtctgtaaaaattcactgagctgcacaattctgatttgtatacttttctatatatacatgccgtaccttatatgtatttttttgtagagatggggtctcacttattaaccaggctggtctcaaactcctggcctcaagtgatcctcccacatcggcctcccaaagtgctgggattacaggtgtaagccactgcacccggcctatacattgcacttcaacaaaaagttgactaaaatgaaaaaagttacaaaacgaactatttgtcactgactaattggttacttgctagttgtgtttgtgctggagaaaaaaggctaggagcaaaaccaagttgtctccatttatctgaagtctgacgaattcattaaaaaacaggcaaaacaggacaaatactgtttaaaagaggcaactggcttgagtttcatcacagactatcacattctttagctccatagaataggtataggctatagactccaaaatataccactgctatgaaaactgcttttatgccagaataaagttttgagtccaaaccacagatttgtccaaacaagctgtggtaagtgtgagggttggcattatcagacaagacaacattatgtaagcctcaaaccaggttaagtcagtggccaagccaggaataggccatttaatttctaatttctacccaagtagatggaatcaccacaatgagatctaaaatttatctctttcgagctaggactagtctagataaaagctttcagaattatttttcagtgtcattagctcctcaacagatagaaagctagggccatatctgggcttcctacatcagcaacacataaaaaaaaaaaaaaagaagaagaagatacactcctcaggttggctatttccttaagagcccagaagaaatgcttcatgaaaaagcttttggctcacagctcaagtacctaatttatgacgtgaactggaagcaggcagcacaaaattacataaagcacatgacagcgtcctgaaccctcacttactttccttttcctgagttctacatctttatccctgtcctgcctgttctccatgtctcatatcaccttttgagttccagtctcctttccataaactatttctacatattaagaatgagccataaaccccactggttaaacagaagtcctgctcaaaaatatgagaaaattctgttttaagcactaggaatttatgttctgtcatggattgaaattggctgtgacagtttagtctctatctgtactttgaaacagatggcagtaacccagaaatctgccatttgagaaattaactgtgatacccccttcccaggtgcgtccacagtaccaaccactgaccaagtgtccatgatctaagccctgcataggatactttgcacaaagcaacaccacaagcaactagagcctccatttttcagataaacaggttcagagagtttaactacacagactctaatgcctgtgctctattaataaaagaagcagtcccaagtctaggtggctctaaggtcctcaacctcacacatcctctgtaaatcagaggtctcggcactcactaggttctttgagacgtagctgaatggcagggctgtcactcttgtctcgctttatgcccagcacttcccgttcccattctctctctcggttttcttcttcaatttgccgttcggcttgggaacaaatccgtagcagcctcaggcagagaatctggtgcagtcgcataaaaatataccagttgttgttgacatagaagaggttgtatacttcatccattcctcttaatttttgagctgctgtgttactaaacagtaacttggacttagggggactgcccccaacaccattgtgcttcttaactgcccctgtggcttcatctacatccatctcttcttcttcctcttcctccacatctgagagatcacctctttgggcaaagagcaaatctggaataaaatgatgcatgatttgttttatcttatatttgtcctccttctgaatgcctgtctgcctcttcacatggtggataatcagagcagcagcatcttccagtatttgtttgtcttcatacgcaagtgagaggtgtgggccaacaggtacaccagcattctcctccgtagcctgctcttgcctctgatgggacagagacacaaaagtattctgtgagatgtctacagcgacaacatgtctacaagaccacatcagccatacatcccattatcaaccacagtgtctatatttttctaatcaaaaacttaggacctgggactgggagcggtggctcacgtctataatcccagcactttggtaggccgaggagggtgatcacttgaggtcaggagtttgagatcagcctggccaatatggtgaaaccccgcctctactaaaaataacaaaattagctgaacatggtggtaggtgcctgtaatcccagcccttgggatgctaaggcaagagaatcacttgaacccgtgaggcaaaggttgcagtgagccgagatcgtactactgcactccagcctgggcaacagagtgagactctgtctcaaaacaaaacttaggacctgactataacaataatttttgtccctcttccagaaacaaataggtaatgacagagacgtggtttgatgtcaaaatacaggtaccttctacacactgatgacttacagggagagtaggacagaattggaaccatctttctttcttttttttggcagggtcttgctctgtcacccaggctggagtgcagtggagcaatcttggctcattgtaacctccgtctcccgggttcaagccattcttatgcttcagcctcctgagtagctgggattaagaagtgcaccaccatgccaggctaattttgtatttttagtagagatgaggtttcaccatgtcggccaggctggtttcgaacttctggcctcaagttatctgtccacctcagcctcccaaagtgatgggattacaggcgtgagccactgtgcccagtgggactatctttcaaaattctggattagtatctatataaaggatatgatatgagatctgtgatttactttacttctggggtgggggtatggagggtgacaaagtaacatcagcaaaatatggaggattaagtttatttattttattgattttgagacggaatcttgctctgtcacccagactggagtgcagtggcatgttctcagctcactgcatcctccacctcccaggttcaagccattctcccacctcattctgccgagtagctgggactacaggtgcacaccaccacgcctggctaatttttgtatttttagtaaagacggggtttcgtcatgttggctgggctggtctctaactcctgacctcaggtgatctgcccgcctcagcctcccaaagtgctgggattacaggcatgagccactgtgcccggcctgattaagttcacataagagctcattttactatttttaaagttcaggatcaccccactccaggaattcccaattgcactgcatttatgtttctatccatctcctaaaactgagcccacggaaaccaggatttattgcttattcatctctgatcctagctcctagtactatttatagtcctggtaggcatgctgaataagcaaggattacaaagagtttggtggtcaatgacaaattttgaagctgtaagtaaggagagatgggactatatggatacaaggtattattgtttgaaggaaacaggtagtcggagaagtggaaaatggaggcaggaggtataagttgaaaccaggacagtaaactaggaaactagtcaaacagcttaggtataaaggtatagtttagatttaaaatggtagaatgaggaatagaaaaggctatgacagctatcaagcaagaatcaacaggtcttagagagtctcacctgcatttaacaaaggtaatttccagaaatcaaagctgtgctaaatatagactagagtcctctcacagatgcagaaaccccccgctcacctcatcatagatactctcaatctcattgagtaagctcttagacctcaggaccttggtgtcattctgtttaaagttgatcccctggtggtccagagacttcaagtagtatttctcattttgttctcgccatactttgttaaagcctctctgagcttctcgccattcttcctctttcatcttcaacctagtgaagcgggaagggatggaaacaacacatgggaattcagagggtttagaagaaagaaatttgccaggcttactttagttaaagaaaggtgcaaagctatattaggtctctcaaaattactggcaacttgggatgctatcaaaccagtcttgaactctgtttcatgagggaattactcatccaagacttactttgaggaaatgatttatctcaaagtcaaataatttacctagaatggttacttaaaaacagcattccagggaatatctttcaggtataagtattccttgaaaaaaagagttcttgtttctttgctataggactttgcaaaacgttcacaatgctaatagaaacacagaagtccaagacaagagaacttgcacagttatgttcctctggatacagtcaggaaagttctgatcagaactgattctaataacccagaagagaacagactaagacaaaaaaaagcactaaaactgaagaataacctgtatctcaaaagccagaagttaaatgctacaggcaagaagaagaaaccatcaatctgtgccagctcttgaggggaagatgagggagaagaaaccatcaatctgtgccagctcttgaggggaagatgagggaggacaaatcaaatctgggtatttgtgaactgtgcagcaaataagaattaatttttaccagatgatactgagagagaaccaagctcctaacaaaggattcacagtgtggtcaataatgacatggggctgggtgtggtgtggcttgtgcctgtaatgccagcactttggggaggccaaggcaggaggattgcttgagcccaggagttagaggccagcctgggaaatatagcaagacctcatctctattaaaaaaaataaaataaaaattagctgggtgtggtggcacattcctgtagtcccagctattcgggaggctgaggtgggaggatcacctgagcctgggaagttgaggctgcagtgagctgtgttcacactactgcactccagcctgggtgaaagagtgagatcttgtctcaaaacaaaacaaaacaaaaacaaacaaaccacaaagatgttaacaacagttagtcctgagtgtggcaggaacatgggtggtaattatcttcttttcttttctgtattttaaaatactcccccaaacatacacacagagccttccaccatgaacttacaagatttgttctctaatgttggttacacaggacccccaaaagaagttccattctgcacctgaattccaacaaccagggttggggagaaagagaggtctcatgggacaaccaggttgaaaatgagagccttatttaatgagacactgaaccggtagtgaagtacactaaagcactaagggcacatttgctcatgtaccttttaaggacaattggaacagcaatggagggattctttctcagaccatcaatgatgtcagctgctttatcagcatatatcctctggagtgcttttctatggatgacttctgatgtgcccccaagggtgttgtccaagcgaaatttggcttgttcttcagcagacaagcgggaaagcttcttctgtattgcttccagaacccggattgttgccagattggtctctaaaactacatcaagctgaagaggaagacaaagaagggtatgctcaggacccaaatcaaaatagaatagagtagtgtttagaagaataaggtagggagtcaaactccttggatttgaatcctggttctgccctactagctacataagactgtttctttatcagcaaaatagggataacagcacctattactctcacaaccctgtgtctggattaaatgatacaatccacataaagtatttagcacaatacctggcacataagaaccacaggatgaagttggataaatggtagttattaccaccaccgtcgctgctgccgccaccaccaccgtgtgctttgcttaggactactgattttagaccagaggaaccaaacaggagatgactttactgaaacgtttccctgaactttcctgaattgctaagatccattatgaacaaacaataacaatcaaaacaatcccaaaagaccgctttgtcttgagagttttttggtttaacttgaaatatttaaatatattcaaatacttaaatattcaatagccttgttccacatccagtaataataagagcagtgactatcataacttaaggagttcactgttgtagctgcgggtaaccatttaaattcttattggactcctggcaacctttgagtctactttttccctagcttaaaataaggttctctaaatgagaaacagaaaatgaagtaaatgagcagtctcaacggtctacaaccaactgtttgcagaagtgttccctaagttttcttgttttgggaatgtggtagtcatttggtcaatatttctggcccctcttgctctccaattatgaacaaaaaatggactaaacttcctggctcccttatgattggatagggccatgtaactagttttgaccaatgagttgttatgagatgagtagaagtaatgtttattacttctaggctgcagcatttaaaggtgtgagatcattccaagctctcttttcctcctagtgactagcaacattcataatggcagcaatcccttggcctgaatccccaagtaattctgatatgccaaatcccctgctaaacatcaatgtacatgtagaatgattagaaattaaacccattggttttacaagtcactcagatgtgggagttgtctgtactgaggcattactaacctatcttgattggtaacgcacattccttcaaactagctcatcccaccaaatcttaaacacatgcacaccccacttctttcatgtttgcccttgtagtcacaaatgggaaatgaagttgcctctcatttggaggcataccagctgagagaggataggaacactctgtcaaaaacaaatgccaagctctgctaaactcatcagttaaccttactaaacgtaagtaacaaagaaatgccttctttagcttgataacactccctatggaagttaacatctgtcttgatttagctttctgcaaataggtgcaactccttataaatgctggggcaaagatggccaaccacctgccagtggccaggcagcatgtggttctcaattaaaaacacaccagaaactgctgaaccaagtgtgaggcgggaaaactggcaaagagctaaaagagtaccaaaacaaacaaacaaacaaacaaaaaccagcaagatacctatccacacaagtaagcacagccagtcaatttaatgtaacagatacactaaataggatacgtatcattttacatctttagacaaaccagacttccctttttaaaaatgataatgtaaaccagacatataaacacactgaggattgagcccactttcagtagtccctctcctgatataggtggtatggggccttctaccacctcatttattcactccactcttcccttcctaattacttcaaaataaagctcctgggacaggcgcagtggctcacacttgtaatcccagcactttggaaggccaagacgggtgggtcacttgaggtcaggagttcaagaccagcctggtcaacatggtgaaacccatctccactaaaaatacaaaaaaaattagccgggtgtagcggcatacacctgtagtcccagatacttgggaggctgaggcaggataatggcttaaactcgtgaggcagaggttgcagtgagccgagatcacaccactgcactccagcctggttgacagagcaatactctgtctttaaaaagaaaggggtccctaatttagccttctttcaaaaggagccaatcaggccaggtatggtggctcatgtgtgtaatcccagcactttgggaggccagggtgggatgatcgcttggacccaagagtttgagaccagcctgggtaatgtagtaaaacactgtttctataaaaaacaaaaaattagccacagggggtaggaggcaaggggagggagagcattaggacaaatacctaatgcatgtggggcttaaaacctagatgatgagttgataggtgcagcaaaccaccaaagcacatgtatatctatgtaacaaacctgcacgttctgcacatgtatcccagaatttaaagtttaaaaaaaaaaaaaaaaaatttacccaggcatggtagcacatgcctgtagtcccagccactcggtggcgggtaggggtgggggtctgaggtgggaggatcacacttgagtctggaaggttgaggctgcaatgaactgtgattgtgccactgcactgcagcctgggcaatagaatgagaccctgtctcaaaaaaacaaaacaaaacaaagcaatcagctgggcgcagtggctcacacctgtaatcctagcactttgggaggccgagacgggtggatcacgaggtcaggagatcgagaccatcctggctaacacggtgaaactccgtctctaataaaaatacaaaaaattagccggacgtgttggcgggcgcctgtagtcccagctactcgggaggctgaggcaggagaatggcatgaacctgggaggcagagcttgcagtgagccgagattgcgccactgcactccagcctgggagacagagcgagactccgtctcaaaaaaacaaaacaaaacaaacaaacaaacaaacaaaaaacaacaaagcaatcaataccagaaacatgaaagaaaaatgccagttctcagagctggtttgctaaccatggcaagatacttgctaagggtaacaatacacacagatcttaaataatttaaaaacagcttcaagaaagtactataaaccttaggatactgattttcttcaccatgcaaaacataataatcttaaaatgccatgcaaaatcaaaagaactattatttagtcatcaatggacaatttcagttaaaagggctaaagtggcctagataagtcacatttgccataaagcatgtactaatatatacatttgaccaatgcataaagcatggaaagtaccacaacaagcacttaccatagaagaatgtgagcctttggctcttccatcttaataaccctcagagacaggtactgatagtctcactgagcatctcccatttcccccaacttcaaatgccaaacaagcttgtacctcaaagcgttcatcttcacaacgataaatatgttcttcatattgagtcttcttggaactcacaaaggtagagtcctcagaccacgaagggaaggaaacccaggtatcatttaaaacctttgggtagaagaagagagactgaaacaaaagcctaaaaaagctttctggtgattaagcattctgaatgaaaagacaaaactctagcagagaaataggcaactaatattacttcacaaatttcacctttagcaagtttacaaaaagctattagtaagaaaagggtgctgaatataagcggaaatataattccagtgctttgggaggacgaagcaggaagatcacctgagcccaggaggagtgacccaatctttacaaaactaaaaacttttatttttatatttttagctgggtgtgaaggcatgtgtaagtcccaggtacttgggaggatcatttgagcccaggaggttgaggcactatgagccgtgatcacatcactgcactacagcctgggtgacaaaacgaaaccctgtctcaaaaacaaacaaaaaagtagaaaacattttctttttaaaaaggattaaaagggttcttaatttcatcattcatataaattctcaatccttggtaccaccactcccttctggaaaaagctgaggacccagggctgatctttgctagggaaggccttacctctttacagagaggagtccgtcctgtacacttgggctgctggtaactctttggtaaggctcgatagctggagcccaatcgtttacaagaagcataatctatctccatagcaatgccctctgtggctcgctcctttggataagtttccagatgtacagactccttatagcccagaaagtttttaaaccaattaaacaactcagggaatttcctgaagaatcaaaccaaaaagtgacaagcaattaggggcaggatgcagttatcctgaggtatgactactaccatctggttttggatcagaaatctgctaccagggatgaattatttcctgcctaagaagaactgcttctgagcatttggtttcccctttttctaataaaatactctcagatcagttaaagtggtgatcaaagagttgtaccgaaaccaggcaaaataacaagccattcttttgatcaagaatattgctttaatgttcacataattcttaggttgtcaaatatagtaaagattccagactcggtgtagtggctcatgcctgtaatcccagcactttgggaggccgaggcaggtggattacctgaggtcaggagttctggaccagcctggccaacatggtaaaacaccgtctctactaaaaaacataacaaaaattagccgggcgtgtggtgacaggcacctgtaatcccagctacttggggggccgaggcaggagaatcacctgaacccaggaggcggaggttgcagtgagccaagatcatgccatcacactccagcctggggaacaagagtgagacttcatctcaaaaaaaaaataataataataatttttaaaaaaattccagaactctgggagagatttttcttgataaacatccagcactggttagaagatcaggagaccactagtcttggccattagtcgataaatacttaatgccctctctattttctcatctctagagctggactagaagacttctcaggactcttctggcactaacatttgagtcaactgatgtatctcaagtaaattaactttgcctatcatatactctcacaaatcaaacattacctggtctccatatcatgcatcagggctaagcccctcacttcacttaccccaggaaaggagagactagttgcacaagctcagcacgagagatcacctcctggttaaaaataacaagacagcgtaggaaattttcgtaggcttctgcactccgaagagcctttcggaccttatggagacaacgggaagaaaaacagtttttgtttttcttaaagtggggaactgaaaagggcctcgctctgtcgcccaggaggaggcgcagttgtgtaatctcagctcactgcagcctcccatcctcagcctcccaagtagctgggactacaggtgtgagccaccatgcctggctaatttctaaattttttgcagagacgaggtcatatattgcccagctgccctgccattagtttttaaaaactggggaaatttgtggctgggcgtggtggctcatgcctataatcccagcactttgggaggccaaggtgggtggatcactggaggccaggacttcgagcccagactggccaacatgctgaaaccccgtctctactaaaaatacaaaaattagccaggcatggtggcacacgcctgtaattccagctacttgggtggctgagtgaaacataagattatcacttgaaccctggaggcagacgttgcagtgagctgggataatgccactgtactccagcctgggtgacagagcaagactctgtctcataagtaaaaaaataaaataaaaacggggaaatttaaactgatatttgatgacactaaggaatcaacgttagtgtttttagatgtgataatgattatgtttgcaataaggagtttttttgttttgttttgttttttaaacgcagtccagcactgttgcccaggctgaagtgcagtggtgcgatctcagctcactgcaacctctgcctcctgggttcaagcaattctcctgcctcagcctcccaagtaggtgggattacaggcatgtgctactacacccggataatttttctatttttagtagagacgaggtttcaccgtattggctaggctagtctcaaactcctgaccacaagtgatccacccgccttggcctcccaaagtgctgggattacaggcgtttgagccactgtacccagccacaaaaaggagtcatttttaaaagaaacttactaaaatatgtatggatgaaataaggtatctgcgatttgtctccaaataaactgggatgggtgggaatatatatgaaacaagtaactggctagaattgggaaccgctaaagctggatggtaggtacgtgaggaatcattttactattctgtttatgtatgttcaaaattttccagctgggcgcagtggctcacgcctgtagtcccagcactttgggaggccgaggtgggtggatcacctgagatcgggagtttgagaccagcctggccaacatagtgaaaccccattctactaaagaaaaaaatacaaaaaaattagctaggcgtggtggtgggcacctgtagtcccagtgactcaggaggctgaggcaggagaatcgcttgaacccaggaggcagaggttgcagtgagccaagatcacgccactgtactccagcttgggcaataagagcgaaactccgtctcaaaaaaaaaataccataataacaatttaaaaactgagatctcggagtataccttctcatatgcttgattctccacaccatatcagagttactcaggtttttgttgcctctttttcttttttttttttgagaccgagtttcactattgttgtcctggctggagtgcaatggcgcgatctcagctcactgcaacctctgcctcccgggttcaagcgattctcctgcctcggcctcccgagtagctgggattataggcacctgccacaacgcccagctaatgttttttttgtatttttagtagagacggggtttcaccatgttggccaggctggtcttgaactcctgacttcaggtgatccacccacctcggcctctcaaagtgctgggattacaggcgtgagccactgcgtccggcctgttgcctctcttaacatgtttacagcaagaatctttgccaaggctgttttaaactctggtaatctggaataacgctctcttaagatagttctgtcctctgatctggtcttttttcttcctctatttacaatattgagcatcttaataccaaaaacccaaaaatgatcaatggcatagacaaagtaaaactagtctagctagattaccaatctggagtttcagttccaaaataagtatttagcactgtgatcctttggtgaagaccacagactgccaccaaaccaagtggcttatcagcaacccctgctccagacttccgtatgcttttcttaactattcatcagtagacactatatagaatctagacttttaaagctaaagataaaagaacactgtaccttttatactgtataccctatttacctttactttttattagcttttaaacatacacaaaagtagacagaagtataacgaacctatgtactcaccccaacctcaatgatctatagtaaattttgtttcatctatacttacttctcctaccactgcattttaaagcaaattccagacatttcatctagatatagtatatatgtttaagaaaaagtactaagaaaatgccattacaggactgggtgcagtggctcacgcttgtaatcccaacactttgggaggccaaggcaggcggatcacctgaggtcaggagttcgagacagcctggccaacatagtgaaaccctgtctctactaaacatacaaaaattagctgggtgtggtggtgggcgcctgtaatcccagctactcgggaggctgaggcaggaggattgcgtgaacccgggaggtggaggttacagtgagcccagatcacaccattgtaccccagcctcagcaatggagtgagactgtcccagaaaaaaaataaaaaaaaaacaaaaaaacaaaaacaaaaacaaaaaacccattactcttagaaattaacttattttcagaagactccttaaggcaaggcatggtggctcacacctgtaatctcaacactttggaaggcaaatgctgaggccgaaggaggaggattgcctgagcccaggagtctgagaccagccagggcaaaacattgagaccccctctctccaaaaaaattttaaaaattagctgagtgtggtggtctgtacctgcaagtcccagctactcaggagggtaagaaggatcacttgagcccatctcttaaataaaaaaggccaggtgtggtggctcacacctgtaatcccagcactttgggaggcgaaggagggctgatcacccgaggtcaggagttcaagaccagcctggccaacacagtgaaacctcatctctactaaaaatataaacattagccaggcgttgtggcggggcctgtaatcctagctactcaggaggctgaggcaggagaatcgcttgaacccaggagatggaggttgcactgagccaagatcacaccacttcactccagcctgggcaacaagagcgagactctgtctaaaaaaaaaaaaaaacccaaaaatgtaaaaaagattccttaatagcatctaatattgagtccgtgtcaagttcaattgtctaattaatgtcttaaaaattggctattggccaggtgtggtggctcacacctgtaatcccagcattttgggaggctgaggtggatcacctgaagccaggagttcaagaccagcctggccaacatggtgaaaccctgtctctactaaaaatgaaaaaattagctgggcacggtagtaggcgcctgtagtcccagctgtttgggaggctaaggctggagaatcgcttgagccagggaggcggaggttgcagtgagccaagattgcgccattgcactccaagctgggcaacagagtgaggctctgtctcaaaaataaaaataaaaataaaaataaatcagcttttaaattcagaatccaaagtctgcatgtcacatttggcttatatatttcttaattcttaatttataatagcttcccttccatacccttttcttgacatttattggttgtgatctagacttccacacttgtctaagagcaccaaccgcccaagcagactttggtaatgattcacatcagagctaaggactcaacactcttgcaggactctcctgcaaaaagctcacataggcacagcagacagaaagggatcaggagatactaatcacggagatgttaaatcatctgcccttctgcaaaacccaagaggcagaaaatagagtcaatcaccacagatcaatccaggttgattcctaccagtgagaagcccaacaggtgccagctaccctgatgaaagtttcctgctaatcatcaagttgactccgaggagcaaatcacacttaagtttatgtggccaaactaaggcaccacacaacatcatttatgccaataatctcaactctcgttgctcattagaatcagctgggtagctttgaaaacatgcaagtaaattagaattcccctgaatgctatgtatgtgtgtactacaaataactatcacagcaataagattacaagtcatcggccaggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggtgggcgcctgtagtcctagctactcgggaggctgaggcaggagaatggcgtgaaccccaggaggcggagcctgcagtgagccgagattgcgccactgcactccagcctgggcgacagcgagactccgtctcaaaaaaaaaaagattacaagtcatcttaaatcctcaaaaattggtacaggcactggtactgcctgccacacagacctggatatctacaatgggagctccaaacatctttcaagagaaacataatacattttctaaaaatctgtcttctgccccaaactgcttcataaaaccaaagcaaacaatgctaccatttttctagctatgctaatagtactagcagactcaaaggactcacaactgggaaactatgttaaaaaacagaaagtcctaattagcctgacacctttaaaacgaaaccttccagggggataagatgattttcttttggcattaacaggcactatcaaatctaactcatccattactcaccttatcaaaaaataacgattctgttccaccaccatgtttgctggcatctgccatagaagaatccttcagattgagcagtttgggtttcttctgcaaaagaaagatacaaacatgtgagattcaacgagtggttttctctgaattttatttttgtctgtattcaatg

SEQ ID NO: 319 - DNA, 49341 bp, Homo sapiens
cccctccctccccgcccctcggctgccgcagcccggctcgcagcgcgcgtcagcgggggctccccggagcgagtcgctaggtaacggggctggctccgcagacgcggggccggggaagcccgcgcgcgtcatcagcagcggcgccgcggggcggggggcgcagagaccctccccaatcccggcctgccaccacctggctcgcgcgcagccccggcccagaatgccttaacctgcgccgattgctgccgccgaggtgcccctcccctgtagggaccccgacgccgccagccccttcctcctttcccgcaggtgcgcactgctgtgcttgcggccgggtgggcgccccgccgctgcggtcgcggtcgccgctggtaagctgcgctctggggcttggggcaggaagcagtggggggcgctcgaagagcagggcagctacggccaccgtggccgccggaccggccatgtgctaaagtttctggggctcggcgccccgctgggcgcgcagcgcggggagcagacgcgccgtgggtggggcagcgcggtgctgctggcgcccggcccccgcggggtgcagctctgcgcgttctcatgctgtctctctctctttccctccgcgctgcctctccgaggtcctcccgccgagccccggcgcggggcatgaggagcccccgggtgccgcccagagaccagcaggctgcgcgcacacctagccagcggcagacggggacatgagcagcgcgcacggggtcccgcgcccggcggccagccctatccggcggcggccagcgggtcaacgctgcccgggagaatgaggcaggagccggcggcagcctcctttttttccttctcctcgccttcctgcggctccggcgctccgggtccgggccgggctgcggctctgctgcgtgccccgcgcgcccctcaaccgcctccggatgcgcttctcggtaagccaggccctccgcctcgcgaacaaagctcccttcgcagggcccggaggccgcctcagggcccctgtcctaccctccttccccacttacagcctggaaacattcggggcttccgattgaatcgttcaatttcccctgccccgaagccccgcctggaggctgaactgcccgggcagacctggtgctttcttctgccttctggagaaagatgtgggtttgacatgcaggcgggagacctgtctggtctagataacggcatgtgtatgcagctaggttcagacttagcatttgggggcaacaactcttatttagtgggtgtccaggccgtgccgggcagtgtgcctcaaagccgctctgggaaataggtccccgtttctccttggcccagatgaggaaactgaggcttagagaggttgaatgacttaatcaaggtcacaaggttaggaagtgggagaccaggattggaaaccagggtaccctacttccctgccagactgttccctttgtaacaaacacacctgtctcatttcttctactaactgcttccgtctcgagagtcattgcgtgtgtgtgaaaatacttgctccaatgagtatctgttctgatgaaataaattgcctgtagcaagcactttttgtccatcctgccatcacgctgctgccaacccctaatgtgtactctactttttagttcaggtgagaggataatatgttttcctaggtgttctctttcctggggttctgttttcccagtcctcctgaaggatggaaaggacagtggttcctcctgtgtgcccagcacatgctaggcctcagaactgcatccttaacctttccctgggggcagggctcatcaaggttacctgcccctggttttgtaaatcttggagatgattacttaaccggagcgggggctgatcccagatggccactgtgcaggggctggcccagtgttggctcatatttgccagccctcagtgtcagcagaacttctgagccccaaacacttctgagccccaaagaaaaggagttttaatgcagatacgatgcctgatgcatgcccccagttctctggcttgccgctgttagctgtttgcttaagtgcatttagttaactgtttgcttaagtgcatttagttaactgtttgcttaagtgcatttagttcctgaaggggcaagccacctggaatcaattgatcctggtctgaggggcttgttccattggtgaagtcacagtgttgagctcagttgtctacacgtacatttgtgttggtgcagagaaagtcccttagcagtaggggcctctgtgtctctgttagtaaagagcaagggtggactgaccagcccttcagacccccttcagctaaatgattctgagtgacaaaactagtaagttacaggcttgagctaggatgtcttagtccagtcatttggacgaacattctacactgaatgggttgttgatttccaagaagaggacttggtttccagggagctgtgagattcaggttcagcccaaaagaggtgaagctcgagctgtgcttaatagattatttactgggctaacacatagtggctataaaatgttccaagctaccagattggggttgtgggataggttaggcctttcagtaggagagatgacattagctcctaagaactgatgacatacaatgcattaagaagatgcccagcaggctagaaagcagcaagctggtgagcttttcctgcccctccaaaaataatcaatcatatttgcataggtaaaacattcccagcacaaacaattactgcaaataaataaagtgattttttttttagactcttccaactgcattgtttgctgagtatattagcgatgcgtggagccggccttagcttggctgcagaggggctgggacagggaaggtgggctgaaggatgttcagaccctgagttagtttttggctgtggattagagctaaatccatcactttgacctatgggtcgttaatggggttgtcattggtctttttaagatgtggattaatgaacctcttaaagtgttgccgaatcccaaatgaaacgggcatgtcccacctttttcccagaaactcggctctcagcgggttttgtgactgtttgaaattcacaaaaccagagcaaagctttcatttttgacaggctcatagggatctgcaaaggaaaaataatgcatcttatgtagggatattaatctcccagcattgtgtgttttagcttctcatgattaactggtaaggttttgaataaaaatgaatgcagagaaacaatcttcattaagttgcttttgaaaatgctgaggtaattatgaaataacgatttttgtgtcatagatcatactactcatagccaaagctggattacatcacaaaacattactcttgttactgatatttattttttaattcattagttttctcatattttttgccttttttctccccgtgtgaaaataagccatcgagaataaattcttccttttcagtttttctttgtcttaaatccagtttttttttttctgtaagatctctaagctgaactcttccacaccatacatataatggcctcatgttaaaatatgttttaagtgccttggatttcttttgggagaacaagagggttatgtatcgtaagtaaataacagtgatgagacatttcccttgtttgcttactcttctaagtcagggcttgagaccatgccctcatgattgcagctgccacacttagcatcatggggacacagcctgagtgctgtggcatttctgcatcagtgaggatgcacacctggactgatcggagtgtgaggaaaacaacagcttccgtaggccaggaaacctggggtttattcccgactcagttgttcattggctttgtggccttgggcaaattatttccatttgctgggtctgggtttacatatatgcaatgggtgtgtacgtttgcatgtatatgtgtgtgtattggtaccagatattgccctccaaactctaagtttgaagaatcctcaaaatttgggtatagctggttattaatacctccagaatgctctgtactttaaggttacataacgttccaattagacattcctataaacaataagaaattggtgattatagaaaatatgctgtttattaccctaagtggagactccgtaccctgagtgtgtgaaggaggatggagctttgatccatcctgattatgccggcttccctatcagagtccccttgcacggtagaggctcagcacaaatctgagagcactagaatgagccatgaccctctctaggatccatgtggcagaagatgcaagaactattatgtaatttgggtcaatggggtaagaagactatgacattctatctgtgtagctttagggttcaggggacttggagattccgcctcaatctcaggctgttcctggaaggtaaggaaggggaagtatgtaatttgaaaatggagagtactttagttagagccttgaactcagctgaagctgggaaatggtgaggaagaagcttgtcagtttggcagtggtattttttgccaggttttgtgtgtaggcttcccttgtaacatctaaggaagtgtgttgtctgaggtcaggctccctggtgaagctgcagtcattttcagatagagagggcatgagaaaggaaccaccagcccttaaacactttgtccttgcaactctgcaaagtagacattgtgaaccctgtgttctagatgaggaacccaggctcagagagctgaagtgtctttcttagtctctaataattatcgaatggcagaaccatgcaatgttttaaatggactctgctggggtttaaatcaacccgtgctggacctcatttccactgctactgcagtgtgtctgtctggcaaccaaattgtgtccttcctccccaatttctagataaccatggcactaaaaaaagcatgcagatgatttgacgtaagtagcatacggaggtgattttgctgtcaataaacctctaaattcaccaggatttttgttaatgcattagatttcttttaactacacgaggtcaaacatgtcgatttccaaaaagattcctaaataagccaagtgtaaccctaacagggttagtgctggtgattctttgggaaaagctaaaagaattctcctgggtcccacattcatccccctggggttctgtgggaggtgaacacaaactgatgtatgcgacgtcagtctgaggagttgtcgctaggctgctcctcctgaaaaagggacacaataaaagttatgtaacagctttcaaaagaactgtttctcctcctccaggatgcccatgagttaatcctcccccaaacaacagactagagaaggtattcagaggaacacatgtaagaccttcacggttcacctacagctcttaggagtttctgggactcgggaggaaatgtaggtctcaaggaacttttcacgttatcgagtagagatgccgtcgtagctgatgttggggacggccttcggaaggtcacccatgtgagtatagctgctgctgttcttcgctgtaagtgtgcagagctggccaagcatccaccattcccaggaccagagattccagagtcctgttggtaacactcaatttacaaagagcaaaggaaaatccctgaaatactctgtcaccccattgcgtggctttacattctgctaacgatactcaggctgggtttcttcaccagcagttgaaaatgcttctgtctctgacgctggccttgcctgtgtcatgtgagtgacgtcttcaccaacagacccctccttccgtctcccttggatcactgagctgcttatatgccaaaagcttcaagtttgttgataggtgatgagaaaaattagacagaatgagttagaaagcttgactatgcttcatctacaatctttaaaataccacatctcagcagtcagcacaagtttttgatttggtaaatgaggaataacattgcgtgtcctcggtgcggcccatggaatctgcatcttctgcccccagactttgagagaacaggtgccccagggcttcagctctgggctagatttctaacatgtgtagttactaaaaagtagaaaatgcaagagtagctttgcagagtcaccagagaggataagataagaagacagagaagttcatggcctctgatacgtgattactgcgaacacttattcagggcatggtagtagaaatgatttcacacccgtttccagcaacgagaagcacaaaataaattcactaagaaatttagctgtgtttcttgttgtttttgtatgtggcttatgacaagtgcagatggcacttcatgtagttaaaaaccttcgccttcctaagtccttcgtggtggctaagagaggctaggctaaatgccttggcagacctgcatttttgaaacctgactcccaaggtcaggtggtggtcttggtgagggtcagtgtatttccaggtgcttctgtttcttaataatctatgatgagctgctgtatgtacctcatttagcatcaccaagcaaaagagcaaacagagaatgcccagggcatttttcccaacctgccacatttctccgcctctatctgctaatatggtctggggatcctgatccacttcttgattcttttaattcagaaaatggatgataatgacagtcattttttaaatgatcaatattgataagtcttatatttttaaataaagtgaatgcccctgagagcatcacgtgcaagtttaaaatgatttatgaatggatacagtatcctttaacttgttcagagggctttattgaatacttctaaaacagtacgtctattatcctttaatttgttcagagggctttattgaatacttctaaaacagtacgtccagttttgcagtgttcaagtctaaaggtagacgtgaaaaccacatcctgtgttcttcatctgaaaaggaggagtggaaaaatacacccgacttctaaaagggaatgttgagactgttcctctctgttttactgacaagataacattgcttcggtctgaaaattctctgtagatgcatcttctacagcagggctggttgtcctccagtctgctcgaggacatccctgtggcggttgagagtggctctgtccatctgtgcaggcatggagctgtctcctccacagagcatgcctctctctggtcccgtctggttactaggatccacccccccaacacacaccatcatcctttcctcagacagatgtcagggacaacagtttaacaaacagttatggagcactagctctggtccaggcactgctaggcattgaggctgcagtggtggacacagacagctgtagtgtgtcataggctgctactgtttcagtaggcctggggcgtcaccctctgccctttttaaggggtctgttcagaatctggaggatttagctgttgcatacttggaggcacgctggggctggtggggagagcccaggctgggaggcagggggccttctctctcctctcacctgggtgcctagggccaagccacccccccgccgccactctgacccttcactggtttcaagtgcaaagattgggtcactgcaggttttttccaagtgtgatccagggaccacttccatggaaacaccaggtgagcttattaaaatgcatatgggtggaccttgctgcagacttgccaaattagaactcctggggatgggggtgcccagaatctatatttttaacatgcttccaggtcgctctcaccttgagcacagtggtgttcaagaagcactggttctcctgggtgtcgaatcagtaatgcccctccctgctctaaaggactcagaatgtggcactcacccccatgctggccactcttcccaccttcacccaccgccgtgctgtccaagccaatcgactctctcttcaccacgcttcccgctcctcctcctctgtgcactacagtttgtttcccgtatggtagccagagtgagccttttaaaggatctcatttctccttggctgggagagcttcagtgccccctgtgcccaatagtcagggaccttaaggtgaccctcagggccctgcacgatctggccctccatctcacctcctctcccaccacctgcccccttgcttccctcttcatgtcacagccctagaacccacccagctgccaggcattcactccaaggagccacaggacctggggactggcaaggcagggtgccagccctggtaggtggggcacaaccctgtgaagctctgttttctgtcttgccactatgctgaaaacccctgcagactgacactcttaaacccacttgggcaaatctgtttctgggcctgcccaccaccatagtaaaagtaaatttagaagcagctctttaagtctaggcaccgtgttacagggtgactcatcatgggactgcattgtcaaagtggctctagaactttttttcgaggaagtttctggatatagactgcaaccctcttgggctggactattaactcagccacttttgatcccagggccctgtcatccctccttgtcttctttccacaagtattcacaagacacctgctacgtccaaacactgcggtccccacaatctgtgtctgcgtggttgtatctccgactgccgctcttgcttacagatgaaacaatgtggtctggaaagtatttctctggcctttttttttttccctcctactgagaaatagttgctctggcctgtgtatcaacagcagccctcttggggcctaggttaagcaaactgcactcgaaaggatcaatcccttggcaagtaggagggaaagatggaccatgttgtgagattaacctccaaggcgagctgagtgcgtaactggaagatctgtggggtctctcagatgggatgcgtgctcagcgcatggggccagggcttggttttctgaaagccagcctgcccagcagtgcaaatgagtgaaaaaggccaggaaaacttcagatgcttttgggtctgacattgcagatgccttaccttgaatcgtaaggagggaagcattttcacgctcagcatcaatcttctttgggatgctttctctggacatattgaccaagccttcactgagaggccattagcaaagtggggtggaggatgaaagtagagatgttccctgccttttatggtttcagagacagttggggaaaacgtgttacgtaactacctgtagctaattagagtgactgacgtgctctgagaaggcagagataggaaagatgggtttggccgggggagggtggaggcgtttgacttgagccctgagagacgagaaggaatttcctgagcagagttgagcgggaaaggccttctaggtaggagggcaagtgtgagcagaagcacagaggcctgtttattggggagagggtactgtgttataggtctgtagagtcaggctgaggctgcaaggcagggacaaggctgggtcactcctgcttagatgggagtgggtcttgaatgctagattaaggagggttccatgtcttacaggtgacagggaactgtgggaggggtttgactcaggatttgcattaaaaagatagctggtagccctgttcatgaccccctgtaccctctatattataggatagtgaagatgtgtaaaacgttcaagaagaaatactgtgtgggaatgagcatggttgtcccgggtgtaacctcaggcaccatttctctgattgcagtgtctctgcttgtctgtatctgttgtctgatcctctgggccctgctgcccagaccccaactccaccagccctgctggggctcggaaggaaagcaaggtagccgctggcttcagcaattgctgcccagccatcgtggactctagccaacaggaaatggagcgggcagtgtcccagcctgattcaccgagccatgggtctccctgtgcctctgcaaatgcattcaggctgctcctggcctaaaaacaatgctcccagacctacatccacagctgagagaatccagggcacacatttgcccgccagcttccctgagcttcccccagcagtgggctcagtgggtaggagagggggacatggtctggaatcaaggcgtgtgccactcagtgaccatttgctttgaaatcaatgtgctcagcagggccagtgacttttgcagagctggctggacaaagggaacatgaagaagggaagagtgtctcagggtcacgggtggttatactacccttgaacttcaccttcctattgctaaggaagagagagagacagaaaagcatgttccacaagccagtgggcaaattcttagctgttttctgtggagtctgggcctggcagagagccctcttcacgactggctgactgccagatggtgccaagggcacggcatcccgggcagtcagcctcctagtgaagattgccatcctctggagggttccctgccccaggacatgggcctgggaagggaatgcaattccaccctccatgggtcccatttacaggtcaacaaattgaggccaagagaagagaagtggaattgtggccgagtagcacatgaaatcactctggagtcggtcatgatccctgaggccggccaatgcccagtgcccattgctggcagcagtccacctggaaatggacagtttgtcctcacactgccttgctacccaccaggcatggaggatgtggctttctccttgttcatctgtcttccctcttggaacccaggcccagagccagggggctgggcatgacccctagatgtctggccttttgtttgcttcttggtttctgaagcttgtgtggaagttgaatgcaagcagagaaaggaatttagtagcaagttatcagagcagattagaatggttgtcaggatctgggcatggaaatcgatggggctgagttctctctttggagctctagggctcctgaaacgcaccatcaggtcctgggaaagcctttcatcctggttctcagagcacctagtgcacacttacgtacatacataagtttaagccaaaccatctcatgagatcatcatcgctggctccatctctttctttcaactgtctcttccctggatcctcagtacctggggtgaaccttgcttggcacctggaagtcactcctggcctgttagtgactggatgggggatgcagtgtgcaaagggacttgtgcagcggtcagtctggctgagcttttggggcagcctggtgctcctgactgtttctcaccttatcaagtaggttctcctaaatgcataagaagctgatgacagctctgctggctgacttcaaaacagtcaaaccttcagtgctttatcaggcagatctgtaagtacagttcctgctcataaaatgcatccgtcacagccccgtgcaacataaaggaattgtttgcaaactttcccaggttattacccccaaacttagtaaatatatgtattggataaataatcttgggaggtccataaattattgcagtttcggacagtactaatctacctgctggcacatttcataggtttcaccaccttattgactcacattttaatgaaagaggagagcaaagctataaaaactatcctcatgggttggggacccgaccagatgatggatgacaaagcagtgtagaaaatgtatgagttctgtgtggttattcagggtaattattattaagacattttgagcatctgacctcagttccttttgttttcctgggcaaggacctactacctcccagattctgctgcacttggctggcggcactctgtgcctacaatctcaccattggaatggcagttcttcaacaggattttgatggctgtcacagtcactttgggggacatgcaccttttatttgaagctgttcttcgagtcagattgtgaggcactggacagacctggattgaaatctgagcttatcctctaattccctgtgtgattcttggacaatttgcttcagcctttatgagtcctgttttctcttctgagaaatgggcataataacaacaattaatggtaatcccagctttgattaatatttgctgggtgcttactggggtagggaccctgtgcaataagtcctttccgtggactctttcactgaatgtgtacaatagcttgataaaggagttaattttattattcccattttacagatgaaaatactaagccttcgagtatgtattggtgcatacaaaaacacctcagataatggttttgaacatgaataatcatttattttgctcagctaggtggccttgctgcgggcctcatgtgaggttgcagtcagactgtgactggggctggaatcatctgggaggcttcctcactcgcatgtctggcccctgagtgagaaggggtgcacagcctgagggtgggagtggggaggctggcacagctgagactctccatcgctctgtggacgctccgtgtggctgggtagccatactgcctacctgtagtctagggctccattgacccaagagagagcaagaggttgtagtgcgtgggggtgtctgtctctatcctctttggtgatcgagcctcagaagtcacatagtatcacttccggcatgtccttagaagcaagtctctaaggccagcccatattcgaggggatggggggggcagttagactccatcctttgatgggaggagtgccgaaggatgccagtacgtttgaagccaccacggagtgcttaggtgacttacacaaggtagaccgttgcaaggcagcagagtggggtgtcggatcccgagcatggccgtcacccctctgcagtgtaaagtgtgaagcactacgggccccgtgaaacgggacctctgtaagcatgtgagctgtttccccttcagatgtcctttctgaagaaggaagcagagctgtgtgcgagtccagctgctgcttctcagcttcaaagaggcctttataccaacccttggggcagaccacctcccctcccctcccctgctgtccctggcctcccttcccttcacctggagccacattctcactttcttgggtcctgggcaattctgttttcatgggcctcttccaccataaaaagaaaaattaaaaattatttcttaggactgagctgatataaagatgaacatattaatgttacatattaaaagattttcttctacccagaagttcattgttttccttctgattttaaattggaacatttctgtgggccctgggcaccgtgcctgctgcatgtgaaggagaagttggcttgcccttccacctccacccctcaccccctcctctccctccccctcctcctcctccgcctccactattcactcttctgccctggccaccacttagcaggctgctgtcctctcctaggctgtgaactttcaggttctctgcaccctgggcaagccccgtgactgggagctgactgctccccgtaactctggctttcctgtctcctggtccttcaccaagggtagacctccctcgtgaggaggaacttaagcagagactcatcttccctgtaagcccacggagccgtcacccctgtctggcttctggctggtctctcatagcagagtaccggaagggcctcccttcctgtgcacctgcaggggtggtggcagtgcagagatggctgctctcctggctcctgcgtctgacaccccagccagcccatccatccgtgaatcctccactcaaccatttaggaaacagctttttactggtgagcatttcacgaggcctacctagtctccttcctcatggaatttagagggacacaaagacaaaaaaaaaaaaaaaaaactgacaaatgattctaagcaatgggagatttttttccccaaggggtggggtctcactgtgttgcccaggctggaaggcagtggctattcacaggcgcagtcactgcacactacacccttgaattcctaggctcaagcacttctccttttttagcttcccagcaatgggagatttttttttataagaaattggcatttcatggaaatcgaagcaagaagtgtagtctggcttcgtgaaggagaaatgaagccatcagcgaccaggatgttttccttcctctctgtctggagccccaggtctcaccatcttgtaccctttgtctctaaccttcctctccaacttcaggtttttcttctcgtcctctgagcatatggccaaacaatggtcaccccagtatggcagccccaaccctacatttgtgtggcctcaaagctcactccatctccccggggcctaatttcccaggagagaagtagagtggcctggcttggtgaggagccctctgctctaaacagctgtggctgggaggtggtgtcacatggtagggaaagctgtccctcgaggctgtcactgagacaggctccccaggtagggtgtgcaagaggggagagagaaatagcacgttcactacacctttgcctcaaaaccaattctggtttagggtggtggttgccagccttttgatgtccacagaagaggatatttgtttagttgagaaattggtataagattgcccaattttaatctgccctctctcatcagcatgtgataaataatttagaaaacaggaagaccttaatattagaatcgtgaaagtattttaaatttgttcattaatcaaattaatcaaatgtaattaaattaatcagagtattcttggttttcccatttcacccctgacagctgagactttggtcacagagctgaacgggtctgtgggcttacaccgggacccacagcactcggagtcctcagaaatcattgttaacaacaataatacaacccagacagcagcagaaagaatcgacccgtgtctggagcctgctgaagttggggggcagggaagcgacatgatctagtctgtgatttagaaagatagcccttcggccacgtggaggtcgaactaacattcgcaaattagaaatctgtgttggcaaacacttttaattagagcaaatgtttggcatatgcagacacactcaaagtgactgatttctgaaagtgcatccccattcggaagctagagccaaggtcccacctgctcgggggttttccctggagcttgagaggaacctttcactcacccacctccgagtctgaagacacaggctgccagcggttgtgttcatgacgtcaactttgacggttgattccttttttggagaaaaccactggcttttggaataattttcgccctctctccacaagagccctgcgattcatataagttctgtttataaaaccccttcgggggcacaggtcaaatttagcaagtctgggatagggcaaggcttactggcccaaaatggcagatgaggaaaaaggctcagacaccctcaggagcctgcccagggccacacggctcctgagagatggtgcaggaattggaccagagtctctgctgccaagttcatctccctattactatacactcgctacacatgcagttgggaagctgttcctgatcttggctctgttgtctgttacgtgtcctagctgggtgcttagtcttctagggttgccataacaataccaaaagctgggtggattaagacaacagaaatgtatggccttgtagttctggagatgggaagcctgaaatccaagtgtcagcagggctgtgctccatcggaaggctccagggcaggatccctgtctcctcccggttgctggtggttgcctgcaatccttggcattcttgcctgtagctgcaccactccagcctctgccccgtcttcccatgaccttctccctgtgcatctatttgtctgtgtccaaatcctctattttcctcttatgaagacattagtcattgggtttactcaccctgactcatgtgaccagattttaacttaattgcatcagcagagatgccatttccaaacaaagtcacaggtactaacagttaggacttgagcatatcttttggggggacacaggtcccctatgacactgagacgctgccagggggcccctggtggaccacactcatacccagaaggttctgtgcctggtcagtgttctcccatccgtgggttctcctcaatcccctgctcaggcccatgagatgcttccagtaggggctgtgctcatgagtccctctgccaggagggacatgaagtcagctgctgccagcctgtggacggattgtgccgctttcgcatctgtctgagatgctgcaagtgcgtggcctcagtgagtgggtggcagtgcgagcacattgtgtgttccggggagccgggccacctccggctggatgtgtcgccttcctcagggctcctggcagcacctggtgcattactgggtcagggtatcattttgacctcagggtggctgaggaagctatgtttggggaagtggcatggagcttagacattcgagctggcctgattctttttccccaccagatgacaagcgtctctagggcagggatgcctggccatctccatttcccctccagcagtttcaggctcatgggagctgccatgtttctgcagctttagtcccacattgctgtgaccctgtgaggctcccctgggcaagtcttcactctctgagcaccatgcagggctgctgtggggttccatgagatgatgcattttaaaaccatgcacgacttgaaatgcccgcagctctcattatctgggagatgcctcaggacaaagtggcaggacctgattgaagaatagggttgaagacagcacctcgatatgtctggcggtgcagggataggtggccatgtaaccccagtgggagccacttataggaaaaggtggtagatttgggcaaggaggtggcccctctgaaaacctgttgcagtttcaagtgaatttctgaagacgcgtcaagttttagatctactgagtctgcagtgaccatggccaatgggatgggaaaattttctcactagaggagaccagagagagggaacacggactctccagagagtttcgtgagggtccctgccaaggactagtggaaacccaagcagttggggacagggatagtgggagaggtgggaggccacctgggatcttggaaaagaggaagcttcctttttgcagcatgggaggcagcctgggaaagttagggttgcaggatgggaatccagggtttcaggaggcaggaacctggagcaacctgactgggcagtgctgtcagcagacccaagaatactgactggcctgtgaaggaaaagtttgctgcaaagtggaatcgaaagtgaccaggggccaacagggaaggggccgccctcactccttatggctctaaggggttgggtctgttctcaggttctgcgtgtgtccctgattcctgaagctacctggatgctccctgagagcaggagctgcttctgaaagaccatggatcccccccaccccactccccatcaagcagccagcagagtgccaggggcatagcaggtgctcatttaacaaaaatagacaagacccgttgccagagacagcttttgctcaagtgctggagttctcaacccagctgtctatgagaataaccttcccaggagcatttgaaaaatgctcatgcccaggctcctcactttgtattaatgatgcagttggtctgagctggagcctggcaccaggcattttcaaagctgctcatggacactgcattgttaaggttcaccaccagctccgaattgtggctgcactatgtgggcacatgcccggtctttctgggcctgttcagtcatttgcaaatagccttgcagaaatgtacatggtgggtccagtgtgtgcctggcacccagagccactctggctaatgctgattcaaagtcgcaagacgattttgccctgttttggtggatagctcccctgtggagatgactgctcagggaaactggcagatttccagaagagggaagaggagcagccattgctgattggatcatccaagctgggttagcgtctggcttcgagcactggtttaaggtgagcattaaggtcccgtgggatgttgagagtgtttgaggagaaagaacacatctccttggtctagatctcctttcaatgaaaaatgccattttgtcagaaattcccctcttttgggatcaggcagtgcatttgatgttaacgagctctcattgaacacacgctatgtgctgcatttgtgcaagggcttggggaccccctaaatgaattagacaaattagacagtcatgccctgttggagcccagtggcttttgggtccccgttccccaggcaccttaacccaggacagccacactagcaggaggagggcggggagggagagattcacacgtgaggatcaggatttgcgaacttgcggaagagtgtggtttgcggggcccctggcaacagtcctgcttgtcgaaacacttttttcttggtgtaaactgttcccaatcgattgagaaagaagatttggaaccaggcccatgaccttctgcaggtgctgagctgtaggtctatagattgttggaatgttacataaaacaaaaagcccctaaggccatgcctggaagagcaagctctcccacaggtcagcctccttctctgcatattgcacagcttcaagagatcttaaaagaaaggactcttttaagcaagggtcagatgggattgggatgacgcacagggaaggtgtagatgcggttgcagtgaaggagagagtgaggacccagagacctcctgtcctcagccacaggtggcttcctcttggagtccacagcatgtgcatattggtgcagggcactgcgggatggagtgttcatcccagccacacgttcctgctgggcaccacctctctcctgacgataggttggagctgagggcacagaaatggccaaggcagggagtcaagccagacagccagcatctccagagaatagtgacagatgttgtctgccaggtaagtgcaggaagtgcagaacctgccttgaagctggacgagggtcatacaaggtgtcccagagaggggacatctgagctgcatcttaaaggaagagtagcagttagctatgtgcagaagggcagtccaggcaggaagaacagatgtgtctaacccaggaggagagcatgggccagcgggaagggcaggaagctaggactgggcaagatagaaagatctgcctgctggtttgatagagtgagggaagtgtggggccctgttttagctccgtagccaaagacctgagttccagcaaatcacacatgtgtgcatgttgttagagtgtgtgtggtgcgtgtgtgtatgtgtgggtgtgcatgcataggaggaaagggagcggagagttgtcaaatgaggcaagccaaaacccaggcagtgggatggtcatgttagcatctgttttacaagggagttcccgacgcatcctccaggatcatggttcgctcagcctcacattgctacaaagtgggaattttaccaatgatttaaagcccttccaagggcttccagggtctctgatcttcctggcatagctctctggcatcttcctcacccccagcaccctatgcaccagaccttgggaaggtgtttccggcccatttttttcttgctttgaaccacagcacgtgctgttgcccccactggaacactctcccgcttctcttcctccttcagatctcagcccgctgtcgccttctctctgaccctggtcccttccactgcaggctgttgctccggtgtctctgggctgctccaccacgtggtgcctgcccatcatggcatccaccaccaggtggcctttttcttggtaagttccttacaaagcaacatgctttgtgcacctctcaaatcttcaacacctagcgtggtacctggccccaggtgggcacttggtcgcatatttgttaaattattgaatccttgagaaagcccaagctcagcaaggttaaaaaaacgtttctgccagtgagtaatagagtggatattcaaaccggccttctcgctggccccactcctgtgcacctctcactgcacctacccacctgctgcctttcctaccgatctcaacgattatgcagtgagctgtggaagaaatggggctcagagtccggtcttctagaaggtgggcactggagtgagccaggcagggtgtcagggtgtcagtgttcaagctcaatggggaaactgaggtagaaccccagaaatagagattgggctgttccagctaagtagcggcagtgcacaggcatgaccctgtacccactggagacttcatttgtggcatcaaggctcactgcagccccacctcctgggacaaagcacctcctgccctgttttgtgtggaataaagctgggacttccatgaagggactgggctgggtgaggggcaagccagaagctgcaccacaccctctggaactctagaggccattccaagcctcacttgtttttcttttcgcaaaagtggaagcagaaagcctctgctctgtttgccttactctgcaaataaaaatggaatcaggagagtagtagtttgaatcccacttgcaagcagtttgtaagaagtgcccaggtgccccaaaaggtggaaacatttattttccatttgtaaaaaataacactttgttatgttgatatcatgcggcagcagagtactctgcagtttgcagcttgggaatgcaaagggcagggtctccttgcaggcctggctctgggaagcctcctcaccacagccctccatattttccatgacactctccagctcccagagcgtgctgccttgcctgcttagcaggctctaaaatcgtactttacagtttatgccatgattcgggcttgcgttggaatttgttccttcaaatagctctggcatatgtttttatttcacagtaaaaccgtttttaaaagttaacacatgcacattgtcacaaatcaaattgtataggcaagtatatcataaaagccctgatacatcctgaatgcttgctttgtgccaggcactgttctggggatgtttttcctataaactcatttaatcctcgtcagaactttgtccccactttgtgtgatccaggatttgcatccagacagtgcattgatcgtctttgagccccagtcatggacttcctgatgtggaagaggaatccactgccgtactagtggctctttctcctcctctcagtttcatctgtgcttgttaaagtgcttctctctgttacttttcaatctttagatacatttttctccagcacccttgcacagtgtgtctgtctccttatttcataaggtgaggttgttaatccatattgttccttttgtctttcctctcaagcttcggtgccacccacctgctactttcaggctgacattccttcaaggttgctgaagcttgcatcccatcctgaatgctctagcgtatgcattgtccatagtttgactctgaatgttgagaacagtaggtgacattgctataattattgctgcatcagaagtggctaatgctgggttaactcatgcactgggatgaccttttcttctctggagatcaatgccagaacccctagaccactcaaagcagaatggcctggaacagacttgagtgggttctcccgcctacacaatgtcatttgcttggaagcatgccatattgtagtttgcttcatctttggatcatcactttattgcacaggatattttttctgggatttctggttgcctttctttttttcttcttgctttctatgcctttttcatactctcccttttttcataccgcctgttccattgagcctttccccattgtttttctgttttgttttgtttcttctggagagctaacccctctcaggatgctctcccctcctctacccagggtactgcatcctctccagggctgctgcccccaggtcatcttgggctcaccgtcattgctttcctgggttggaggctctgtttgcttaagttacctcctaagaaaaggtacatggaaagtaaagtgtctgaaaatgtctgtattttatgctcacactgaaggtcgatttccaggttctagatcatttgccttcagaattttgaagactttagagttttccttgttgctgatgagaagtccgatgcctggttctttgtagattatttattctctatttgtcttgtccagaagattataagaattcttcttcattcatggggttcatgtattacatgaggatagtctccagggtgggtcttcatttattcattgttctggatgcccagtggccccctttcatctgaaagcccacgtccttcagctctgggagattctaatggaactgattgttttaaaaccttcatttgttttccattctccatatctgagcctcttacttgtcagctctaaaatcttccagaaagggattatattcttctacatttttctcatttctttgcctttttgctctttattcgagattttgttgacttcattttctggtttgtcattttgcttttttttaacttttaaaaaacatgttggcactaacatttttaacctctgagagctttttcttgtctctgatcatttcttttcctggaatctattttcgttttatagctactagtatactgagtgctggaatagtaattagagcattttgtttgtttgtttgctttagtccatgaattatttctgtctcctctaaggtcagtttttgattgttttgactctgctcttcctgctgctcactttctcctgtgccttttcgtttcgagttgaaaaaagtctagcagctgttgtgagattgttctttggccaatgagtaaacaggctgagaaagactgggtaactgaccaggatcacccaggtagaaatgactagctggtaaccaaaccccagccttctgatttctactcagcttcccttccccccaaaacttgattgatttcaagtagattttaggccaagacttgtcccactttgctgattgcatggaggctggcatctcttggtaactggggctgtgggagaagctgactttcccatttcccaccactggtctgtgcctcctctgtggtatgctggaggacccaggagttctgtggttgtcaggagaccatgcagccacatctgggatggttggtggcttctcattggcctgatgtcctttgtcgaaggtgaggccccagaatccactcccaggtatcccacagccccccacaaaaagctcagacttctccctctcagaacaggagaccctcagctctgagatggggaccacagtggagcagcacccactagaaggattcctgggtccccgaggcttggttagaagtaaatcttcacctgcatgcagaataattcaagggggtgtttgactgcaggcaggctgcctgtcttcatccatttgggctgctataacaaaatagcataaattgagtggcttctaaactacacacatttatttctcacagttctggaagctggggattccaagatcaagttgccagtagattgagtgcctggagagggcccactcggtggtttgcagatgaccgtcttcatgctgcctcctcacctagtggagggaggggtggagagctgtcttctggggtcccttttataaggacactaattctattcatgagggctccaccctcattacctaatctccttccaaaggccctgcttcctaatactagcaacttgagggtgaagatttcaacatatgaattttggggggacatatttagatcatagcagtgcaaaattaggaaaatgtggaagaaaccattaaaccatagatattttaactcatgtcaccctcatcttctgctcctggaactttctcctatagaatattctgacttgcagagagaaacagtgaaatcattcaaaggaatttctcggtcctccagctttgggatgctccttaaatcacatggaatctgagactgagccatttattgggagcttttctttattcctttttttcccccatttattcagcagatgtatatgaaatcttcctgtaaacataaaacgatgcttaaatacaagaggtgagaagggtgcagaggcaattaagatgtggcgtctgccctcaagggccctgcaactcagagggagagacaaacatgtaaacaggtgcactgtgaggcgaagggaaggctgcgctgctgggaggtacagttagtgggctgcatgattgcggggaaaggagcgatgaattgtgctcgggggaactgaggcagactggagcagagacggcaccagggctgggctggacaggaagttgagtgttattagatggaaccagtaaagcaaggcatggcttgagcaagagccaggagtcagaggctcacaagtgccaggcccatcccagggctgctggccccagttggtgggagtccagggtagcaaaggacttggccatgcgaaggtttgggtttcttgtctggtgagggcacagtgcctccttcttaggtctgtgctggggagtaaatgagccagccagggcaggaggtgggctccatgctggttgcatagtaagccttaatccaggttagctgtcattgcttatgacaaggtggccaacagttctacatagccttggagcgcatactagtttggagagcaagtggtgccgggtttcaaagaactgtgggcattaaaaacagttcatgacaaaaggggagaagcagatgcccttagaagggatgcagccaccttctccacatcgccattttgtggacaggcaaacaggctcgtaaaggacagatgtagctcatttatgtgcggtgagacaggactgaagccatgtggtttataggtgccttttgcttctttttttgtttagttggctagttatttttgtgccctttacctatttttaggagcgtatttttccctgctttttagtttcagtactcatatataggtttctctcttttcttttctagcatcatgtttgagatgggtaagagacagtccaggcaacagcttcagaaggtgtgtgtttaacggacaagcaagcaagtgctgttgtctggctcggtgtaagagctttctgaccggcagagctgacaggagccattgcttatggactgctttgggaggtgattcatgcagccccggaaatgctcgagcagaaatctgggcaaccatctggtgaaactagtagagaagggaatgaggattcaatgagtggtcagactggaaaagcccgaacattctcttcctccccagagagttgggggccagggattctgttcatgtattcagaccctccttctgtaagcattttgtgagcctctcctgggtgccaggccccatatagatgccaggaataaggaagttaagggacagaggcaggagatgtaaattttgctaatgtggggcacaggagttaatcttgtggatttgggctcaggacagccccaagggttgacagccctggcgcctagcagggccatcgtggacaaattacttaaccccaggaaccacaacttccttttctggaaaatgggcagatactcattcattgagcctctgccatatggcattgttcttggcacaggggctgcaatgaaggacacgattgctgtcaagtggcttctcttcaaagtagggaggagaaatgaaaaaataacatactttggagtagggaatcctactttcttcagtactttgatgaaaatgaagtgtagggtacatagctggagagtgatgggaataggggacctttatagacagggtatcctggaagacttttgctgcagggacacggtatctgagcaatctgaatgctgtgatggagccagccagtgcaaacgtttgggcaaagtgtgttccagtagaggagacagccagtgtaaaggccctggggtagtaatttcaaaaaagatcaaggatgttcacatcctttagttgtgatgggattgacagagattgtgtaaagatcacaatcctttagttgtgatgggattgacagagaggggagagtagcgggaatttagatagctaggcagcagtagtatcaagtgtatttttccagtgtagcaccttatagcaaagtcattttttttcaagtttttttttaacccctgttagtctggacaagtattggatcaaaattgtaagcttgacttctccctgcatgtcagccgcagtttcttcaaaaagttatcattcagaaggatgctatttccaggctggacgcaaacacagttggagggatccatatgcagagatgagaatttttgtatctcagaagatggtaaaacccacccagctgtctagtcatgttggaaaaaaatcacattaaaatgcaaatgctcctgagtaagtgaaatgttgatgggtgcagcccgccaaagaaaaatattcatgaaatacaggctgttgatccacagctagcatggccaagccatttgctcagcaagacctgagtgctaggaaatcgcacttacgggagctgttctgtgcccttagcaaacgctgatctccccaggggcatttggaaatggggacgctcaagtgctgggtaatcatggggatggggtgggggagcctgcttggtaaaaggacactctggccacattgctttcatcgtctatttgaacctctcagcatggaccttggggacaaagactagagacggtgtcacctccaccttcccaagaggaaggggtctgcatttccctgcatcgtttcaacttgtatttctgagcctatcagggactctaagctggatttccttaaaaagcattctcctttcatgggtgggtctttgaaaaagcattgagaacatagattttctcagtaaatatctggtatttgcaactttgagccataaaatgtaggagtggagagagagaaaaaaatgtgtaccagacatcatgattgtttcccattgaatccatacaacagtaatcaggtgggcattgttactccattttgtagacaggaaagctgaggctcagaaacaatagagtggggccatttagagcatggccttggcgaacatgagagaatcccagctctctcacaccctgaggaaaggggagatgtttctcccgctcgctgattccactttgcccatttataaaatgtgatgatagtgtcttcctctcttctgttgttgcaagcattacaattattgatggacataaagtgcttagaacattacttggcccctgggaagcagtcagcaatgctaggggctctgctgactgctttaaatgtgaccacagtcactcagcaagcagaaagagatgatgacatcagcacgattgtccctgtgcagaaagaccaagctcaaagcccagagaccccttgagatcaccagcgacaaacattccacacagatcacaaatgagcattgttctgctcgcagagttcttgctcagttacctgtggaattattctccccactttacagatgaaaaaaattgacattcataaaaagccctcttttccttaaggattgcaaacaaaagcctctttcagccagtgttcccgttacctattgctgtgttacaagccagtctaaaacttagtggcttgaaacagaaggtcgttattatctcatggggttctgtgggttgactggactcagctggtggttctcactttaggtctcctgggtactgggggcagatggtggctggggctggagccactgggctggcagctgggctgggctggccggcacagccagggctgtagggcttctctgcccatttctctccacctggctcgctggggcttcctcacagcaggtggcctcaggggagttggatactggcatggcagccagcttcccaagagggagtgttccaagacacaggaaatggaagctgctgggctgtaaggctggcccaggaacttgcatgagctctcacccaaggggagggaacatggacccctgcctcatgattggaagggagtgagtggccatctataatcccccattgctgggcaaggtggattttgcagatcctggagggccaagtatgtaatagttcactcccctgtaacatgggttctgctaggtccctcagcataaacctggagccttgcttgatcctgctggagacataggccatcactggctcctgtgggggggcctgggtggttggcttagactagaacctgcctcactggggatctgggagaaggtcactctggcagacagactgaacccaggcaagcagtcaacatgcaaggcctgtggaggatgtgctggtgataggcagagcacagtgggagggagtgggagaggaaaggtgggccctggaatgattcaggaaggcaggcaggctgaccttcaggcctcaggagcacagccaaggcaaccaggcaggtgcagggcagaccactctctctgggtgagggataggtatgaaagtcaacagcccaggccagggtcaccaagcagcttcctgggacaagagctcagccagaggccgagtcctaagaggtgggccacactgtgtactggtaaagcccaggtgtcatccctgaaacacagaagctgtggttcccagaacccagggcccttgaggctcagccccatagaggtggggagccccttccaggcctcgggccctgattgcttctgagaaccaaggcaggtaaggtctgcagagaaaagtccaggaggtggaggggctgcccgggctgggtaccccgcagtgcctgagtttatatcctcttcccctcaggacgctagccctggctgaggacctgcgcaggatgttccagagatcccttcagttctggggctttctgtaaccaaagactgtcccagagcctgtcaccaaaaaccagctcattccacaagggccctggaagctctggttcacatccagcactccttagcctctgttccctgcatcctctagaggcattgatactagagcaatccttaagtgggacttagcaaaggccctggtggtttggtctaagtgtttgtgaaatcattcaataagggacttaaacattacctctttttaaaattttgaactaatgtagaagtcatttccgcacccagtggcccctcccgtgaacatcttatataacctgagtgtaatcagcaaacccaggaagttaccaacgtgtaatactattaactcaattgcacaccgattcagattgcaccagttttcccacaaatgtccttccatccaggatcccgttccagatcccacactgctcagttgccatgtctccttattcccctccaatctggggcagttcttcagtctttctttgtcttccatgaccctaacacttcagaagagcacttgtcagctattttcttaaatgtccctcagtttaagtttgtctgaagttcttttttggactgaggttgtgcacttttggcaagaatcccacagagctcatgttgtgaccttcttggtgccccctatcgggattcatggtgtggacatcactggtgacattgacctcgatcactgggttaaagggatgtctgccaggcttcactgtaaagtcactgtcttttcttcgtaattgataaataccttggaggaaatactttgagaccatgtgaatctctttctcctcaaacatgagctcattacttttagcatccatcggtagatcttgtccacaataattattactgtggtgattgcctactggtgatttttctgtttctctctgtctttgtagtcctacatttatttattggaactctactgtaagaaagaattggtctttctcccccatttatgtatgtgattatttacttatgtcaatgaaaactcatagacatttcttttatcctgtgatttataatctaatcctgtggttatttattttcttgctcaaattatcccagctttggccattagaagttccttcaggtttgctcttgtgttttcaaccagcccctccacccccacctgtttttggaagacttccttaactttctggtatcacaagatgttcaaggcttatcttgtatgttcccttcctcaactctggaatcaaccacttctccaaggagccctggttcattttattggagaatggcatagagaaaccaaggtttgggtgccaggtatgtttattgccactgagctgtcattgcttttaggccttttaggggacatagctgggaatgatatggacaggcactaatccatgcgtgcacactcatctgtatttctgtgtccacctacctggatgtatattaaaaaccacgtgtttatactggtatctctaattctagtccaacatcacaaggctcattttaactttttccctttcctgcaatttttttccccaacagcaagaaactcagcttttgttagctaaaatatatttatttaattctagtatacactaaagtagtttcagatttattaacccatgtccccatgagaagcacatttacccaattactgagtaggtgatagcgtttgtgtacagtctttttgtcctcagccttatgctatccaatcaaaatactgttttccaaaattacttaggtgagttcttttctttcccacccccttcagtgtggtaatactatttatttgtaatagtttggtccacttattaatgtttacattccattttgggtttccttccggtcttggtaggtttgaattgctttgtgtggacatatgaaagacatgctaaacatcgcaatgctcctgagtcagatctatagcaaaagatacactcagagaagcatcacttcctccccatcctcgccatcgtgatcctaccccactcttctctgcatccctttctcttccaccacctctagggaaccagtctctttaatttctagtttacccttcctgtatttcttttgcataagtgagcagatgcatgcatgcatttttgtagcccctttcttccatgaggtgtagcatactgttgtatgttacatgtctgttgcatgcactttcacactttgcttttctaagttaacattgggtccttgaaatctctccaagtccattcatagggtccttcctccttcctttttgccaccacatcgtactctgtgtggacatgccatggtttattcagcccttctcctatatctgagcatttaggttgcttttcgtatttttgcatttacaaatgaggctgcagtggatgaacttgcgtgtgtgttttcatagcattggagcttatcttcagggtagagtccaagaaatggagttgcacagttgcaagggaaatgtatatgtggttttgttaagtgttgccaattttgtttccagaaagctttgccttcaagggttggaaaatagttatttcttgttggaagtcaacggtaagcataaggggcaaggtgggggtattgctactcttcttatgggatctttagaatgttgcttttctggccagaaatctctgtggccagtggtgcctttgcccaagttcttgtccggcatccaggaagaatgaggtatgcagacaagtggagggtgagcaagatgaagaggtgctttactgagtgttacaacagctcagaggagatctgcaatgggtagctcctctctgtaggcaggtcatcccattgagcgtacagctctcagcagagaagagaccctggagtgagtggcttctttatgccagcaggtcatcccaccatttctgcagctctcagcagagaggaggccctgaagagggtgactcctctttgcagctgagtctcaacatctgtgcagatctctgaagccctcagcagagaggatagatcctctctgcagctggtcctcctgtggtctctctgtcctctctgacctctgccctgctctggctgaacctggggcttttatggacctcagaggagaggaagtgtgtgtcagttggtccatgggcagccatgggtgggcctggaaaaggcaccacaagtccccagtttgatctgcaggactggcagtctggcccccagccttcaggccctccctggccttaaggtggagcattcctagggacctgcctgcttctgctcaggaatctgtctgcctcctgatgctgttcatggcacctgggcttggccccagttttgctctgagatcagagcagatgccaacagcagggagaagtcagatagtgggaagaggcacttccgaagctatgagggcagggatgacttcccaggtccccaagagtgcagggaggcctgagtctgcagccatggtttgggcagctgcagctgcacccagtggggtggggctcctgcctactcagccgctccagacgacctgccactgccatcactctgatggaggctctttctcaccaggcaacgatctgtcaggcaaagtgcgtcctcccatctgtcctcttagcatcaaggaaaggcagatgctggtctctcatgacaacttactgaggactctcatatacgctgcctcgttttgtcctctaacaacatcatgaaggatctgagcttactctactgttggctccattttaaaggcaaggaaactgaggctaagagaagttaagagattttcccttggtcacagagttagttgggatcacaagagtctcaaaatcagttttctcagattatggccttcttcccctctccatgtacactattggaaccataagaggccttggctatcacccagtttgagcccatcatgaatccattacagatgaggaccagagagggaagttgatgtagtttaggtgacacagctcagtgagggccatacctggaacccaaatccctgggtccttcccctactccctgttagtcctgggaattggaggtagagtagccctggcaagtggggtccatggcccagtggaagtggcaggtaggcggggggtgacgttgctgggctggaggtctgcaccacaggcctgcgtctcatctctgctgttgaagcatcctttcctcagagatacctgatgacttgggttcctcagggaagtctggactaacagaattaacttttcccacaagtgaaaaacgtgttctcgttgagcaaaggaaattttgattaatttacccttaagtgtcagtacagggagctgttttttctctttagatcagtgtttaaacttttctcactcaacacacagtaaactaatcctcctttccatcagacttcagggggagaaagaaaataaacaaggttatccttgctgccatctctttttttttttttttttttgaggtggagtctcactttgtcacccaggctgggctgcagtggcacgatctcggctcactacaacctcctcctcccgggttcaagcgattttcctgcctcagcctcccgagtagctgggacttcgggcacccaccaccatgcctggctaattttttgtatttttagtagagacggggtttcaccgtgttaaccaggatggtctcgatctcctgacctcgtgatccacccgcctcagccccgcaaagtgctgggattacaggcgtgagccaccgtgcccggccgctgccatctctttatagggaaatccagctaggtgggctgggctaggctgtccctaccccccatctcagctgcctctcagagtgagccaatgcatgcactcactctcagtactgaacactgcggctgccccaggccaggctcaggggccagaggacatggaggtgaatctgacccacccaggcctgtccttccaaaggagctcagtttagtggggaaagacccaaatcaagagatggtgacaggatagggcaggagttgcccagacatccgaagacggggtcctgggaaatgctaccaatggaatcgagcttcaaagggccagcagtagttcttcaagccaggaagagcatgtgaacaaatgcacaggggttagagccccagcaggcggtggtgggactggaatgtggggggcatttgagggcaggcaggagatgggcagcacctgggagtcatgttggctgcgtgatttaaatcgcaactcggtgtatgatcatttctttacttttttcactgccgtatccctagtacctacaaacttcctggagtgttgcagagcttcactaattatttaagtctcaattccttatctctaaaatgcagataatgcttatttttgtctgtgctgtcgctgtgtctctagaatagggtcttggctgggcacggtggctcacgcctgtaatcccaacatttggtggaggtgggcagatcacttgagcccaagagtttgagaccagcctgggcagcagagtgagacctcgtctgtaaaaaacaaaatagaatggggccagcgtagattaaatactaaataaatatttgttgagtgggtgaatggatggaggaactgtgtatttattaattagtagctatgacgtttatcatcatgtgtggctggatagtagctactggccccatcatgacagatatcaagtacaaagccagatccagcaacatcttggcaattagggaggggaagcactgtaattaatactaatcattgtgaaccttcgttgatcagactaaatgctttacagatattttatctcttcactggttctttggaactcctgggagtaattcctatcaccagggatggcctggctgccgtctcccttgagtggcttgtctgatgacagccaggccattctgtggctgcctgtgctgggcatgggcatgtgtggaggagcttgtcctttggaaaactcttgcccagcccctgacgaagaccttgcctgggttcagactttgtcactcagaggctcccagctcatttcctgaaagcctggaaggcagctgtggaatgttggcagagctggcggccaccctgtctagacatttagtcctggagagccggttacccattttacttactgtggtttgattttaggagccaagtgagtttcaaaaatttaatataaagtatctaatgcatacaagagtatacatagtgtatatgtgtgattgaaaaaataaacaggaattgaacatccatgtacctattgcatctaatgaataaattccacaggtgccttgcatgacttacaagggcctctgttctagtccccgcttccccctccagcctcagctcttaggacagccccctcaccatgctgctgcgccagccctactcgatgtagcattccgcacttccacattttcttcacatctgccagtcccctgcctcgttgcccttctcccaccatcagctgagatggtcctactggcctttgatgtctcagctcagacctcctatcttgtggagacagttcactgcgtgccctctctgcagtgccctgggccctcatcaccatagtgatcaatttgtgttttccgttcactgggccatgagctcgttgagggccagggcccttgtcttccatttgtacatgcccgttgttatgggcagctgtgttttaggtgaccactgaggtctcttcttggaagggagaagttgatgcttcctctgtgttctggcctcatctgctagatttgtcagacaacgatgctaaatttccaggcaggagcttgccatcgtagataggatcagcgtgaaccttccccgctccaaaatatggaaatgttctcaagacggagaaacactcagaattacagttgagcctgagccactccattgaaagcagccagcaagtaatggaaagaatttggatagaataatccctgtcttccttttccggaatgtctggtaccttttagcacatcagggagcaaagatttagttctgagactggcattattttgacaaacaagttggtactagaattaaatgacccaaaacccaactcccattcagcctaaacatctctgctgtactatagaaaggctgtcagaacctccttcatttgtcatttttcacatacagcaatggccccttttggttttcaaattccagcctctcaggcagagagatactgacatgaagatttctccttgcataccggcgttgttcttgtcacttggctggtgaggttctttgaggattgttggaaaacagaagcactcgtagtcttcgtagttttatttatttatatattgattgctttgaacatgataaaagtaaattaacataatcaactatgttatagaacatttctgaatttttcccccagcatgtttttcctaaacaagtaaggttttaaaaatcttacttgcactatattgtactttgtatttttactttagtccccataatcatgttgaatttatgtgatcattgattttatttaatatggaaaagcaaatttcttcttaaatttacattacctaatattctcactggctacgttctgcattcgacactgccttttattgtaatattgtctaaatagatgcagaaaaatggaattttctctattaaagtattttacatttgaaatataaaagaactagataacagttttctattcaaatgtgtttattttaacattgtttggttaaaaaagatagatgaagttccagtcaaccactttttccccctgaaatttcaagataatgctgtattaacttttctagatctaacactagcttatccttccctcttacaaaattgtttgaacttactgagaaaatattcccatcattaacaaaaataaactatttaatagaaaaaaattatttgcagtcataagtagaactgaattttaatatcctgtgcttttccccttatcacatcgtgggcatcttcctttttttctttttttttctttttttgagagggagtctcgctctgtcgcccaggctggagtgcagtggtgcgatctcagctcactgcaggctccatctcccaggttgacgccattctcctgcctcagcctcccgagtagctgggactacaggcgcctgccgccacacctggctaattctcttgtatttttagtagagatggggtttcaccctgttagccaggacggtctccatctcctgacctcgtgatccgcccgcctcggcctcccaaagtgctgggattacaggcatgagccaccgcgcctagccgggcatctttttttttttacctcatggtctttgtcaccatcattttctttcctttttttttttttttaaattctactctaagttctgggatacacgtgcagaacctgcaggtttgttaaataggtatacatgtaccatggtggtttgctgcacccatcaacccatcatcatctaggttttaagccccgcatgcattgggtatttgtcttaatgctctccctccccttgtcccccactccccgacaggctccggtgtgtgatgttcccctccctgtgtccatgtgttctcattgttcaactcccacttatgagtgagaacatgcggcgtttggttttctgttcctgtgttagtttgctgagaatggtcaccatcattttcagctgccaggtaatgcatcagtgagttgtaatcacacgaatttttcattccgcaatttactattgatcactgagtggcttggcaagggacaaactccatttcttagaattggctctgagaaattggtctagagaagtcataaagaggaaacctcaccagcaaatagaggctgcagaaagtgccaggacccagcatcttggatatcgctcagccatggtctgtccagcagggtcactaacctagagacctctaagtcctagatggactggactttttttttttgagacagagtctcactctgtcactaggctggagtgcagtggcacgatctcagctccctgcaacctccgcctcccaggttcaagcgattctcctgcctcagcctcccgagtagctgggactacaggtgccagccaccacacccagctaatttttgtatttatagtagagacggggtttcaccatgttggtcaggatgatctcgatcacttgaccttgtgatctgcccgccttggcctcccaaagtgctgggattactggcgtgagccaccgtgcccagcccctaggtggactttatagcaaccttggataaatatgggccagaggagaaggcaaacagtaaccaattgacagccttggaagagtgctaatgaactagttggtattaagctggaaacctagtcaaaaactggaaggtgagtaactgtatggagagggtgcacatccagtgtgtggatgatctgaagctgggaggagagtgactgtgtaggaagacaatcatctagaagccaaggcaaactcaacagattggcacagtgggcagaggtcagccccctggactgtaatgtaaatactaagtcctattcttgggttaaaaatgctcaccttccacaaacagggagcaatgtgattttgtagcatcgtaagtcatggcatactgtggtgaccccaaagtgaagtggttcttattagcatccatggatgtgccacatccaggagggagaggacaaacctgcccagtttgggctgaaaatctttcccttatgttttccttatgcatgctgtgattttagggtgggccttcccaggagaagggatcatgattaggagtggctatgtggacaagtagggaacagaaggtgcttagctggacaaaagggcttgtgaagtcatgagaatgagcctctgtcatcattgtcatcatcatcaatcatcatcatcaccacttaatcatagtggctgccattcatcaagctaggagacttagaactaatgtctttaatcctacaagctactgttatccctactttataggtgaggaaactgaagctcagagagatgaagcagcttgccccagtcacatagctgataaaccactgagacaaaattggatcccagctatatctgaagccagagttgtcattccttccgtatcaatttttcaaaaaccgtggtgctcccttgcagaggataacaaggacttgcttttgtttagttcctggttataaaagtagttccagtgggtgcaagctaagcgagaatattttgttttaaagcaaagggctttcctgactgagctgtcggcaggtagaatatacttcctgagaggtggtaaattccagaatgataggaagtcttcaagaggaggcttggttagcactgtgtgttctagagggagctcaaagaagccaacaaaataaccttgaataccccttctgtacaagtaaaagctctggttgcatgcaacagatactggtaagaaatgggttccaactgccttaagcaaaaacactgttttttgcagggatatggggtagttcatgggatagaaggaaatggtgagctgagctttaaaaagggcaaaagtcagcctggctgcaggcatccaggcggcagcagctaatggaacctcatttcagcaccgtggctaggatgagtcagtgtttacagttgacccacctgctatcaccctacctaagactaagctccagagacagagcatcttataggcttagccaggatccagacccatccccatggcagcttgattgacagcctccattaggaagggtaattttccagaggaaaatcgagaccaaagaaagaccatgaatgctggttaggcccagtgagccatgacctccgtgccttctagccctgcccggctgggattccacactgaaccctgagtccccctgcagggctctccctagctgctctgcagcctctaggcccaggccacacacggcgctgtgtcactgtatactcgtggtttattttccaagacacgcatcctaattaagcaaatgattaaaaactctcaagtgtgctcatcggaagcagcccaacagaggactggcttgctgggaactgtgcttgaaagtgagttgcccatcgccttagcacagtaggggtgctgatgaggagcactctgtctttccagaaaagtggctcccttcctggttaccatgcggggcttcttttggcattcagcacagcacttaatatacccagtctttaaaaccctgtgttttttaaaaaaaattgtttttgctaattaatttgttttaatatcagtattgttttattgttaattatgcagttaactagtaagtattaaatcaccaattaacttattaagtatggaatagatatgagaagcatatttagaatgtaagtataaagagcaagcgctcatgtacccaccaccagcttgagaaatattaccagtggcttagagagtcctgagcatcctctccatcctgtccacttagtgggaaccactacgtcggctttgggatttattgttctcttgtttttctttgtgtttttatcacacttgtatctccatataaaatattgttagaatctccctgtttctgaacttcccacataagtgggaacatcctttctgtggtcttttgcaacgcgcttttgcactcgatattgtatttgcaattcatccatgcgatggcacgttccagcatttcattttttcctcgacgctgtgtgtttttccagcatgagaactcacaacggtagatccaggccaccgctgatggccattgatgctgggtccagcattttgcttatgctgacattgctgtctttaaatgctcttatccatgtaccctgctgctcatttgcaggtgtactcggtgtgtatctcaaggtggcatggctgggtcactgaggtgtgagtatgtttggctttataagataatgccatcctgttttccaaagtgacagtatccactgatactcctgccataggtatctgagagtccctgctaccgtacagactctgtcagtgttcagtggtcttgtcagatgttttagttcttgccaatctgatggctgtttgatggtagctcactgtgtttcaatgggcatttctctggtactgaggtttagcttctttacggctgtttactcttttgtaaaccatgcctggacatggttttgcccagttttctactggatatttatcattttcctactcatttgagactagaatgatgtatagtgtatatcccagtttgtggcttaacttttcacttttgatgatattttatttttttgataaacagatattgaatttaaggtcatcgaatttcataattttccttatagtttgagcttttatgtcttgttaagatatccttctctaccccaaggtcatacagatattcctttatattgccttataaaagtttcgaagtgttctttttctattcttatctataattcatctggaactgatgaactactgatttgatttcatttattttttcatacagatactcaggtattccaacactgctcatcaaagacccgtttacccctgtggatcagcagtgtccatgtgtgtgtaactttgtttttgtttctttggcctatttgtctaaggcttgtataagccttagacctaagacatattgatgccctatgaggcagatctccctaccttattctttagtaaacatcttggctgttattatccatttgctctttgatatacattttagaacctacttgtcaaatatcaccaaaaaccccatagacattttgactggaactgcaaaaaacctatagaacactttaggaaaaactgatgtttttaggatattgaatcttgcttattgaatctagcattccgtgaagatggtatgtcttctttttcatgttggtctgcttttatgtctttcagtaaagttttacagtattcttcatcaaaatttcacacatctttattagatttatttctgggcactttatatttcagatactatcacaaatactgttttttaaaaattaacatcttgattgagatataattcacaaaccacagaattcatctatttgaagtgtacagtttcatggctttagtatatttagtgtatttagggttgtgcaactgtcactaaaaatctaagtttagaatattgttgttactccaaaaagaaatgcctttactgttatcagccaatccccacttccccctccacccagcccctggcaggaagaaatgagtaaatgattgagtggataaatgaatgtataacctttagcaagctttatgtcagacattgactggccccagcctttgcttgttgtttatttttaattttttaaattttattttttaagttttaatttttgtggctacatagtgggtgtatatatttatggggtacttgagatgttttgatacaggcacacagtgtgaaataacacatcatgaagaatggggtatccatcccctcaagcatctatccactgagttgcaaacattcccgttacactctctaatccattttaaaatgtgctgttattattatacttgttgcttattgtttctgttttcctttcccatctctgttattgttctggtttctaggctaatctcctggattctatgagtctcctccatcactgttcatcctccagaccctggccagacaactttttccaaagaaaacaatattctaacttctccatttaaggaagccctcagtaactcccctgggaatcaagccacactcccaacgtgttgtctacaggggaattgaagtttccaagttgatgacttaagcaacttggaaacaaacacccgaggtgcaactcttctgtgagtcggagaaggtctcttctaggtctttgtttgcttcagagtcctcggaaagtaaacacagctgacctgattattcccctccacttcctcctgagtcagagttatctcgagttaattcagggaagaggctaaattaagccttgaaaccaagcagcctccatgacaggcgctttgttttgcttgagtgactgtgatgatgggtctttggttataaaggcagcactaattgtatcttcttataccaatcctggccatctattccctggcctgtagagactgggagatgccaggttgccccagagcacccactcattcattcagcacaattttcttaagtgcctgctccatgcccggcatcacgcttggaggtggggattcaaaagtccttcctccaagggcttgcagtctttctaagacgacggatgataaaccagagactccattagagacatgactagtgcttggatagacatctgtccagggcagtaaagggagtggatttctaagattcttacaacagacttctcatgactttgtgcaaagtttgagctgtggagtcaccaaaataaaaaggggggatccactaatacctacaaactagcaaacagacacaaccactttgaaaagctgtttagcagtatccactaatgtcaaacgtatgcgtaccctgtgcccggcagctcctcttctaggtatgtatgtagtaataggaaatgcacgtgtgaattttacattaaaagagaaaactgtaaataaaaactgtagttaaaacatgcagcatgctgcagtgtttacggggaaatgaaatagtatctgcagtttaggccaagcatggtggctcacacttatgatcccagcacttagggaagctgaggcaggaggattgcttgagcccaggagttcaagaccagcctagcaacatagtgggacccagtctctacaaaaagaaatgtaaaaattttagctgggcgtggtggtgcacgctggtggtaccaactgcttgggaggctgaggcaggaggatcgcttgagcccaggaggtcaaggctgcagtgagccgtgatcaccccactgtactccagcctgggcaaaagaacaagagcctgtctcaaaataataataataatagtaataatgatatatgtagtttaaaatgcacccaaaaaagaagatagatgaataaggaatgggcagatatgtgacaaagcaagtatgggaacatgttagtaatggatttgagatggtgagtttatgggtgctcactgtaaaattccttcaaatttgctgtatgttaaaaaacttaatatgaaatattgggaaagatgtatgtatatgcttgcccgaatatatatacaagaatgttcatagcagcattattcataatagccccaaacttgaagcagtgaaaatgcccatcagccatagaatagagacataaattttgggtgtagtgatccagtggaatactgttcacatataagagtgaacgagccacagctatacacaacgacgtgagcaaatctcacacacagtgttgtgagtaagaaatcagactcaaaagaggacatactgtatgattccatttacgcagaattcaaaaccaggcaaagctcaccaatggtgctagaagccacaataatggttttcaggaggtagggatagtgattggatggggcactgtgggaggcccctgggtgctggaaggctctgtttcttgatctcggtgctaaacagatatgaaaatgtatcaagctgtacatttaaactttgtgcactttcctgtatgtttactatacatcattaaaagtatacgaggggagaaaaagcaggaaaaccgaacgaatccaactagaagctttccctagctgagctgtgggagtaggaacccactgtaggcctatctagtaaaccgaagttgtgaagaatatgaaacttgcctttagggtgttcatttgttcacttatgcacagtttcatgttgcatcagttcctccattcttcactgatgtgcttgcctctcgttcatacggatgttcattcacatgtcctgtcctccggatccagagccgctctgtaaggtgcgagcgacccagccctttcaggggctcatgtgcacagggggagggcatgcagacgtttcatttcccatctcatttcacattcccacattcctggattcccgtttgtgatccttcctggatatgtgccctaagatagcattcgaatgagagaaacagaactggtaagatatatataggtgtatataaagagatttattatacagagttgactcgtgattttggagaccagcaagtcctgagatccgcaggatgagtcagcaagcgggagacccaggatggccagtggtgtggttccatctgaagccctgcaggctcaaggcccaggaagagctacctgaaaatcaacagttcgagtccaaaggcaggaaaaagccattgtcccagcttgaaggcaggcaggcaggaggaatttgggggaatgtcagcctttttgtttcattcgggccttcagctgattggtcagtcaccacccacatttaggacagtctgatttcttcagtctcccaattcaaatgttaatctcatcctgacacacacacccagaataacgcatgaccagctatctgggcgtgcatgacccagtcaagctgacacataaatttaaccatcatcaaaccctgaagcgtgaaaagcctcctggctctaaaggcacagccctccagtggaagaaatgtagctatggggctggcctggtgcacatcacatcacaagtggacgggctgccaccaccacacacactgatcctattttacctgtggtttggaccagcaattggtagaaaagaaggctttggctgcccagtctgcctcctggatggccatgttttctgtcttcgaaaataaaaagttattttgattattgcaatacataccatgcatacaaaaagagtagctggaagatatgcctgcagtttaaaggaacagtttaaagcttaacagatggcagatgactagtatctgaaggccactggtgcccctccctcatggcagcctgctccactcttgcctggagaaagccactctcctgagttttgcgctagtcactttggtgctaatcattccattactttttatgaaaatcaaatagcacatgtctaaaacaatagatgacttggttttgcctgtttcgagcctttataaatcaaattgtactgcacaaatttgtctgccatgtgctctttccctccgctaagtgtctgggctttgttcttcctgttgcctgtagttctaattcattcatttcaccatcatataatattccattgtagagactgaccaccacatgttcatctgctctcctctcggtgcatatctgggtaacttccagttctctgctatggcagatgaagcccatgggagcagtcctgtgtccatgcctccaggtgcacagaagtgaggccttctctagggtataacctggcagagcaggtgcccagtggtagaatatgtctgttcacttttctagctaatgcctggaaactttctggaatgattgtagcaatatctgtttctaccagggattatgagaatttctcatggcgttactcatccacaccgtgcatagaccctttaccatcctgcctggtctcaatgaatcaccttccctggcttccagccacccctacccataccgcagtcagagctttagcatggtaggactgtgatgccccatacacactttgtggatactcaggacagcatgtttcttgcgtgtaacccaatatgtgagagtatgtgaaattcccaccaccaggatggagggcacagactttagtttcactgcagtgcagctgacccagtttctccttcaagggaaggggggaaaaccagctcaacaaagtgggtgatgcccgggtagacttctaggctcctctctctgtaccaatgtcaggacactcatcttctaaaccaattagccgtgttctgcctttttcccatggccaagagcaaggtgtcccaaggtaggatccttgtgggatttgtcattctcccaccatgttctgacctgcaagcagatcactacccactacagatctgcctggctatggagggcatgcttataaatgatcatcttttgtgctgcctctttccaattacaggttagcctggcaaggaagataaagacatttgcaaccaagatggtaatcactagtgaaaatgatgaagacagaggaggtcaagaaaaagaaagtaaagaggagagtgtcttggcaatgctggggattatcgggaccattctgaacctgattgtgatcatatttgtctacatatacaccaccctgtgaatggcccagagcgtcctcagaggcctcagaatggccaaagacggaagtcctgcgtgtcggcgcatcactgaccagaccctgcgagaacaagcaggcttgacccgcacataccacccaatcaaatgcaccttcaaactttacaaaaggtcacacaaatagaccgatcctgctgcagggagcagacactaaagcacaatgattccaacaaaactcattcacagcactaggaactcaacgtctttggcagggggcccagaagaatgcttggaagaccagcctctgacaccatcagtgagcggatgggtgcagaaattcattattccagatcgctgacagatatcacatatttgaaaagatgaatagggcggacatggctcagatgtgtgtctcccaggacaagtgtttcatcttcacttgacgagctatttagtggaaaaaccacaggcgcagccctttgacaggcatcccattcatcaaaagtgtctaactatttgatactggggagataacttatttttcttttttcattggcttgacatgtgtatctgttcatgtcaaggtttataaatatatatttttaataaatgtgctctattttttagcatgaaccaaatacttggagaggcactcccagatccatagagctttccttagttttatctgctttgtcccctcctcccccaactacagatgttctgttgtggagccattctagtccttttgtctcatcttgagtcttttaccttgcgcttttgttctctctctctcctctctctctgcctctttggtctgaaggacattttcccatactgtcagccatggttttgggtgcatgttttaagattgtccattgagtggctttttgttgttatctcggagatataaaatgattgtgggcatgcagaccttagatgcaccctatctttactgagaattatgcatgaataagggctgagtgatagatcagcttaaaattaaaaggactacctttgaggaagaagagcgtggctatatttgcagatgaacttttgaacagaatattcagcttcttaccggcagcgttattgtttcattcttgtgaccattcgtttatcagattttgattttagcggtcatgtaccgcgagagttgggaagaacaagggggaaagctcgggattaggtgcattactccttcctttgcaagatacctgggatcctcctcaaaagcgggtggggtataaatgacacaagaactcccccaggagatctcatggtgattcaggctgtgaggacagccctgtgacaggtgacttttcagggacatgaggaggggatttaatgattgccctaaaggacttctgtatttttaaagcccctggtttacacccacatgaagctatttcctctctggcagggatggttgcataaaaacaaattagctcccttctggctccctgaaatgggcccttgcctggctacagtggcatggccttaaagagagggttagtattccttctgccattgccagctgtattagtctgttttcacactgctgaaaaagacatccccaagactgggcaatttacaaagaaagaggtttattggacttacagttccacgtggctgaggaggcctcacaattacggtggaaggtgaaaggcacgtctcacatggtggcagacaagagaagtgaacatgtgcaaggagactcccatttttaaaacagatctcgtgagactttttcactatcatgcaaacagcatgggaaacctgcccccgtgattcagttacctcccaccgggtccctcccacaacacatgggtattcaagatgagatttgggtggggttacagccaaactctatcaccagccttgcccctgggcagaagcagcagcagtctgcctggctggattcaaatgattctgaggcttctatagtctatgcctgcagatctctccctcacccatgctatagtgtctgaaattccaccattagagagtcatttcttgggctctgttaaatggaccaggctcttttataaagaaaatgcccctgagcagctggctctggcattgatttatgatatcttctcttccctgccagaaggaaggaagctaaggtgcatgtagggcgtactgtgtgcccaggcactgtgccagatgctttggatacttggagtcattgaattcttgtagtaaccctgtgagagagggagtcttttctccacattgtagaagaaggaaaaagggctcagagaggtcaagaaatgtccctgagatcacatggcttctagtggagtcaagatccaaacccaatgtgtctgattccttagcccttgggggtccggaggctgctgaacaagaaaggaggtggagaggagagaaagctgcaggcataccaccgcacacccttctccctcccctgtaaaaacaaccctgggaactccctggacactagcagaatatcatacactaaggataagggatgagaggaggctggttagaaataaagcagtgtcagggggaaggagctactcagtaggctctgtgtgattctagaaagactgtatgaaaattctgaacagtgaacagaataaacaataaaggtgcaatggaaaaaaata

SEQ ID NO: 320 - DNA, 70429 bp, Homo sapiens
ccctgaaatgggtcagcagggccacattcttactggaggcctgaggggacaacccagttccctgcctttcctggcttctagaggctcccacgttgcttctctgcaacccctatttccgtcctgatatctcctctgactctgaccctcccgcctccctcttaaaaggactcttgggatgacactggacctacctggatgatccaggataatttctccatctcaaggtccttagtttaactacattggaaaagcccttttcgccccttaaggtagcatcttcacaggttgtgagctttaggatggggacatctcaggggactattattccacctcccacgagggtagaatgaaacttcactgtcactggatagagccgtgcatttaaaatgtgtatcatgtgtggtattacctaatcaaaatttaaagttgtatttatgtttgataggacaattcctgcaatgattttaaaagccaaagagtgtgtgtgtgtgtgtgtgtgtgtgtgtgtgtgtgtgttaaattaagcctcctttccatgcctggggtgttccttctctgaagcagacattttactcatttttttgcgtatcagtctgcattttctgaagaagaaaaaaggggaatgggaaaggacatggtccccagttgaaggaggggtagggtgggctgctgtgatgtcgtctgcctggattgagacctccttctgtttctctttgggcatctaaatctttcacaaatccagcaaatgtatatatttcctgactgtaggccaaacatcatgttagatcctggggtaccaatcaggctatgcccccaggcggccttggctctggcgggaggcaggcagtaagaatgcactgacgacatgtcagagaacgtgtggccttaacagccacaattccaatcctgtgtctcagcccggctgagcctcgggcctcctccctgtgcagctgagtgctggggtcgggggagaggagagatctgctcagctgctagccccaggaaaatgctgtacatcttccaggatggcctttctgctgtgtatttatgcctaggctcatgttccaagaaaatcccatgatcaaccaaagcatgatttccctgggaaccagagggacgtgaggccgtcagcccctctgatatagggacttccctgggctgttttctcagcaactcacagctacagggcagaaaaatatagatgatgcatagtgctctggctttctctctcctcctctggggatcctggggcttgggtgattcattttagtgcctctaatcaggccctgagctcagggcctcggagggaaggaggattccttcagaggggtgaagtttggctgtcattgatggttacccttgggttggtaccatgcgctgggacgttcagagactgattttccttcttatatctgacagtacattttggatctttaaaagccccaactattccagacacccatgcaagtcataagccacaaaggtcagtaaatttcagaccaaaaataaaaaagcaagggagagagaaatgcacagtgacagaatgagatgcagacaccagagatacacaggcccccaaggaacggccaaagagctgcctctgagacggaaatgccagaagtacagaggagacacacacctgaaaagactgaatattatcgggaaaaagacacacccagacacaccaaggctcagcggcactgctgtcctcaggtgctccgagatgaacaggcaacctgagagcttcttaggacaggccggatccctcagggtcgactcccattcccactatttttatttccagcctgcagaatcacctcttcttcatagtaggaaagaactctgcagactgggaaacccctgcaacctgccactgcaataaattagatctgccacttgcagaccctagtaggcaagtggtattaactagacttcaatagctatacaagaaagatacatgcacacagtacacagaaggctgtgcagtcataggatccattttttatgggaagtgttcccttctcccagacatttagcaaagaagtgattctagaacagcaatcacaaaggtggagatgagcgaagcaaaatcctaatttatccaacccttttattgaatagctgagcaaatgtagtacacgaaactaggggaaccattaaatgtcacaaattcaatacggaagccaggtagaaaccagacatctttggccatggcttagggtcttggatcagtaggattttgcctctccattggaatggcatcttactctgctgtggcaaacaaagctggatcccagaattcaagcatcagtctcaagtgacttgggaactataaacggctcttttaaaggtgatcataattatttccctctttgatagagcacaaagggggtgccctgtctaacactcccacaagatcttggcacaaaagggatgaatatgcaactttggtttctcgctggcatttaaaagccctcatttaggagtaggatttattaaatattataatcagttcagtgtcgcctgctgaaacatttactttaatgggcttgttaaatttagattatgttaaaaagaaaaaaatttagattatgttaaaaggaaaaagagagagtgagagaaagaaagacattcccctgtctctgaactcttgggctgccaaatcctcattggatacatactgaagaaatagctcccagccatgataattacccggattgcgggaggaagggggtgacatttcaagatgatgtgagaggacgttttgtttggtaaagacaccctcctgatcaaaacctctttattttggaaagagcaacataaacctttcttttttcctttctgcttcccatccttcctttcttaaatggtattttaacttaattttaatcacatgagtaacacgtgatatttatgttagtttgtattgtgttgctataacagaatacctgaggctggctcatttacaaagaaaagaggtttatttgcctcatgattctggaggctggagagttcaagatggtgcagctagacctggtgagaacctcatgcttcttccactcttggcggaaagtggacaagaaaggggagtgagcatgtgcaaagagaacaaatggtcacagtggaagcaagagagagaaactgaggaagccagagtccttttaacagtctgctgtcttggggactaatctatttctgaaagagggataactcactcacccccaagagagtgcattaatctagtcatgagggatctaccctcatgacccaaatgcctcccactaggccctgtttcccaagactaccacattggaggtcagctttcaacttgagttttcatggagacaaaccatatccaaaccaaagcaatattaatagctgacattttttgatgccttgctatgtgctagacactgttctaagcatttacctgcattgatattttaaatcctctgattgcattattaagtggtattataattattgctatattacaggtgagaaaagtggagcatagcgaggttaggcagtgggtcgaaggtcacatagctggtaaatgacaaagccagtattcaaactcaggtgcctgacactgaagattatgcatctatctaactgctatgctatactgcacagatattcattcacccatagaactaaagtttttccgtataaagccaaaattttctttaatcaacctaatccctgtcttctccttataccccatattagccattaccatcagcttgggaagtgttccccatgtctatgaaaataaataaaatcactgtgtgtattaaagcaatgatgtcattctgtatcattcttgtaactatttcttcagtcaaaaatatttcattttatacctgtataatattctattctatttagctactctcttcttgacagatattgaatttaatttttaaaaaagtaaataatgttcagtgtatatgtaagtttgtctttagggaagatagaaaaaaatggaattacttaggtcattttttgtttttgaacagatattgccaacttaatgttcttaatggcagtacctgaacgttactattacttcaatctctctttttcataattaaactgaaaaacaaacaaacaaccaaccaataaaaaaaaaaaaaacacttggccagccaggcgcagtggctcacacctgtaatctcagcactttgggaggccgaggcatgcagatcacaaggtcaggagttcaaaaccagcctggccaatatggtgaaaccccatctttactaaaaatacaaaaattagccgggggtggtgctggcacctgtagtcccagctacttgggaggctgaggcaggagaattgcttgaacgggaggcggaggttgcagtgagccgaaatcgcgccactgcacttcagcctgggtgacagagagagactccgtctcagaaaacaaacaaacaaacaaaaaccttgctaaccttatgggtaaaaaatacaagtgcttctctctacccttctgtgagagttaaccaccttggctactgcctttcaatgtgcagttctacacagctgggcctactaacggtcaagttcaggttttccttggttctaaggcaagtttggcaaaaaaaaaaaggttatttatatctcttctctactttgagtcctggcaatttggagccaagttgtagctgttcaacattctaggctatgagacccctcacccaccaagataaaaactatgttcaatttagaagcaaaatcaaaatctcccactctttggtgtattcattaatgttactatccagccctgaacttgacaaacacttaatgagaactttctatgcgcagacacagtgccacgtgctggggaaacaaggatgagaaagataaatgctctcccatcctcatagagcttcatgtgtctgtgattgtccagttcatagaatcgaatgtccacttgggtcttctctagtttataaaaactgttccccactcaccttccatgaacttcaccttgaatccaagaccacgtttttggggacctggtgctttacaaagcacccagtccacatctatgagggttgcctactacctccaacctccattcttcttgtgggacttctacaggatctatatgaatattttagaaatactcagtttagatttagatttgctattattgtgtcaggtctgttgaaatagtttagtatagactggtcctaaaccttgaaatgaaataccctttctttctactagaagacaacttttcatgagtctcttgcatttctgcctaacttgagagcagatgaactgacctcaaaaaacagagatggtgtggtgtaataaaaaacatatttggccttcatccttggttcctgatgcagagcttctaaaacccttggaatttcctgagtcataggagcatcttttgttcttcataacaagcccctttcaacctgagtttatgctactgaagtgactcttggtgggcacctgcgtagcttcaggatggggactggttgccagaaaaccatatgattagagggttggaacttccagctctacttctgacctctagggaggggagagggttggagattgagttcaatcccccaatggccaatgatttaatcaattattcctgcataatggaacctccataaaaacctctaagcaatagagtttggagagcttctgggttgaacacatcaagatgttggagggtggtgtgtccagagagggcatggagctcataccttgtctcatgcttctcttccattcggctgttcccaaattgtatcctttttaataaactggtaatagcaagcaaagtgctttcctgagttctgtgagtcatttcagtaaattattgaatttgacatgggaagaaaggtcatggggcttgtaactggcattggaagtggtaaataatcttgtgggatggagctcttaacttgttgggtttgggctaacttcagatagtgtcagaaatgaattgaatcattgggtgcccagttggggtcagagaattagagaaatggagaattgcttaaaaggtatcccaggaaaaaaagaacctgagggatagtctccctctggagcaatgggtaggtaggcttaccacttgttataaaagatatggattccttaaactcagggttcttctccagtaatgcaaccttctgcatatgcaaatgtcatttcatcctctctgcattatcctgtaaaaattgagtctcatgggaccatgatacatgctgaagggttgttcctgattattgctatgcttaatacactttatttctggctcaggagcctctgtcttctaccagcatcaatgaaactgtggcagtttggcttgctagcttgcaaacagggaaatgtctgagacatttcacagttactgacacatgtatttacccattaaataaaatacttattgagtatctgctatatgacaactactaggggttcacagatgaatcagatagtcaggtccctgctctcatggagtttccatgcacagtgaaggaggcatgcaaaatagaagcatttatggattgtgaaatgtgctaggaagggaataaataagtgcagtggtagagaccaacaggtatactagggtaggttggtgagataaggcctgtctgtacagatgaccacattggtgagaattgagaggtatatttgtcattcaagtgctccaggaaacacaaggatggaggcactgaggtgggatggagcccagtgtcttccacaagctgactggtgacacaagtgaccccatagtagatgaaagcaagtgagtcatatgaggtgatcagagaagtagcaggaaacacccgtccttgaactcacagtatgaaggttgtatttcattcaaagtgaaaatggaaatcatagaaaagttcaagccacagagagtagggaggagcagcaactcatttacatctcgtaacaatttctctggccacctagtaaagaaaggaacaagagtgcttctcctaggacctcctgtctggaccacccagtgccttctctgagcccagcctcaacttcccctcttcccctcccccggccctgtgagtgcgtttctgacccacctctgctggctctcccattctcccttctcactgcccctaggttgctgagcaacccagaatgcctctcacctcagtgcgcagggaacaatggtttttcagctcagggcttgagaagggcaaagagggaatccaaaagcagaaatatgggcaacccttcagaatgggccattgttcagctgggagcagaaagggatttgcaacagacaaaaagagaaggtacaccttttgtcaggaagggattgtaaaaccatccatgagaacacatgcccaaagcattaaaattgacatcacaaatacggttgatagaacaagacagcgggacatattgcaaacagaatgtgacagacaatgtctatgaagaaaacaatggtcaacaaaacggtgccatacacacattataaggagatattatgcagctaagtgagaaggacaagttgcaaagtcctgtgtgtaatatgatccatttaaagcaaacattaacgacttgaaaagcaagtctatgtttatgtgtttgcatatatatataaaatcatgaagaacagtgtgaaaagttaccttttcagaccttgttggaaaggtgatcctcaaccttgactaaatattagagtaattctaataatttctaataaaaattagaaaatttccttcatagctaccacaaaggttaatactacgaaactaaatattttcaataaaattcttgtttttaaatagctttagattataggaaagatttttgcaagattagcatacattatcatgtatgtccttcatacctatggtatatttgtcgaaactaaggaacgaacattgatatattatcgttaaccaactccaggctttaatttgtattttaccagtttcttccactactgtccttttttctgttcgagaatccaattaacggtacaacactgcttttagctatcacgacttcttagtctcttctggtctgtgacagtttctcagccttctcttaatttcctcaccttgaaagttttgaggagtactggccaggtattttgtcaaatgttcctcaagttgaatttgtctgatgttgattcataattagactgacattatgggttttgggaagtaccaagggcaggtcatttgtccttcttagcacattctatcagggatttgctaccaacagtcactggtgacattaaccttgatcacttggctaaggtggtgtctaccaggtttctcacctgcaaagttactatttttcctttccctttccatagcctattgtttggaagtgagccactaagtccagtccccatttagggggaggagtttaactacaactcctaggtaggggaagacatacatttattacttggaattgttctgtgaggaatatttggctcttttttctcatttatttattatcagcaaaaacttgtgtatgtttattttatactttaggttttattccaatgctactttatttattttgtttctcaaattgttccagtctttggcactgcagtttctttccagttggctctggggttcccttcgtatccccttgcctttttttttctttattaccactctcttactttctggcactataaaatactctagtctcatattttgtatttccttccccagctttagactcagacatatctctgagaatggtatttagaaaccaaggtctgggaagaggcattctcattgctataggggtgtcacagcttctgagacttctctgtggatagaggtaggaaatatatgtgtatacaatccaggtgtacacacatgtctagaattattgttgaatctcaacctctctgtctttgtaaacacacacacacacacacggagcactaatgaaggatatttcgttgcttcattagtaagaacataaactcacacattcatacgtatatatatacaaatacatatatgtgtatatgtatatatatgtatgtgtatataaataaactcatacacgcacatatatacacacacatacacatataaacacacacacacagagggaaggggaaatagatatttgttgttgctctcatggtttaaattaaacataagttcatactgatgtcttcaactctaaaccaatactcaaggattcattcccctttccttcttgcttgtttgtaatttcgtctctgatagtaaaaaatttggctgttgttatcctccatttatttacttacttgcttaaccctctattagatgtaaaatactttgagaattaccaactgtaggtacccctatgacaaacaaatttataaaataaagttcaatgtttctataaagttctttttgtccttgaccttacagtttccagtcaaaatgccattttccaaagtcaccgagatcaaattctgtttatatcacttctggggaactttaaaaaaaaacactgatgcctatagcctaacccagatcactgaaatatccttgaaggtgagtccctagcctgaacagttttaataattttgaaatatacaaggtaaatgtttttatcccaaaaaatgcatgcaagatgataaatttatcaattagattgatgaaatcattccacaatgtaaatatattgcacaatttaaacacaatgtaaacattgtaccacacaaatacataatttacacaagtattatttgtcaattaaaactaagtacattaaattaaaataaaataaacattttaattatccccaggaggagcaatagcttcaaacccattgagaatcattgagaatcatcacttcagaaattagaaacaaagagtttcaagtattgttttatgtatttcattgtttcattaattaataagaacataattcatttgtaatttaaaacaaaataagaaagtaaaacttttttttttgataggatgagaatagcagtcacagaaaccaacccctcttcctggtttttcctcttaagggctgtgtgacatcagaaaagcaatttaaacactctgagtctctgcctctttgtctgtagattcgctctaatgccactcatttatcttccttacatggcttttcctcacatcccaagccagctgagacaatgtctgtgaacacatttcgatgatcttgaagaactattcaaatggaaagaattgttgttactaagttatgtcacctaatgagttgttcttcagacccttgagagctaaggaagactctgtgacttgcataattgctgtagccattacccacatcaactggcctgacatggaggacaatggccaaccgggaggagaggaatggagcagatatggagaaaagagaagcaccatgaatgatagcacacaaaagacataagaaagagaggaggtcgtcttctgatttgccttggttcctgaatagctttctaggtctacttataacctgtgaatctctccgctatccagtagagctactgtatattttgtattatttccagggatctctaatttaatagtgcactgggtttctctaatatggtagaaagtgataacaaatttgcatgttaatcctcacgtatgccgattcagccatgattaatccagatgaaatattgcaaacataagcagacctgaagctgaggatttatctactttggcaccattagaattgtaggctgagtagccctgtgtttggaggcttttgtgtagataggctgcttaacattacccttggccattctggtctaccaggtgacagcagcagtccctcctccagtgtgacagccaaaaaagtgtctccagatattgctaaatgtcccctaaaggaaaaagagtctccgtttgagaaccactgctctagtgagaataaaaatttttgttcttattaaataactaatataatgttatatgctggttttatcctttcaaaaattgtgatgaatttttcaaaaactacaaaaaacttatacttgtagacactgaatgaccacaaagaggtctgatgatgatataaggtgaggagacacagctccagggagaccgttttgaatttttcatatatattaataatggataaaggaaattgtctcttattatgtgagacagctaccattgtagtcatatttttatctgcctccctatcccatactaagtggagaaaaatatctaaagggagtacatttttctgtgaatataccagttttatgtatattctttctaagttttaggttagtttccttattcttatggggagatacctgaatcatcttcaaagcactatctacttcaatgaagtcacgtttgattctaggtgaaaaagacattcaagtctgcaaacttggcttgttcaaaatccaaattggctcacatactagaaaagcaatagggaatatattcaggtacagcttgatccagggctaagcaatgtaaccaggactgggtttgtctctgtcttttacttttgctatcatgttggtttaattctcagactcagtaatccagcctctttgtcagaagacaagatgaatacagcagcccctcttcccatgctatcaggttcattcccaatgagaaaagaggactcagctgtctcccagcagcaaaagaccctctgtttctctggtttgctttcatttgtcattgaatttgggtcaccagcttatgcacatgccattattgaacgagggttcaagacaatggcttatgtgccagttcctctaactggttcagaaaggagaagaggagaaaaatcctcaaatgaaaacaagagctggtactggaagaaggtggaatcatttttggaaggtcaaacaacagaagcctgcttctctaacctagaatatatttataaaaaaagttcttagagacttaataatgggatggccacattttataaatgaagacatcaggtctcaaggatcttgagagaagcaacaactatagtttgtagcagagaccaaacactaaccaaaatttagctaccaagttttagatgacggaatccaaatttccaatattcaatgagtgatgacatttatactggactcaaagaaaagtgaaaacattttcttacacattcctaggatcattttgttttatacctgttgtttatttttaaatcttacttgatcaaaaagcaacctgtggtgcttgcaagaaaaacagattctcaagttactctcccatcgattaaaacttacaatgccaggggtatggtgaagaaatctgttattctgttatttagctagtttgtggaacaatgcatatgtcagcagttcacggcctcaggtgaatattaaaattacctggggagctgacgatgactggtctctcaactcagatcaattaaatcagaaccacctggaaacaggacttggattttttttttttccctctccttttttaaattctcaggtgattccaatatgcagccaagtttgagaacaagcatcttgtgtcatagagcagtggttctggagaactcgatataataaatacaggagcttagttcctaccctacttcagtaagtctgagctccccttttggttatgagcattatgggtgattcttatacatttcaaagtttgaggaacacttctcagagccttactaatcagtgtggtccccaactggcagtgttgacatcatatgggaacttcctagaaatgcagcacctcaggctccacctcagatctactgagtcagaatctgcattttaagaatattccccaaatggtttgcaaacattttagggtttgagaatctctgctatagccctatctttgactcccaacaacaacttaagcccatatgaggagatgtttaagaatatcaagggaaagcgttagcacaaatacctaatgcatgcagggcttaaaacctagatgatgggttaataggtgcagaaaaccaccgtggcacatgtgtacctatgtaacaaacctgcacattctgcacatgtatcccagaacttaaagtaaaattaaaaaaaaaaaaaatatatatatatatatatatatatatatatatatatatatatatatatataaatttccaagcctcactccaagatattctgattaattgggtggcaccttgggccttttatcaggaattctttaaaaaaggttcccaggtgattccaatatgcaaagtaggactaagaaccaccattataggaaaaagtatgctactcaataggatccagttatatttcagctgcaatgtttattagctttacaactttggataagttatataactacataccattagcctcctaatctgtaaaatagacacatatctaaaataccatttctagaaaagtcttgcaaatggaactcctgacacattctgccttgtcttccttacaaggaaggactgttttgcatgttgaagtttaaaataaacacaaaaacgcctgcagccaaacaaagctgaggaaatcagaagctaaaattaattttcattaagtaaaacaatggccaagagattttcactttctattcctgattcctgctttcttcgtcatctaataagcccagatttctagaaggagagctgagttaggctgtttccttccctagatcctgcagctgttgaaatatcatttttttcctccctaggtaaatcaaatggtgctttatgcaacagtgaatttggttgccagtttagagggaggtgttgttcttccatgaaccctttctgagtcttttttctcattaggtgcacatagcaatgaggctgactagagcaagcctaatgggcaaggaaagcttttggctttcaagctagattgtcaataggcatgtttgatatggctgcatttctgacctaatcagctgccagcagtctctccaccgagttccctcggggcatcagagcaaactgtattccacaatctaacagcttaaatcagctccaatctcaaggagcaggggcccgaagaaaacaaaatgttggatgaagcttgtatatgcagagaagaacctttttgatgagggcaagtgtgtttgcacaatatctaccccttgcctgaaaccaaacccagagcctccgttggcggaatgatgtttgtgagaacaggtgcatctacattcaaattaaatccacaggtcactcggcattcagttatttttactggagaacacccagtgaagaactttgtccaaagcattgtaagaacagaacattagcttctctatgtgtgctttggtcaggcttcagccctagttaaatatcaccttctatcttgaagatgctctggctgtggctgcatttgatttaggcacagaagggtgcatgccaagtatttttgaattagtaaggatgctttcaggtgtaatttaccataaacataaacaagttaaattaaatatggacagaatgtacaggctcataaaaaagggaagtctacagtcattaggtttaaggcatagttttttttttttaatcaggataattcttcaactgctgtcaccctcttagcttgccctactgactttgtcctcatggtaggaacatagttgagacagggctagctttcatatctgagtgagccctataagagcctgagagagcttctctttccccaacctttaaaaaacaaaaattcctgagcttcactctgattggtataacttagtttgcctgcctaactctaagtcagtcatgttcaaggagaatgaccttatgctaattaacctgacggtagagtcaatgccacccaaaccacacagctgcttctcaatgagataagtggatattgaggagaatagcagaatttcttacatagttacttatttttctcaaggaattaatagtagttattatttttaattggagagaacttggggatgtgcaagctagattctgaaaccagttccatgctggctttgagaatctcttctcaaagcgagacatgtggaaatacagctgacacattccgatctgagaattatcttatggtgacacaaagcgagattttgaggggtaagaggcttggaagaggtttgaggggtggccactggaagccttctgagagggttgaagtgtgtgggatacaggaaggtggtaagtgtgtgtaggtgggaaagtagaagaagagacaccccgagtttctttattgatggagcatattagctcctggctcacaatctttcttcctgtcttcccttttcatcattctgggtggcttacaagctcatgcacgtgactggtcatttactggagcaaccaccttattttacccccacctctgccgccccctccaggtgttcccaccctgaactttactcactggtgactttaccccttctccacttctaagatatatttcaaacaattcgttcttacattatcacttaatattccttcccaatcattccagggccctcagtgcaataattctttcatctttataatcctccagcccattggttgtatcaccttttcattattcattaatctgctcttaccttctcttgcccccttcatcagcttagatttcatgacccatttttataatgactacctttaaaacatcttaaatcccaggcctcgcttttcttttatcttgttcagatggctagctaaacattagtgaagaaaaatcaaacaagcagaccaactagtttcacttaaaattcgtgaccacagacctcacgtgcatactcaatactgctctgacatctgacagtgcttctccaggcagattacctcctatcctccagatggaaattttaaaatttctctactctcttcaaaccttgcattcctgctctccataattcttactctcaagtgatgatgtaaattcatgtattttgagaaaatagaagtcattatgagaagtcctttattacctcaccacaaatctacccataactgttccctcttttgtagattttccttttgttgagatgagggatatagagaaatgggaggaatgggagttaatatttaacagatatagactttcagtttgggataatgacgaatttctggagatggatagtactattggtgatacagcaatgtgaatgtacttgagaccactgaactctacactttaaaatgatacattttctcttatgtatattttaccacaataaaaataggtcttaattacaaaggaagaagtagtaaatttagagttgagaacccatcaaaaacaaacaaacaaacaaacaaacaaacagcaggtgcaggaaatatcctccctccatttttaggccaatcttttacagtctggatttattgcctattgttttatcaaagactttactcctttagttagtctccaatgtggtggttctctgttccattctcttaccctctctgcatgctgggaggctgacctctatggaatacatcaaagtttgttaggtttggccagctggaggcacaaccaggagaccacagggcatgaggtgtggtcatgaagattgcagtctccatatttcacattctgagtgtcctgaccacacatctgacaatagcagttttcctctatagccacagcttttagtgaacagcccttgcttttttggcttcgggtttcactgtttccttggtcttctctctttcagacctgcgtgtgcctttccttcatggctacccttgtgcttcatctgccctcaccttgctaagtcatccttacacttaccctttgtgtgtgccgagtgcttctcaccagaactctgaatgatattttaccctgttcttcatcattttctttctttctttttgtttttgatggagtctcactctttcacccaggctggagtgcagtggcgtgatctcggctccctgcaacctccacctcctgggttcaagagattctcctgtctcagcctcccaagtagctgggattacaggcacctgccaccgtgcccggctaatttttgtatttttaatagagatggggtttcaccatcttggccaggctggtctcaaactcctgaccttgtgatccacctgcctcagcatcccaaagtgctgggattacaggctttttcatcatcattttcttcagatccacagaatcattcccagactcatgtgtacatgtcctaataatttccatgaaacaagtaaaatatttaactgtcaactgacatgatactccactaaaagcaatcaaaaaagatgaataaaatacaaaacaaacacctcatttatttgagggtagaaaagagccatggaggcagccaagacccaatgagccaaggtcctggagagttgggaacctttagagagaagctaaattttctacacttactcatctctggaggtatttgaagtattacaatagcacaaaggaagaggtcaagaactggagcagaaagtgacagctaaatagacctcttgcagtctcttgggttgagattaatgaaaagtggggttcaaagttaccaaagtgattagcatttgagggaccaagatgtcagtgagaaagaaggctcagagaaataggcatggaactataggccatgcttcccccagaggcatttgccaacctataaacgtcacaggggcaatatcaggaaatgatatgtacattttaagaggccgagaatctaagcacatattttgacaagttcacagtgctgcaaaaccaaaattgaagttcagggtcctgcaagctactcaggaatctctcatagaaactcttgaagggctgtatcctagggttaaaagtaaactagaaataggacctgtctgaaactcagtcttaaattagcttaacccctgactgaattaacatgatcaaccacaatctaactgccttccagtggctgaaatatatactctggagaaaaataccatcatctagagactcaacatcttttcttttctttctttcttttttttttttttgagaccgagtcttgctctgttaccaagctggagtgcagtggcaccatctcggctcactgcaacctctgcctctctggttcaagcgattctcctgcctcagcctcccgagtagctgggactacaggcacccgccaccacacccagctaatttttgtatttttagtagagacgaggtttcaccatgttagccaggatggtctcaatctcttgacctcatgatctgcccacctcggcttcccaaaatgctgggattacaggcgtcagccactgcacttggcctcaacatcttttcaaatgcaatgtccagcattcagttagaaattactaagcatatgaagaaatgaaacgaagaagaactctagtagaaacaggctcacacatgatgcagatattgaagatggaacagaacttgaaaataactctaacataactctgattaacatatttaattaaacagatgagagggtgaataattttgccagagaattgaaatctattaaaaagtatcaaatcaaaaactgaaaaatgagaaataaaacaacaaagtttaagaattcagatgaatttaataacagattagaaccaactgagggaaaagtcattgaactgaaaaagagatctttatttaaaaaataaatatatgtaatatttattttttaaataaagatacaccaatatatacacacatatatatgtgtatgtatctatacatgtacatatatatgtactgagagagagagagaggggagagagaagacagagagacaaagagagagcagaataactatttaaaaagatagtaaagatttttccaaaataaataaaagccatatatttaaaaaatgctaaaaactccaagtggaataaaaacaaataactactcatgtaagctcattgtagaaaactgctaaaaaaatacaaagataaaattacaaaatcggctgtaatgagaggtgtgtgagggggtgagtagattacattcaaagaagtaacaataaaattgatgctccaattctccattgaaataatggaatttagaagataatgtaatgatttcttcaaagtgtcaaaagaaaacgattttaatccttatgaaaatatccttcagaattgaaagggaaataaagactttatcaaagaaagaaatggaaagcttgtctctagagcagatcgcaccaatgactgtgggtatacaaggtaaggcttctgagtcgctgctaatattctgttataaccctgagtagcagtcacacagatgtgttcattttatgtaaaatgtttcatctgtacacctatgatttatgttctcttctgcatatgttatgcactttaacaaattgtctaattataaatccacaatccctttcctgtaacatcttatttatttactccacttcatagcaaaacttcttgaaaacatttgtctagtgttgataaatcaacttcttcatgtctcatttttaaaattgtattgaacttcaggtttttcttttgtaattttttaattgacatgtttgtaaatatttgggggtataatttaatttttgatacatatatgttgtgtaattatcaaatcaaagtatttagcatgaccatcaccccatatatttatcacttctttgtggtgaagatattcaagcctctcgtatagctgttttgtaatacacaacaacttactattatctattctcattctacagtgtaataggacatcaaaacttattcctcctatctgactgtgactttgtacctgttgatcagcctcttcccatcctcctcctctctcctccccagtctctggtactcaccatcctattctctgcttctatgataccaactctttttttcttagattctacatatgagtaaaatcatgcctgtcaccatatacaaaaatcaaccctcaaatggattaaagacttaaatgtaaaatctaaaactataaaactactagaagaaaacatacaaaaaactccttacaatattgggctgagcatggattttaaaaataaaaccttgaaagcacaggtaacagaaataaaaacagacaaataagactacatcaaattgaaaatattttgcacagcaaagaaaacaattcacagagtgaagagacaccccaaggactggcagaaaatatttgcaaatgtacatctgacaaaaagttaatatccagaattataggggactgaaataacccaacagcaaaaaaacaaaaaacaaccttcccaataaccaaatttaaaaatggaaagaagaccttaaaaggtacttctcaaaagaagacattcacatggccaataagttcatgaaaaaatgttcaacattctttcatattataattgaggaaatgcaaattgacctagtttccttttctacaacttcattgacactgttcaatgtcatcattgccctcccctatgatgttgcaaaatgcggaggatacatgggtccccatctttgcatttcagaataatttaacacagcttaccttctgctcaagacattttcttctctgagctgctgtgataccatattcttctgtttttatttccaatctccctggctgcctcttttcatatttctttatgcactcacacttctctgtttgacctctacatgtgggagcgccatggaaccctatccagatgcttgtgtcatttctgatccaaattctattctacatttatatctccagtttagacttgaaagttgagctctagacatgtacatgtaattgtgtgtatcaggggtcagcacactttttctgtaaaaggccagagaataagtaccttagcctttgcaggccacatggtctctgtcacaactattcaactgcgttgagtgcataaaagcagccatcaccaatacataaatgaaagaatgtggctgtatcccataaaactttgttaccaaaacagatgacaagcaagatttggtacaaggggctatagttcattgatccctggtctatatacattcttgatattcactcttgatattcactcttgaatcactaataggagttttgatattaacaggtttgaaaggtttctccctgtgatactgaacttgatgtgtcaacttggctggggcacagtacccagatattgcgtcaagttttaatctaaatgtttccgtgaaggtgatgtttaagtaaggttcacatttaaatcaattgactttgagtaaagcagattatcctctataatatgggtgggcctcatctaatcagtgttctagaaagaagactgactttcttggacaaggagggaatttagccagaagactaccttcagggtcaaacaataactttcccctgggtcttcagtctgctggttacctggcagagttttggacttgccagcctcttcatttatgtaagccaatttcttaaaataaatttaaaatatctctctctctctttctctctctcacccccaatacacacacacacacacacacacacacacacacacacacacaacactattgcttctgtctctctggagaatcttgagaataatacccttgcaaatctctgttttgtaatctttcctccatctccaccatcatcgtgattcaagtcactattatttccacctatatagccttgatagccaatcaattggtttccctttaatctctgctccacagagtagtcagagtaatgtttgtaaacacaagatcctgttcctcttctgcttaaaacttctcaaaataaaacccaaatgttttactaagatctgctagcatgtggagcagggagataaaggaaacagaagcgtgctcaccctcttaaatgggactgctattctttggctccaacatacacagcaatgtgggcccagtgtggccagaccttttgttttctttttaaaataaaaagcagccatccaggtttctttggtcttcataacttctcagactcctcatcggggtttttaaagctcttttagatttcagttctctctccatctttccaaattcttctctcccacaccgcggtctgcatttctccctccagccatggtgatctaactgtgattttccttctgcatccggctgtttctcacctccaagcctctgcaccttctgtttcttgtgctcaggcttccctccacctcccacccttttgttctcatggttgatgcttcttctcctatgccatgtattccatgaagacgtctttgactccaccacttcaagttgagttcactgtccttccccggggctaataaaaccgctacgcctccccatgagagcaggcttttatgcttcctttccattgtctctgccagtagactgtgggctaactgctcaagtacatgaacactgtcttggattcctttgtgttcaatacaggaatagccatgaaagaattccagccctgctcctaggttttgaccggttaacctgattaatatgtattgccacgaggcctctgtcgctatccaaggtgctggccaccttaccttggtggttccagccaaccttccttaccagggctagagtgtgatcctctctctgctcccagtgctgtgatgctatctgctcatttaacctctatattactagggtctgctacaccacaggctgctgatattaagcttatgcgttaatacaaggcctcagttgcttatttgcacctctggggtcagtatctgcagccagatcgagtttctctgtcccagttctgacctggaaggtaagccctctgacccatttcagccaaggcactctctctttctgcttcttatgtaaactacatgccaatcctcacacctgtctccacttggtttgagacatgatcccaattctcactcctgagaatgtctaagaaatagttacacaattctttttctactggaggaggtcctttgcatgggagaaagttcaggttaaaagcacataatttattaatatatttcctcagacctaagtttataccctagctttattaatgactaaatatgcaaacttgggcaagctactaatgcctccgaatcttagcttcctcatctctaacatgggaataataatacatgcctcatagtgttattaataaaatggaagctaatgtgtttaaaatcacttagttcataagcttttattgtttttttaaaaggtattaataaataacagtacagcagtagtctcatccattgtcctagtctgagctggcctatctctctcattgtggaacatttcctaccttctcctactctctcctgacagctgcttttgctgctaataaatcctgcctgtgatatcacaatgcattgtagcagctggctcagagtcaagacatcaacacatgaatcagacaggatgagaggaggataaggctaaagacagaggctccagctaccttggtgacaaggaatggaggagaaaaggaacaggaaattttaataagattaggagggcttgcttttctgccaagtgaggtgggtttaaacttcttcctgtgttcactacctagtttgtctgagttaggcaattgcttgagggagaggtagctaatcaggaatttggcaaccaagaggaaaaactgcaaaataaatcgaccatctgatgttcaggaagaagaaggaaggaaagaaggagggagggagagtgaacaaaaggagggaaggagaaaaagaagcaccattccccttcctgacatgcctgccttggacacatttccagcatggtagaaataggcttcccaagactcacacaattaagaattagttttctaaaatttgatgtccataagagtaagttcaattccacggtggcacccaagtccattcaaaatattccttctgaactttccctctccatctctgggcaccccatctccatgtgtacatagaaagatgtagtaacaggccaggcatggtggctcacacctgtaatcccagcactttgggaggctgagatgcgcagatcacttgaggtcaggagatcaaggtcagcctggtcaacatggtgaaaccctgtctctactaaaactacaaaaattagcctggtgtcctggcgcacacctgtaatcctagctactcaggaaactgaggcaggagaatctcttaaacctggaggcagaagttgcagtgagctgagattatgccacagcactccagcctgggtgacagagagagactctgtcttaaaaaaaaaaaaaataaaaaaagatgtagtaacaaagtttaagtgtttactcagtgtcaggttctatatctgcattctttcatttagtcttctcagcaaccctggagaatgtcccattattatccttattttctttacaataaaactgaggcttagcaatattacattattttctacagtcacagatttagcgtgatgttgagccccacagcctgataacagagagtataatgatgattattgcgtcaataaattttttttttgagatggagactcactctgtcaccccggctgcagtgcagtggtgtgatctcagctcactgcaacccctgcctcccaggttctagtgagtctcctgcctcagcctcccgagcagctgggactacaggtgcgtaccactgtgcccagctattgtgtgtgtgtgtgtgtgtgtgtatttttagtagagacagggtttcaacatgttagccaggatggtctcgatctcttgacctcgtgaaccgcccacctcagcctcccaaagtgttgggattacaggcgtgagccaccgcgcccggcccagtaaattttttttaaaagaacaatactttatatgtgaatgtatgtatatgttgcttagtatgtatcagcctctgcccaagacaccagggatacagtggtgaacagaggtagagaggtagagagcacagaggtagagaggtcatacagctcttcaagatggaacaagtagcaagcagtagaatggggatcccaaccctagtcttcaactttcaattttatttttctattacactcagctgttctccaattcccacgtcttcatattcaaagacgctattaacctaccccatcaccaccacctggggcctgcaaagcaaagcaaacggagttagcatctttgtaaatacgaattgtctgagtcggaactcatcggacccagggaaatgccattccctgtttttcaaagagagtagaaatgctattgatctcccagagaaaacatgaggctcagaatataagcactgaagagctggttctcgcgccatgtgatccggccaggatgatttcccttcatagatcctcatcggtagattgagaaggatggacgagctggttcccaggttcccttagcctttgtgggaagaaatgtgtttgcagtagttccctaaaactattagttcaaaactcttcaagacagggagtttaatgaaaagttagggggacaaaagtttgactaacggaagcacagtcttttaaattcctcttactctgccaatcttttgctgatcaatatgctggatcacactctaaggcgtaattggctgcaagattctcctaagggctttaaaattcagagcccactgggaggctgaagctggaggatcacttaaggccaagagtttgagaccagcctaggcaacaaagcaagattctgtttctactaataagataaaattagcctggcaaggtggcacacacctgtaaccctaactactcaggatgctgaggtgggaggagcacttgaggccaagagtttgagaccactctgggcagcataacaagatgcttctctactaaaaaataaggaattagccgtgcatggtggtgcatgcctgtagtcctagctactcaggaggctgaggcaggaggatcacttgagcccaggatttccaggctgcagtgagctatgatcataccatgcactccagcctgggcgacagagttagaccctgtctctaaaatataaaataaaataagaaaataaaataaaataaaaaaaaataaagacatccaagctttatcaggagagaatacacataggtaattgtgttggtgaatttctggggcttcattcaatagaaattcttctacgacaacagtcatccttagctttctcttctccagagtctaggtgcagggtaggagttaaaagcttgaattcacacatcagtcaggaaagatctgcgtaaaactgtcatcccttaatttctcttagcctgtttctaaggggatatttctatgaggataattatagtacttccctctttgggtatagtcaaaccagtttatgtaagtatagcttagcccatagcagaaaggtaatgagatgttcaactgatcaataatgaagtctacagggtaatagatgtccctgagctcctcagaatattgtcatactgacttagatagttcattaccacattccagtattaacatgctgtcttaattgcagagaggccctgttactaataacaatatttagcaattttttttcttttttgagatggagtcttgctctgttccccagcctggagtacggtggtgccatctcggctcactgcaacctctgcctcccgggttcaagcaactctcctgtctcagtaccctgagtagctgggattacaggtgtgcaccatcatgcctgactatttttagtagaaacggggtctcaccatcttggccaggctggtctccaactcctgactccaagtgatccatccacctcggcctcccaaagtgcttgggtaacagaggtgaaccaccatgcccgacctatttagcactttctaactggacagagaaagagagagagagagagagagagagagaaatggaggtgggagaaggaggattttgcagtgtgcttggctggaaagccagctaggcagtaagaatgaaatgagccatcagtttccacaagaactgttggtaatgactccttcttccctcccttctggctggctgtccattttgttgagggctgggttgtttatatgagaaaaattctggtcctgtgttagaaggcatgcttgctgctaaagacaggtgctgatagaacagtgcagagggcatgatgcttatgaatggagtcacaaaatatcccactccactaaccctgccccacacaccagcatcagctgcttgattgcttataagctcacagttctagcagagatcagaaacttggaggagatgtcagtggctctgagaaccaactcacattacttatttatttccccccaaccattgttgaagagtatttagcaagtatatttcctgaaggtggttctttttgtaagaaaccccaacggtgatttaattaagcctacataaatgctaagtgggattcaaacagaatgggatttgctgatttgtctgtgttgaaataaattccttgttctgttctaattgaatagattgaacacagactgtatttgttcttatcctgcagccgctttcacaggagcgataaattggaaatgttatctggcttgatatgccagtttttctgagaaaatcactctgccagtggtgacagaatggaagagctgaaaacatcttcttttttcaaagtcatatgtcacgaaccaaggagactccaaaaaataaattatggaagattatgaccactgctgccaaggatacagtgaaataggtacatcttgtatgcccagtaatgttgaaaattaatataaccttatttaaaaagcaatttggagatgttgaaagaaagcctgaagattaccaccatgcttcatgattctatccaggtgtcccacatatgagagccaattccaaagaaataactacaacttggaaaaaactatatgcataaagatgttcattatggtgttagctatagcagcaaaacaaaaaaaaaaaacacagaaaatgtttgcaagaattcccaaatagaaaattattaagtcagctatgacattttcccagtaggatattctgcagcacttaatatgaaagtcactaagtttacatggaaaaatacctgaagcataatcttaagttaaaataaatctaaatatacttatatgctatagttgcactttttaaaaaatatgacagacagcatgaaatatccagaataggcaaattcatagagaccaaaagacaggcatagtggttgccacaggctggaggaagaaaagaatgtggagtgactgctaatgcataaaatgggtttccttttggggtgataaaaatgttccagaacaagatatgggtgatggttgcacaacattgtaataatataataatgtaataatgccactacgttgtacacattaaagtggttaaaatggtacattttatgttatgtgtatttaccacatttaaaaaaataaaatgacaaaggatgaaaaatgaaagtacctaaaaattggacagcatttgttttaggaggatgggattatgggtggattttctaagtttttgaaattttctgtaatcttggtattagagaaaggcagaatcagacagtattagaatgcagccaagaagcctcggggctgtgatttccctaaaccccatgcctttctccaactactgtagacctggatatccaaacctggaaactgaggcaaagccactgcaaaggactggacttatgagagaaacagcagggagcgggggaagaggggtagttaatgagtacaaaaatacagctagacagaatgaataaggtttagtatctgatagtacaacagggtaattacagtcaataataatttattgtacattttaaaaatataactgaaagagtatagtttgtaacacaaagaaatgataaatgtttgaggtgatggataccaaattgaccctgatgtgtttattacacattgtatgcctgtatcaaaatattccatgtgtccatacatacatatacctactatgtacccatagaaattaaaaatttataaagtataacaaaagaaagagggggggaataaactaagaaattcagtgtatagaaaattttcagtgcttcagaattgcctgcattcctcttcacaatcgttattcactttctcctcctcacagtgtaccatcataatccattataatacagtaccatggtgtagttttgtctgtttttgaactttatataaatggaaccatataaagggtcttctttgtgtttagcttcttccacgaaaaactatagagttatctatattatcacacatatcaatagttcatttctattatatcataatacattcataataccatatgaatgaaccagagaaatgacctgctttatgtttttaaagagtttgtggcatctggttttaactccaatatgtaaagagcttggaagccatctttccttccaccacaacaagaaaacagctgaactgaaaatcaatgacttttcttagatccattaaagaattgagattgcaggacacactaccaccctgaaaactggagagaggaaaaatacagagaggaagcagatcagcttacctgaagcagaggccgctggaatctgtgacaggtaggaacatttaaaccgtacctttgatgacttactggaagctgagtgtggaccagattgagagcctggtttgagggaggtctccacgcttctgtgtgttttatctccaggagtcccactaggttcccacaatgaagatcagagaaaaacagtgaaaaaatccctcacgtttgttcaagggaagagaaagtagccattctgatgtaagcccacaggtttgtccataacaaagatctacccaggaagggaaaatactttactagtttcttctcccaaatgaagaaaaagaaatacccaactccagctccctgtagccttcctgtcccactaaacagaagatataaagcttagaggcatcttagaggtaacagactccctaaaagactaaagcttaatcataggattacagaacacctcaccttttcccacatcttactgcattatagagctcctgtataataatagtggattacagctaaaagagctataagatttagttttatttaagaaggagtttctagggaaacccagagacaaccagggagacaaaaacaagtgtcattaaagtaaatgtgagcctctgactcctacagctgtataaaatggtaaacacaacctaactcctagcctgataaacagaaaacttcagtaaatgcatatccacctttgttgtcattatccaaatatgtcatgttcagtttccaacataaaactacaaaacgtgctcaaagacaaataaaaacacagtctgaaaagaaaaaacaagcatccagaccagacttagatatggaagagatttgggaattatcaagccaggtatttaaaataactacatatatgctaggggctgtaatggaaaaagtagacaacatgtaggattagatggataatgtaagcaaatagatgaaaaatataagaaagaattaaaatgaaatgatagaaatcaaaataatcacatcacaaagaaataaattgtgatggcctcatcagttagttgaagaaagaatcagtgagctggatgtattgtcaataaaaaattttctcaactgaaatgcaaaaaaagataaacaagccgggcacagtggctcacacctgtaataaacaggccaggcatggtggctccactttgagaggctgagacaggcagatcacttgaggtcaggagtttgagaccagcctggccaacatggtgaaaccccgtctctactataaatacaaaaataagctgggcattgtggtgtgtgcctgtagtcccagccactcgggaggctgaggcaggagaatcacttgaacctgggaggtggaggcttcagtgagccaagttcatgccactgtactccaacctggacagcagagtgagactctaaaatcaatgaatcaatcaatcaatcaatcaatcaatcaataatagaatatccaggaactgtgagacaattttaaaaggtataatgcatacaaagttggaaaaccagaaggaagaaagtagcagaaaaattgtttgaagtaatagtgatgggaaattttccaaaattaatgacagaaactaaaccacaggcatagtaatctcagagaacaacaaccatcattatcaaaatatctatctaggcataccatatttaaattgaagaaaactaaagacaaacagacaggcttaaaagaagcgagagggaaaaatcaaccaccttctctacagagaaacaagaataagaattgcaacagatttgtcatcagaaactacgcaagcaaggagagagtggaataagatcttcagggttgaaaaaaataaaactccaccaacatagacatttgcatcaagcaaatttttttctcaaaagtaaaggagcagatattctcagacaagcaaaaactgaggaaatttgttgtgagcagacttgcttacaagaaatgttaaaagaaggccaggtgcagtggctcatgccggtaatcccagaattttgggaggatgaggcagggagatcacttgaggtcaagagttccagatcagcctggccaacatggtgaaaccctgtctctactaaaaatacaaaaatcagctgggcttggtggtgcacacccataattccagctacctgggaagctgaggcacacgaattgcctgaacccaggaggcagaggttgcagtgagctgagatcatgccactgcaatccagcctgggcagcagagtgagaccctgtctcaaaagaaaggaggaaggaaggagggaagaagggaaggagggaaggaggaaaggagggaagaagggaagaaaggaaggaaggaaggaaggaaagaaggaaggaagaaaagaaggaaggaaggaaggaaaaaagttctccagagaaaagaaaaatgatataggtcggaaactcagatctacataaagaaaggaagaataatagagaaataatcagtgaaaggtaaatgaaatcttttatttttgtaatttctaattgatctaaaaagatagctgttcaaagtaataatagcaacaatatattggttgagtatagcagatgaaatgaacaggctggtattataagagataagagggatgaattggaaatactgtggtataaggtaccttcactacctatgaagtagagaggtattatttaaaagcataattagattattttaaaatgtgtattacactcaaaagcagccactatttttatcaatatataataattgtacatttttgggtggcagatgtgatattttggtacctgtaacattgtacaacatgtaccctgataccatgtaccctaatacaaatcagggtaattatattatccatcacctcaaacatgtatcttttctttgtgatgggaacattatagctttttctcttctagctattttgaaatatacaattattgtttactataatttccctactgtactatttaacaccagaacatattccttctatctaattgtatttttgtacctgttaactttttacctcccacaccccatcctccaccacatataattgatatgctaagagaagagggaacatggagttatatcaagtgttctattaaaaccagcaaaggcagaaaaagaggggaggataagaaagaaagagcaagtgcaatgaaaagagaaagagcaagtgcaatgaatagaaaaagctacaaacatgatagatattaatccaggtatatcaataataaacttaaatgtgaacagtttaaatatactagttaaaagacagagactgtcacattggattatttttaaaacaaagccaagatttatctatgtgttctctataagaaccccattttaaatataaatacacagatagattaaaaataaatgcatggaaaaagatatactattctaacacattaacactaatcaaaagaaacctggaggatctatattaatttcaatcaaagcagactttagagcaaataaaattgtcagaagtaaagaggagcatggcataatgataaaggaacaaattctccaagaagaaataacaatctttaaggtgtatacaactaactacagagcatcaaattacatgaggcaaaaatagatagaactgaaaggagaaatagataaatccactattaaaaccggtgactccaacacccatctatcagtaattgacaaatctatcacacaaacatcagtgaggatgcagctgaactgaacaacaccatcagtaactgaatctaattaatatatgtagagtactccatccagtacagcaggatgcattcttctcaagctcatatagaaaattcaccaagtagactacattctgggttgtataatacaccttaacaagtttgagagtgtgctgtcaaataacaatggaattaaattagaaatcattaacagaaagacagctcaaaaaatccccacatacttgaagattaaataacacacttctaaattatacatgggtcagagaagaagtctcaagataaatttttaaaaatattttaaactaaacaaaatggtaatattaaaatattaggacacagtgaaacagtgcttagaaagaaatacagagcattgaatatgtattttagaaaagaaaaaaaaggatcaaaatcaataatttaagcttctaccttgggaaactacataaagaagaacaaaataaacctaaagcaaacagcaggaaataataataaaaattaaaacagaaaatggtaagattgaaaactggatgttaatagagaaaatcagttcaaccaaaatcagtttttttagaaaaaatcaatgaaattcataaacctctcatcaagctaaccaagaaaaaatggaaaagacacaaattactaacatcagaaatgaaagagggaacaccatgattgagcccatgggcatttaaaggagaataaagaaaattatgaatacctccatgactccaaatttgataacttagataaaattgaagtggggtatttccctgaccccttcacaggacatgcaaaggggtgccttgttgactcagcctgcagtactcaactccttgtgagagggaccatgcaagcaaacgaggcaggaagtggagtgtgtggtcactggaactagacggctgctttggtgccagcagaggcaaactccactcacttggacctgctgggcttccccctttgtgggaaggagcacacaggtgagcaggagcaggagccagggcaagcaagcacttttgggagctggcaggagtgaactccacacagggccccatagcagcatctggcagagaggtgcccatatccccagaaaccccagaaaaagtcttacagtgctcttttagctctgttgactgcagatggcttaaatgttaccagctcagtatactctctgccttttctcatgaggcagctgccttccatcagtgagggcaaagtgtcagtgtgacagccttttgcatctagacttgtggtagctgagctcttgtctgaaatctaggagaaatgaagtcacacaaatgaatcgaaggttagtaaatgtggggaattttattgccaatgaaattgactctcagtgggaaggggagctgaaaaggggacgtgatggaaaagtaatctttcttgaagtccggctgtctccagccagattcttctctgaagttatgtaatcaagctgtccctctgaagtcaagctgcttctctctgatgtacaaccagagtctccaatgtccaactgcttctctctgccagctgggtctggggtttttataggcacaggattgggagcagtgtgggccatgggtggttttggaaaaggcgatattcaagcgggaaaacagggatgtaagttctcactttgggctgtggtttcaggtttttgggcttgagggtggggcccttgctggggaccctccctcttctacctagaatttccctgccttctgtccatatcaaaatcaatcaattccttgaaagacacaagctaccaaagctcacacaaagaggaacagataatctaaaggggtctatatctattaaatacaattttttttggttaaaaatcttcctaaaaagaaaaaatccaggcacagataattccattgcttaattctaccaaacatctagggaagaaatgataccaattttgtacaatgtgttcaagaagatagaagcagagggaagactttctaactcattctatgaaaccagcattatgttaagaccaaaaccagataaagacattattttaaaaaatctatacacccacgtcatagatgtaaaactcctcaacaatatcttagaaaacagaatacaaaatatataaaaaaatataaaatatacataaatatatatataaatatataaaaataattatacacctcaagtagggtttattctaggcttgcaaggctggttcaacattaaaaatcaattaatgtaatcaatcatatcaacaggttaaagaataaaaattgtatgattatattaatagatgtagaaaaagtatttgacaaaacctaacatccattcaaaatacaaactctcagaaaactaggaaaacaggaacatttccaaacttcctcaacttgataaaattatctacaaaaaactccagctaacttcatacataatggtgagaaacttgatactttcacctcaagatcagaaataaggaaataatgtctcctcttgccattccttctcaacactatctcagaacttgtagctaatggaataccataagaaaagaaaataagaggtatacagatgggaaggaagaaataaattatctttgtttgcagattatattattgcctatgtagaaaatcccaaagaactggacaaaaaaatccagaactaataaattattatggcaaaatcaaagaatgtaaggtcattatacaaacatcaatttgcccccaatatggtagcaatgaacaactgaagtttgaaattaaaagtaagatataatttgcatcagcaccaaaaaaagatctcacaaaatgtgtgtaggatctatatgagaaaaactataaaactctgatggatgacatcaaagatcatttaaataaagaggtgttcattttccttgatagaaagacttgatatagttaagatatcaattcctcacaactttacaatctgtagactcagcacaattactaccaaaatatcaccaagttattttgtgaatattgacaatttgattctaaagtttatatagaaaggcaaaagaaacaactatataactcaagactgaagaataaaaaagtcagagaactaatgctatcggatattaagacttaccacaaaatgacaacaatcatgttaacaaggtattggtgaaagaatagatgaatgataaatggaagagaatagagtacccagatgtagacccacacaaatatagccaactaatctttgacaaatgagcaacaataagacaatggagaaaggatagtcttttcaagaaatggtactgaaacttctggactttggtatgcaaaaaaaagagaatcttttataaaaattagctcaaaatagatgttacacataaattgcaaaattacaaaacttctataaggtaatgtaggagaaacctgaggtgaccttgggtttggtggtgagtttttagattcaacatcaaaagcacactcagtaacagaaacacaatacaagtcatgtatctgttaaagaacttttatccaaaatgtacaaagaactcttaaaactcaacagtaagaaaacaaataacctgattaaaaatgaacaaaagatttgaaagacacctgaaaaacatatacagagagcaaataagcacacaaaaagatgctcagtcccatatgtcattaggtaaccacaaattaagacaaaagtgatagtactacacacctgttagaatggctaaaaccaaaaaaaaaaaaaaaaaaaaaaaaactcacaacaccaaatgctggcaagggtgcagagaaacaacacttacttgctgctggtgggatgctaaatggtgcagccattttggaagacagcttgcagcttcttgcaaagctaagcatagcctcactatatgagtgtagcaatcacgctcctagctatttaccacaaagagttgaaatttatgcatgcacaaaaacctgcaatgtgaacgtttacggcagctttatttgtaatggccaaagtctggaaacaaccaagatgctcttcaataggtgaatgaataatctttagtatatccatacaatggactattattcaatggctaaaatgaaatgagctatcaacccacaaagagacatggaggaaccttaaatgtatttcgcttagtgaagaaaccagtctggaaagcctacacaccatatgattctaattagatgacattttggaaaagacattactatagacagggaaacaatcagtgcttgctgggggcttggtggaagggcacgtgcatgactcctgtagtgacaactcctgctgaaagcaggctcacaggcaaaaattacaaaataaattatattaaagactacataaatactgggagaatttactaccaaagggagggaaaagatgaatagaggaagcattagagattttctgcgtggtgaaactattctgcataataccataagggtggatgcacgtcattattcatttgtcaaaacccatagaaccagacaacataaagaaaggaacatcatgtaaacgaaggactctagttaatagtaatgtataaaattgtaacaaatatgccacactaatgcaagatgttaataataggagaaatggtatgctagaggtagagagtaggggtggggtgcatatatggaagtctgtattatctgctcaatatttctgtacatctaaaactgtactaaaactgaagcccatttaaaaaataaaaaataaaattagctgagtgcaaatgatggtttaagcacagcagttaaaaaaattaaaacaacaacaacaacaacaaaaaacaaaggtggggggctgggcacggtggctcatgcttataatcccagcactttgggaggctggggtgggcagatcaccagaggtcaggagttcgaggccagcctgaccaacatggagaaacctgtctctacaaaaaaaaaaaaatacaaaaatacaaaaattagctgggcgtggtggtgcatacctgtaacctcagctacttgggaggctgaggcaggaaaatcacttgaacccaggaggcagaagttgcagtgagcccagaacccaccattgcactccagcctgggcaacaagagcaaaactccgtctcaaaaacacacgaacaagaaaaaggaattctattaatttttttgtaaagcttgccacagctgccaaagtaatctataccttattcctgataagggatgccattggtaggtaggggtgaaaatatcttagaaatgcaaccttccttctaattcattaatatttcttttcagaggttttacgggtgctttagctgtctttttgtgtcttttttcacctggtgacaaagagctgcaattttcctacctatcaatttggcagtctgtgtgacatttgatggaacaacttatggagtatggtggtgcttatatttctatagtcagtcttcctgggttcagtttcagccccatgacttaacaagcctatgagtctgagttttaacaaatagcatagaggaaatgttaatatttacctcaaagattgttgtaaggattaaataaactaatctctggttcccattagatgtgttcaatagatgtgagctgttatttttattatttatataagtcttacccaatgcttacatcaaataggggaaagatgaaagattccagctcaaattatttctggactatcaaagtgcataaaagcaaaactaagataggatgcttagaagctgtggaaacacagccgagaggaaaaaaaaaggagagaaatacaggtcaggatagcttgaaatctcctctgcccttgatctgggcatccaatatagctcaccccaaatccctttaataatccccttctgtaaacttgaccctaaccttgtgctctcctgggcaggaaatagtgataaagtctgaggttttacctctaaggttctcggtgacccctggcctgagcctccacctcttgaacctgaaatcacgaagggtcaagaccctgattatttcttgtgctctctccctctctctcggtgtttatattttgctccacatgcctggggcccatcaaagggagaggaacatgttcagaaaataaatagcattgctgtcttatgctttgcttgctagaagctgtttatataatataatctggtttcttcactttggggaacttaaggcacagaaattgctttccctcaagtcttaatatcataggactcaaaagagacccaaaagaacttcatgggaccatggttccctccacagacatgttgccaaatagtttctttcccttcatgtttgaaagttgcttcttcaatcaacatgccaaaaacatcttcagaagcactgatactctgttgcctcgggctgcgacatgtggcttatgctaaattcttttctctctctcatccttgctaggctgcatttgtaaccaagccgtggtccttttcattgcatcttgccagaatgaagaagagctgatctctccagttcctgttattccccttacattgcccacatttattgctcaataaaccacagaaatccttctgtaaccctcgttcttctcctctcttccccctttcactattgaatttaaaactcatgcattaggcatgtgctttgtgatatttgtgtcacctctctaaactgtagtgcaaaaaagaggaagaaaaggcatctgctcaaattgacatttccatctcggctcactcatttgagagtgacaggctataatttgccaacaggttcacatccaaatgcataggttagtgctgacatcaggtgatttttccaccattgccatctccagctcatgcatgctacacaggaggccacgcttaagtcagcagatattgcagggaaaaggaagagaaaaaaaggagaaagctcttgatttccctaagcctcttaatgcaccaaacacaatgatatacttaggtctatttggtggagcaggtgggtgggtcagagcatgcattggaatgctgtgtgggttgagaaaactgggttttctcttatgtgcactcaatctgtgcaaacacacttaccctttgactctgtgagtaaacagactttttagccaggaaaaccaggatcaattcctggctctgaagaccaagaccgaggtgagagaggaaacatagttccctcctgcttccagtggtctttccctatccagttacgtgcctccaccagccacaacaaggtccacttgctattagactggtgcaatgaatggcaaaaaacacaattacttttgcaccaacctagtaacttgtacattgtctggccaagaagagaacgtgtttattactttctttttctttctgtttcttttctccctattgcttctttcatcctcctccttccttctggattcaattttcttcttgctgggttatagcctttagaggttctctcagcaagcatctctttggtagtaaattctcctagtcttttcatggtctttaatagaattttttggggtaatttttgcctgtgtgcttgctttcagcaggagttggtattaacagcagtcgtgcacgtgcctaggtttaggaggactcctattgtctggttttatggttgtctctgcagaggttcctcacttcctggctagcttttacattaattccgtggctcgaagtttctaccccgtgtcaggaggtacaactcaggctcatctactacatacacctcatgcagttccagggttctaatattttatgagtcactactttccatcagcgattcaggcagacattcacttctgggctctgtcccagagctggaagggaagtttctcctccctgtttacagactcagcatgtgtttcctggtgccttactttacccaggaatcttcattccttcttgtagccttataaggggccacagacttgaagacagtttctttccaagaacattacaaccccagccccagagggtcaaattctgttctttactgagcctgggaagcctcttatcatctctagattacctgaggggcaccctttttaactttgacctcagattctattttattgaattaaaattgtttatttagtaactttacactttacagcatagagaaggttttgcataaagttttgttttgccttattgaccaggagtcctgcactcacttttctgcccctgttttttcgactttcatgtatccctttgaagcttgggacaacatccaggtttgcaattgtgccatctatggactaccttaccagtcaagacttcagctagtgatgggcttttaagcccttactgcattgacgttatgaagtcagagacccaaagacattttgagcaacacttgtttggggaaccaagatctctgtgcaggttcacaagcgcatggttaagctctgacctttaccaagtctggttctgcttccatgggaagctactcaaaaatgagagaaaaggaaatgagatgaggcggctgcacatggaaaagaacgtccagcattttggggctgaccatggatagcatgcgttctatccctgctgtagtacattgtttcctgctcaatccaatgcctctctttctttaaagacaagaaatgtgtttatgtcatcattgtctttggcaaccaaaagagtgagtcagtcttcacagtccagagtggaaagaaagcaataatcagatatcagaactagggaataatatcttagcagccaacctaaggaaaaaaaatgtttgattagagacaccttaatgaccagggaatatatggttaccatctttgcctcataccaacttgcttggtccacttgaatgtttagcaaatattgctttgaaaaaacttcctggttcaggtgacattataagataagcaccacataaatccaggatggacaaggaaagaggcttctgaaaagaggatgggacttggcaaatagaatatagctcctgtctctgagaggtaccccatctggtagcagagggtcaaacaaaacagtttcaaagcctgttttccctacagcagcctgtagcatccaagatttttggaagagaaaggacatttcttctggacgttagctttcttgtctttcccccaggcatctcttagagtagggagggagctcttctatttgttgactgcttaatctctgccaggcaggagttctatctatttttaacacatttgacagagtgatcttttaaaagtaaaattagatcattctattctcctttaaaaactattcaaggggtattttctttgcattcagagagatccaattttttatcctcacgtacgtgatgtgatcactgttttctcacctgttttgtaacttatagcagctccctctgctcaatacagttcagcctctttctgtttcttgatgtcttccagctcatttcaccccagggccttggtgcctgctgttccattggtctggggccctttcgttcttatattatcatctggttggctccttggagtcattgaatctcaactcaactcaaattttgtttactcggagaaggtggccctgaagccctatcaggttagcccttcttgtcactaacaacatcagcctgttttattttcttcatggccatctccattatctgaaattatggtcttcatttatttatttcccatctctcttctctactgtaatgtaagcaccaccagaacagggggttctgatgatctgattcaccacagcatctcccgtgcctagagctgttctggtccttagtaagcctagtggctgaaaatatggcctttgtagccagttgacctgggttcacatcctggctaagctacgtgacctttctcctgttgccgaacctctccaagccctcacttataaaatggtaatagtaatcataattcttatctcatacaattgttctaaggattgaaggagtgaatgcattttttttttttgagacagagtctcgctctgtagcccaggctggagtgcgctggtgccatctcagctcactgcaacctccacctcctggatcctggttcaagcaattctcctgcctcagctcccaagtagctgggattatagggacacgccaccatgcctacctaatttttgtatttttagtagagacggggtttcaccatgttggccaggctgatcttgaactcctgacttcgtgatccgcccacctcggcctcccaaagtgctgggataacaggtgtgagccactgcactcagccaaagatgtatttattaagactcacttggacatgcaaagatgtgtaggcacctagacactcatctctaggtgaaaatttcatgatcttcataccatgtttacacacatatatgctcacatatggtatacaaacatacactctcgtacttacccacttggtcacataaacacatacttcatatatggatgcatacacttactcgtgcttactttcttattcacacacagatatgctttacacctacatagaggctcacatactgtcagagacagacttgtgtgactccttgacttacattcgtacacatgaaacaccttcagcttaggccagaggagtagtcacgagcttttgccgcctctcatttctaaattctggagacaggatgagaccaaaaggatgtctttaagggacagatagagggaatggatgtgataatccatttttgaatagcacctggtgcatagtaagcacccaagaaatatgagttattatcaacgattattaatctgttgaatgaatgaatgaatctggtgttttcccatacggatttcattgacttctcatagcaaacgtgattccatccatgttatgagtgatgttaagaaaattgactgggttttcacagcaagaatgacctgggtaaggatttcattccacatctaccagactgtgaatctcggtccctctcttatgattccaagccctctcccctcccctctggtgtcacccatttctgtactgtgccttggccctgtgctgggtcaatttttctaaaacctcttgccctggtgtcttcctagctggtgtcagcttgaggcttgatcttgaattaattccccttttgctgctgtgtgtgctgcggactcctccactcaggtctgctcatttcagcctctgtctcagcagttcctgatgacccccagcaaggaacaacaaaagggattttcgaggaagaataccacattgattcttccactgcgtcttgctatggaaatggaaagagtggtagtgattcccctggtctcatcaccctgattgggtctaccttcactgaattgttcttcccagcaaggtggcagaaatggccctagtgtttttttatagagctgccttttatctccacttagtgtcaacttctgcattcaaggtagagtgggaaaaaaacataaaagtaaacattcctctgggaagaaaaaggcccaagacttcaagtcaacatggtaaacaatggcataatttttcatctaaccgggttctagaattcgtgaacttcaatcagacccatgttgcagcatttgctttgatatgtgccgtggaataatacttcacacttccctagggaattcagggagggtgattatcacatccattccctctatctgtcccttaaagacatccttttggtctcatcctctctccagaatttagaaatgagaggcggcaaaagctcttgactactcctctggcctaagctgaaggtgtttcatgtgtacgaatgtaagtcaaggagtcacacaagtctgtctctgacagtatgtgagcctctatgtaggtgtaaagcatatctgtgtgtgaataagaaagtaagcacgagtaagtgtatgcatccatatatgaagtatgtgtttatgtgaccaagtgggtaattacgagagtgtatgtttgtataccatatgtgagcatatatgtgtgtaaacgtggtatgaagatcatgaaattttcacctagagatgagtgtctaggtgcctacacatctttgcatgtccaagtgagtcttaataaatacatctttggctgagtgcagtggctcacacctgttatcccagcactttgggaggccgaggtgggcggatcacgaagtcaggagttcaagatcagcctggccaacatggtgaaaccccatctctactaaaaatacaaaaattagctaggcatggtggcgtgttcctgtaatcccagctacttgggaggctgaggcaggagaattgcttgaaccaggatccaggaggtggaggttgcagtgagctgagatggcaccaccgcactccagcctgggctacagagcgagactctgtctcaaaaaaaaaaaaaaaaaaaagaagaagaaaaatagaaaaatcattatatgagcatgtttcccagtatatgaatatatctgggcatgtgtaagtacttgcgtatatacacctttgaggtctgtgcaagtgtgtgcatgagtgaagagctaaatgaatgcatttgtgaaagtgcatgcttctgtgcaggtgtgagaatatatgtctatttccctataggctgtgactacatgggtaaacagaggttcgggtctgctgaggatggaagaacaggccacaccgttctgactatttttccatgtcaccctcctgggctgtggaaacagaacagggctttagaattaatcttttccagtaaactcgactctgaaaatagttccgctgtaaaatttaccttgccttctagaaaggcccatcacatctgtgctcttttcccataggtccgaggaagttcctgagataactttgtgagtggtccactatttctgcatttcacagcattgctatactccaaactttgttctactcattgttcaactcaatgccttgaacctggcatataatagatgctgaatacatgagttataattgaaaacaatgttgattattcttttacaactaaactctagccatttacagattttaaataaagtgatccataacattgaattcttcctgaatgtattatcgaaatgtgaattatggattatggcattcatcatttgcttcattcattattcactcaacaaacactcactgagcacccactatactccaagcttggacttggacactggagatgcaacagtgaacagatgcattcccgtaaggaaaccaatcaataggaaattatcatacagaacaacccgtcctgagtggtcaaagtaagaaccataagttgaatcctcaacgtcgttttaggacaagaacaagaaacccaagaaactcttcatctttgcatttgggctaataagttcttcagattcttctaaacacgctcccccatcctggctcagtggtgcccataagactccctgggtttcctttcttttctgttttcttggctcttcccagctctcagactgagcatctatcatcaggacatcagggaaagttcagctgatgagtggcagacactgatgctgtccctttagtggtagaggcttgtttacctgctttctgtggccaggtagggggtaaattagtgccctgtgttcttctcctgtcaggcatgggtgaatggctaagctccttccttttctgaggctgctggtcaggccccactgagcagccacttggcactgctgaaaccaaagagagaaataatgagccaccatcaggttctctagattctgaggtatgtctgaatatgctctggtgaggggtgagtgaacagtgacccaggggaagggcagaaggatctgaagctgtgagtgcaggcacagggttcctgtgggaaatagacacctaggaccccaggtggaggtgaataaaaaggagctcctaaagacaagatgctcagagaccctggggaagaggagcaggtcaggagccccgcagctcaaagttgtataaggacacacccaaagcgctttgaggtggcagacagacagctggaagcagatcttggaatagatgtaacagaaataaaaaatggaaataagtcatgctcaaaaaactgagaccatgatgctggctcacagagcaggaggcagcatctgtaggaaagggatcttgggagcatccttgtgtctttcctctgttcatccatgtcccacagaccacaggttggcagtgggaaatgaatcaggcccaagagtgcctcatgtcctttgcaattctagcaagaaaatgaaattgtcagagttacactccgaatcctgaggacctgacccctggctgtagcatcctctgcattcctgttgcttcacaatctcatcactgacttcgaccccagctttcacagccttcctctctccttcaagccacatcttcaccaaggtggcaccaaccaaccatccaatagacaccaaattagagactcagtgagtccaggagattcagggtgcatcttgtgtgaaagagcgtgactggcatttccacagggaacaggtctatattttttacaagattatcaaagagttgtgggatccccacctcgcctaaaaaaagaaacattcatggcctggtgcagtggctcatgcctgtaatcccagcactttgggaggctgaggcgggcagatcacgaggtcatcaaatcaagaccatcctggctaacacagtgaaactccgtctctacttaaaatacaaaaaaattagctgggcaaggtggctcatgcctgtagtcccaactgctcaggaggctgaggcaggagaatcgcttgaacctgggaggtggaggttgaagtgagctgagatcacgccactgcactgcagcctgggtgacacagcgagactccgtctgaaaaaaaaagaaccattcactgccctagactgtcagtccctacctgcctcccttctttagtgaagattcgcctccacctgaatctcatcatgaactttcctatcatcgtccgcattggtcccacccctgaagcagtagtctctggtttccctgaccataacctttggtccaaatagctttctcacttctccatgctaaagcagataataaagaattatctgctttatcagctggttgaagacttctaggcccctccctcccctctgtcttccagcctttctaccttctgacctggcttccgactgcattcggtctaggttccaaggtcaattactcagccaccctcttaccagcatcttcagattcccaggctccttgtctcttttgtagacctacaaatacatcggagaatgcagaatagtgttctgccaccccctaaaattcagagggtaaaatctcacccaggcacccacggcatctcagtaattgtgttatttaaacttggccatctcttttcttcatttatcttggcaaatcctccaaaatttatccactcttcctcaaatccctctataatgaacttccagctcacatccttctcaaggaatggccttgcctttttcaagaaaagagagacctggagggataaactacctcaacttcctgctggctctgcctatggtagccctctgttgacaggtgagaaacgaggattagagaaggatagcgccctctccaaccacttacagctagctaatggctgcaatggagaatgtctctactcctttaggtcatctggaaatgctttgttctctctatttattataattattcttactgttacgattatgataattagataggctttattctccattaaaacaacagatacatgctgaatgactactgttatggtttggctgtgtccccacccaaatctcatcttgaattgtaatccccataatccccacatgtcttgggagagatctggttggaggtaattgaatcatgggggcggtttcccctatgctgttcttgtgatagtgagtgagttctcatgagatctgatggttttataagtgtctggtatttcccctgctggcattcactctctctcctgccgacctgtgaaaaggtgcattccaccatgattgtaaatttcctgaggcctccccagctatgtggaactttgagtcaattaaacgtcttttctttacaaattacccagtctcgggtatttcttcataacagcgtgagaatgaactaatgcaactactatgagccatttcttacaatgtgaacagtctgtcatgctggccagcccaagcagatctgcgggtccgaggataattgtaaaagtgtgcaaatccacaagcagtaagtgttcacaggcatgcatgctccatgaatctacatctgctctcacaatgcttacatgcacacacacacacacacacacacacacacacacacagggacacgtgtctacagaacacagaccttctgcagatgcagattcatgcgcaggtgtgcaggtaactgcagctgctgattgcttgtgtctggttttatctgccacctgtccttgaaatacttcccactgatgaccactgcattccacctgtgagtggaaaggcacaatgaactctgcttaacaggttcatgaatttaccaggcacttacttaagatggttacaccacattatagcaaatggcttctgggggctcaggaagggctgtatttactttccgagaattaccattagtcctggatgggaaggtgctaagaggccgcattagcatggctttggtcagtttcactcccctgagcagttgcagaattcatgtggggtttattgatgggccagttattctttaatgggtttccaatttgactcctgggataatgagatgggtctttagggaccatctgtctctctcccacggttgtgggcagctctgaggagcctgactccttaactagcaggtgatggagtggagatggggctgagtgtagcacaacctatttgtctctcccggagctgaaatgctccccagaaactcctttctcctctctgagacccctcctcagttgacatatttgaaagtcaagcaaggctctgcctcaggtagtcaggggatttgtgtcccagctctgctggacaagcttaggcaagtaaccaaacctttctgagtcccagttttctctccagtaaaataaagacatgcacctgataatacgtggcatgaactgaggatctactctgtgctcagcactgtgcgagttttcagcctaggaagggacccaaatcaggcaacatctctatccttatgaacaatgacaaaaacaaaaacatactgaatcaccttaatggatgcatgattcaggctgatataggtgctgggaagacaagaagcaggaccgtgagcaagagccatgtccttgtctaggactccgagagagtgacagtggagctgagagctgaggggtgagcaggcataaatacgttggaggagggtggtgagagtgtaccaggcagagggaacagcttgcgtaaaggcctggagactggagggaacatggtgtgttgcagaagctgaaagagagccaggaggactggcatgcagagaaggaagggatggaaaggtaggcagaatgcggatcctccagtaatttatactaggacaccttgttaaggatttggtcttcatctcaagaaaaatagacagctgtcaaaagttgtaagcagagggaagactccatcctattggcatttcaaaaagatcgctctgggccaggcatggtggctcattcctctaatctcagcacttcagggggccaaggagggaggatgacttgagcccaggaattgaagaccagcctggacaacacagtgagacccctactctacaaaattttaaaaattatgtgggcatcatggtgcacacctgtggtctcagctacttagaaggctaaggtgagaggatcacttgagcccatgagttggaggatgcagtgagctaggatggcaccactgtactccagccagcccaggcgacagagcaagacccatctcaaaaaaaaaaaaaaaaaaggagactattctggctgcagtatggacactatattggagaggaaccagagaggatgttgacagactggttacaaggcaatttgtgcaaaaaatgatggaagcctgtccatagcaggggcagagaacaccgtgagaagtgatattaagcaattcattgaactgaatttgagcagagaggagagaaagctgtcaatgatgactcctatatttccagctaattcctcacaaggccacttaaagattaagtgaactcatgtgtgactagtgcctggcacaccgcaggtgcccagtaaatgccagttcttgtccccctgtgtccttcagttctttgccacttgattcccactgactccttcacagccatgcaaagctgggactctaatccctgttcccttctcctagagtgttctaaccttatcatttttctaattcagtgctgatgtgccaacaggcagccttggcttggcagagctgccagggagaagccaggcacagcttgcggctgggaacagttgcgctgggatagtccttggtgggttgatcctcctcctggcgggtctgactaggagagctgctgctttgtcacattgatgggccaagtccccttactcctttgcagaaaggagaggacatttgataaataggtgaaggagggacacaaaacagaatcggaatggagaaaataatagaatttgtggatggaagaaactgcacccttggggctgtgtaatcacgcatgaatccccccactctcctaggctccagttttctcatctttaaaatggggtttatgatagtttttataatggagttccattgtgagagtaaatgagatcctgtgacgaaaaaatggtaaataaagtataatgtggcaaagaaataattaatgtgtaaatggccggtagggtggctatgaattcagttaaacctgagctcaaacccaaattataccacttctgacctgcatgttggagcggggcagatgagttactatcttctctgcacctgagttttctcatccacaaatagagattataatatgtagcccatagaactatggtcagccttaaaagggaaaccccaggtccccaatctcgtgaagtttatagttttagatagagaaagaataaacaaataaacctataaatcaaagattagagcaggtgtggtggttcatacctgtaattccaatgctttgggaagctggggtgagaggattacttgaggccaggagttcaaaagcagcctgagcaacatagcaagaccctgcctctacaaaaaaaatttttttaaattttaattagttggatgtggtgtcttatgcctgtcgtcccagctcctagggagcttaaggtagtaggatcgcttgaggccaggactttgagtccagtctgagcaagagcaagagaccctgtctctacaaaaaaattttttttaaatttatggctggtgcctgttgtcccagctactgggaagcttaaggtaagaggatgacctgaggccaggagtttgagtccagcctgagcaacatcgcaagattctgtcctacaaaaaaataaaaataaaaaagattagccaggtgtggtggcatgttcctgtagtctcagccacttgggagctgaggtaggaggatcgctggggtcagaggctccagtgagctatgattgagccaccactgcactctagcctgggtgacagactgagaccctgtctcttaaacaaaaaaaaaaaaaaaaaacaaaagcaaacaaacaacaaaaagaaatgaggtgaaaaaaatgaacaaacataaatcaaagattagttgacagggcggtttaattctctgaggaaaccaaaacagtgtgaggtcataagagtggctaccttggatggggtgttcctgggggcttccctgtggacatgacctttgagcccagacccgaaggaaaagaaaggccaatgactcaaagatctggaaagataattctcaatcctggctgctcattagaatcaccaggaaatcacctccagaccaattgcaacagtattctttggggtagaacttgaacatatgtatgttaatatccagggggattttgacacaagatgaaggtggccaatactgagcaggtacaagatgcaagatctcaggagtctactattgcctgacatctagtagtatcttgtgtttatttgctagagctgccgtaactcatatggcagtttgggtggcttaaaacagtggtctccaaatttttggtgccagggaccagttttgagtaagacattttttccatggatgaggctgttggggtggaaggtagtgaatggttttgggataaatcaagcacattacatttattatgcactttatttctattgttattacattgtaatatacaatgaaacatacaactgaccataatgtagaatcagtggtagccctgagcttgttttcctgcatctagactagatggtcccatttgcgggtgacggaagacagtgacagatcatcaggcactagattctcataaggagtgtgcaacctagatccctcgcatgcgcagttcacaaccaggttcacactcctatgagaatctaatgccaccgctgatctcacagggggcggagctcaggcagtaattcaagcaatggggagtggctgtaaatacagatgaagcttcgctcacttgcctgcgcccagttcctaaaaggctatggacagtaccagttcatggccggggaattggagacccctggcttaaacaacagagatttattttctcacagtactggaagcggaagtccaagatcaaggagttggcagggttggtgtttttctgaggcctctctctttggcttgcagatggccaccttcttgctgtgtcctcacaggctcattccttagtctgtgttctgtgcatcctaatctctctctctttttttttttttttttttaagacggagtctcgctctgttgcccagactggagtgcagtggcgagatctcggctcactgcaagctctgcctcctgggttcacgccattctcctgcctcagcctcctgagtagctgggactacaggcacccaccaccacgcccagctaatttttttgtatttttagtagagacggggtttcaccgtgttagccaggatggtcttgatctcctgaccttgtgatccgcccgcctcggcctcccaaagggctgggattacaggcgtgagccaccgcgcccggcccctaatctcttcttaaaagagcaacagtcatactggatcaggacccactcatgtggcctcattttaccttagttacctattcaatggctctccctgcaaatgaaggcacatattcatatttaggacttagcatataaattttggaggggacacaatttggaccataacacacctaatacatgcaagtttcttccttgaccctaagcttctgattgacttttttatctacctccctaaattgacactgtctgccctcccttctgtgtggctctgagaatacttttcattattccagcattaatggtttccagaagtttgaactacaaaacatccaaataagagtcttatttagagcccttatctcccaggtagagacagtgcttcaaagaggaaggaacttgcccaatccttcatagataaaggcccgggagcaggtcaatactcccaatgttattgctgccacaatctttgttctccttatacctgcagatgcagaggggcaggaaaagtccactaggccagctctgctacttattatgtggcttttggaaagttaggccaccacattgaatgttatctataaaaaggaggctataaaatgatgattgtgagatgcatgccataacgagaaggcttctcacaatgactgtcctatagttatgtgctccataaatggtgaccgtcatcatccatgtgatcctcagtgctgtgccttctgatgggtgtgaggccatcctgggaggaaggaaggagcatctgacttctcagggtttccaagtctggtgtgacagtgcctcctttgattccagctctgggtaagaggaggttatgcccaggcaaggatgagcagagtgaagaggacctgacatcaggtaactgtatagccactatcttcacaaggacagtggtcctcacactttcttacaaatgcatttctctcctctgcctctgggctattgtcagagctgaattccaggccaatggccatgggacattgtcacatgggatttaaacaggaacctgtgagagtttccctgacatcttgtccgccctgcgctctatgagggaggtggagggagaaagtctctgtagcccactggggctgtgacatcaggactcagccatgtctgcagggttttcctcctctctgacactccaaaggcttcattggcagatcagcagagaaagtagcttcctttgctgaaaggcttaggaagagacggtgacctatttttgcgagcttttctgatgaggtcttcatgtgggaacttctgccaagcaatgaactcacaaacggtgggtagggttttccgggcatccagatgaagaacaaagagacctggtgttttccaaaaacacactcttgctttcaatatggaaaaaggaatgaatcctcacatcaaaagcaagaaggaaggcagcctgtgtgggggtccatttctctaagtcccttgcaaccattttggctaatgtccttctctccccatttgtcagttatccagtccctgagcaagttctgacaaagacaagaagaccagcaatagtcttccaccaggaggttggtctggaatgagagttgcttctagagaacaaatactcagtctgatggatatgacactatgtctcagcattcccttcactaagcttccaagctcagcgccaactggatttagagctcagactacaaagcaaatacgtcaactgtttctcagatgcctccagtccccttttccccacagggtttatatcatacactttccattctcagagtcaatgaggctgctgcgggctgcaagagacagaagacgcaacaatgtggcttgagccatcggtaaatgtactctcttcttaaagcaaggtccagaggtaggcagtgttgaggagaattccacagctcagacatgccaaggacaggagctattatagtcttcagtccacccttcttggaatattgagttttcctccttatgtgtttttttttatggttataaaatagctgccactgctccagccattgcctctttaccagacagcatcaaagcaggaagcaatagagctctctactcaatccacttttaactttaaatataaatgttcgatgatgtataacacatgtacaaagagtacacacatcaaaaatgcacattagatgacttttcacagagtaaactgaggcatgaaacaaagcacacaaaccatgatacagaacatcaccagaagcacccttggccacattccaatctcactgcccccgagagaaatcactaacctaacttcaaacaccatagatacgatggcttccttttttgttgttgttaactttttataaatggaatcacacaactcttccttttaggcaactgtcttcttctgtttcctgagatttatccacatagctgagactatctatagtttgttctttctcattgctatatagtgatcctttccacatatctaacaagatttatttatccaattgctgataattatttgagttgcttctaagttttgtagatcctgaatagtgctgatgtgacttcctggtgtgtatgttttggtgaatatataacttaggagtggaatggcagggtcatagaatttacctctctgtttccatgaaggaatgtctttcccagaaggccccagcagactagaaacaagcttaccctggaacaacccaccagccacagccacagattgccttgaccttgattggcttagagatataatttatttcctgtggttgggaacgttgctttcttttttgtttgtttgttttgttgttgtttttgtttgttgttttgttttgttttgttttgagatggagtctcactctgtcacccaggctggagtgcagtggtcccatcttggctcactacaacctccgcctcccgggttcaagcgattctcctgcctcagcctactgagtagctgggattacaggtgtgcacaaccgcacccagctaatttttgtatttttagtagagacagggtttcaccatgttggtcaggctggtctcaaactcctgcctgcctaggcctcccaaagtgctgggattataggagtgagccaccagacctggccgggaacgttgcttcttaatcaaaaccaggcatctggagagagtaagaaataggcatggtttcatgtgggcactgtcacacgcttttatctcctgctgattattagctcaggttcttccatgaaatgtaggttcacctggaatcacatcagtgtcactcacctgggcacctgtccactgctctgcttttcctagaagtgtggtcgaaatttcctgtcactatctgcctgccctctacccagggtttgtctctaattgtgttttttttgccagaaccatgcctgagccctccttgacaggtaggcctgaagatgctgtccgggaagaataataaatatagaccaaaatcgcctggcacgtgccttatctcaagccctctatctgcaattctatcccatcaggcacgcttcctttagtgaattttctaagtacctctatttcaagatcccaatgggagtgatttttcttaaaagggcacatcctctttcagtatcacccggcgaaaaatcctgaacaatctcaagctgattctaggacagttttgagtaggttatcatgggatttcccccaaagtgtgagttcagtgtagtattttagcagaattttaatattgcaataagggtggattgacgttgcatccatttgtattctcattacaataaaagaatcagcatggtattagaattttactgcctgtgatgtttggtgaattacagggaggtctaatacgatttcccacactatattctgtttagattggcaggtttctgtggccatttctcaatagactgataaagcactagatagaggattagtgctcttggaagctgagaaaggaggtgatggggttgtttatagcttctggggatggattctgatgaaacagcccagagagagtgaaactttcacagcatacagaatgccaaggactcggaacataatatagggaacagccccactccatcgagtacttccccctgggggtccaggaccagaacaatcagaacagagatactaatgaacctccccttggacaacatcataagaagatataaatcatacccaatgtctctggaggagattcattctttttttcctgctagagggacacttcagattggatttaactagcacatgttagacagcagcaacaacatgcactctcaacactcacgatctcattccattttcacacagccctgttgaataagctcttactattatgctccccatcaccagtattgttttagataacgtttccaggaaacagaccctgaaatggagaattgcatgcagaaggattcctgaggattagtctctggagatcaaagaaagtaaggaagtgagggaggcaggactggagaggtagagaagctgacctgcaaagtggctacaatgaagctcctgcagggagatccagagtggggtgaccttctgagttcttgcagacagacacaacggttctgctcctgtgtctaggcacatcagttgcttattggctgggggctaccccatgaagggacataaccttgcacgaggcagctccctgctacaaaggacagtactcagtgagggacatggaggtgagaggtcaacagccaatattctcagcacctgggtgatgagtgtgtcagtcctgatgaaggaatctgggcagaattccacactgtccactgacatcatcatcatggtcatttaatgaaagagcctcaaaagaattaagcaaatgacccaaggccacatagctggtgggtggaccctcagttgctctgactcctgagtcagtaagccctctcttccctgccattgcctcagtctctccatttctctcaggagtctaactagggaagcaggtggtgaggtagatgataaaggaatggaaactctgagtcaaggaaataacaattcagatagaagaatgctaggaacacctttcattcaataaacaccagtacgcacccacagtatgcccagcattattctaaatgcatgggtatgatattaggaagacagacaaggttctctttctcatggagtgtttattctagtcagataggtttatattctacagagcctagaatatgatggataaagttagtagtagctgagattggttgagttggacatgggatctcattcgaaggaacaggaaatgtccgtattatttatactaattgaggttatatcatatttggctacatataacaggaaaaccaactgataagaagaaggcttattcatttctgttccttaagtatggtgtttattaaaaataagaaaacatgtggccgggcacggtggcttatgcctataatcccagcactttgctaggccttggcggtcagatcacctgaggtcaggagttcaagaccagcgtggccaacatggtgaaaacgtgtctctactaaaaatacaaaaaaattagctgggcgtggtggtaggcgcctgtaatcccagctacttgggaggctaaggcaggagaatcgcatgaacctgggaggcagaggttgcagtgagccaagatcacactactgcactccagcctgggtaacaagagcgaaacttcatctaaaaaaaataaaaacaaaacaaaacaaaacaaaacaaaacaaaacatgcaaggtcatattatatgctgggtgtgcaggtagacagaaaaccctacaccagcatggatggcagacttctgttctctgacttccacttcagactggattttggtgtagtatgggctaagttgacatctggcttaaaatgaggaagcaggagatgcaacagatgaagttaaggcaataattcagtctgtctcatgtaggtaatattgaatggcaaggagtatctcttgtcattagaaacacaattgcttagctgggcctggtggcctgaacctatagtcccaggtacttgggaggctcaggcaggaggatcacttgagcccaggaggtcaaggctgcattgagctatgattgtgccactacactccagcctgagccacagagtaaaaccctgtctcaaaaaaaaaaaaaaaaagtaaatagaaacacaattgcaattgtagctgggagtgatagctgttacttaatgagatttaggcctttgcacaggtttgtcatgtggtcttgtcttccctctttagaaaaggaggagctctttcatgatgatttcctcagatgtttgttcacagataatataagtctcaattgccaacatgcattgctttccaggtttgtgagctggagtctcttcagtaaatggcagataaaagtatttgaatatatccctgaaaaagaaacttccatctaccatctagttttgtgtgtgtgtgtgtgtgtgttgtgttgttttgttttgttttgttttgtttttagacgggtcttgctctgttgcccaggctggagtgtatggagtacagtggcgcaatcacagctcactacagccttgaagtcctgagctcaagtgatcctcccacctcagcctcccgaagtctatctagtactcctttgattttcttttgccacaatgtagcagagcagacctacattggattttggtttttgtttgttggttctgcagaacttgcattcccacataaaggtagaagggattcttggctgtctgatagagaagatacaaagattccactaactttggtctcagtgggtagaagaaaacatcagagacttggagacaccagttaaacttcctcggaagggttatccatcttttccacacagcagaataaaaagtgtggaggaaaatgccaacccttattagaacctcagcccagggaattaagctttgcacagtcaactcaggagtttatcagctgcccactggacatagttctttcagtcctcctgatctttcgttaagtaagtctgaatatcctgacatgttgccatcttagtctagttgggttgctacaataaaatactcataggctgggtggcttaaacaaaagaaatttggctgggtgcggtggctcacacctgtaatcccagcactttggtaagcagaggtgggtggatcacctgaggtcaggagtttgagaccagcttggccaacatagtgaaaccctgtctctactaaaaatacaaaaaattagctgggcgtggtggtgcacacttatcccagctactggggagtctgaggcaagagaatcgcttgaacccgggaggtggaggttgcagtgagccaagatcgtgccattgcactccagcccaggtgacagagcaagactccatctcaatatatttatctaggtcctagaagtcccagatccagttgccagtcaatttggctcctggtgagaactttcttcctaggttttgggcagccaccttcctgctgtgtcttctcatggtgaaaagagagggagagtgagctttcttgcatcctgtcttacaaggacactaatcctatcagatcagggccccatcctgtggcctcatttgaccttacttactttcataaaggcccaacttccaattataatcacattaaggttagggcttcaacatataaatttaggggacagacagttcactcctctgcagtaacagcattaagcatgtgtaggtcttctctttctccaaagaaaaagatttcaagagatattctttgagggaatccagcccagtatccatgcccctgtgctttctaacccaatagtccaactgaatgttcacatgtgacttcataattccatattattgctccagaggttccaaagagcttcttgtagacttccctaggcattagctaagaatcccaaattccacccacagagagccagcttctgctaggcactattgttgcctatagattagaggataaagaatttgggttttagtgtttcaaagcaaggagcagtcacatggccaggtcatgagccatgtgcaataattcattatcatcattcttaactgtcacatcaccaatgccctgctttgggtccactattattatacagtaaggtagaagactttctgggatccctattacagcttcaaagactttgcagttcaacaaactcatacaaaaatgctcaatattactaatcattgaggaaacgcaaatcaaaaccacaatgagataccatcttgcaagagtcagaatggctgttattaaaaaataaaagcataacagatgctggcaaggttgtggagaaaagggaatgcttacacactgctggcggaaatgtaaattagttcagccactgtggaaagtggtctagagatttctgaaagaacttaaaatagaagtacaattcaactcagcaatctcattactgggtatatactctaaggaatataaattgttttaccctaaagataagtgctcttggatattcatcgcagcactattcacaatagcaaagacatggaatgaacctaaatgcccttcaactgtggacaggagaaagaaaaggtggtacgtacacaccgtagaatactacacagccataaaaaagaatgagatcgtgtcctctgcagcaacacagatggagctggaggccattatcctaactaaattaacacaggaacggaaaaacaaatattgcattttctcacttacaagcatgagctaaacactgagtacagatggacacaaaaaagggaaaaatggacaccagggcctacttgaccgtggagggtgggaagaggatgaggactgaaaaactacctactgggtattacgattacccgggcgacaaaactatctgttcaccaaacccttgcaaaacacaatttacccatataacacacctgcacatgtaccccttgagcctaaaataaaaattgagaagaaaaataataaaaataaactcattgcacatttaaaaagagagttatcatggttggattttcttttttccttagtaaataaaacttccattatttcacactaaaaaaatgtaaagagatacttggcagttggactctgtgaaataaagcggtattgctcagtgacttcaccactttctggacctcaaattaacttttcattattgcaagtgtatccagtgcagccacaagccccagcaaataatttcctaggacatcactgacattcggacttgaagtgtcctcactgtcagatctgaggccacagcagtgaagcccgacttcagcatcatctgggtctggggctctgagagcaactgaacctttctccttcctctgttgtgctgtgggctccaaggcaggtgacaaatggaaaccaagttgaggggaaagttcgggtagagcccgtgctggttcccaaccagatgagccacaatacccgtggaggctgagcctaagggtcaccagccccaggatgaatgattgagagtgcatggttgccttgattttatagcattattttaaagaaagagggcctcccctctctgaccaacacaccccaaactattgcaaagcccacctcacttcctttttaataaagtccccttgaactggcctatggtctctcactctcaaactctcagatccagttggccaggctcacctttggcccttgcccagcctcagaggaatgtggcttggaatcagggagatttcttattacctctaggggtaggagttctcagatcggtggaggagctcagaatatccatcagatcacaaagtccttctgtcttcaagtctgtcattctcagtgagtcagatttatctcccactggatgccaaaatgaccatagtggcgctctatcagttaaggtaatgtagttgctctaacaaacaaccctaaaattttagtggcagtaaaatatgtgctttaaacaatatttctcttttgctcatcatagtccaacaagagttgatgggagaaagttgaggcaggagctcttttcctgtctgtcactcagagatacaggtttttccatcttgcttctaccctattctaagtctggagtcttctctacccagtagagaggttaaaaaaagggcaatattcccaacaggaaggtttcatgggccaggcctgggtgtggagagcactgcttctgttgaagatctggaacttggtcagagagcttcatctaccacaaaggaagatagtgaatgtagcataggtgtattgcctggaccaagaaacccaggtattagggagcactgcagtgtgccccagaatttccaagcaccacgtccttacacaacagcattcaaggtcaggaccaaaggcagaaatcacagggctttcttcattctttctctcttgccgtcaaagagaagcatctttttccaaagccttccagaagatttttttgcctgtgtcacactggccatcactgggccaccattagcagcaaggaagtctaggagagtgagtatctggcattttgttctctaagatggaaagtggtttctgccagcaaaatagagctgattggctcttggttgttacaccaatgtgtgcctatggcttagaacagagtgttctagccaaggtgacaaagaagatgtcaaaatcagaagaagatgggactgggtatgtggccaatgacccaggtgagaaggtcttggttgtgggatggatttcagtcttgtcggggaattgcaataaaaggtgcagaggacaagcaccaaggccgcaggtagttagatcaggaagctgcagcctgcttctcacatagatgcccaggggtcatattcctgtcccatgcccctccgggaagaacagctgggttacagcattgggtgaaattgttagggtaactggtccacaccattacttggtgtgtgtggggtaaggggatgagcatatatatggggaataccctttgaccactttgtctatgtgttccatggtttttcttgaacccatcctcacccagttcccttggaagcaatgcttcctgcatcccactacatctcacttttctcctcttctaggaagagtagactttgactatatcaggaatggggattaaatttgcattgcaggtgaattccaagcctccttgtaagtgagaaagagttttatacttacccccatgagtgctgagactaaggaaatgattacactaacttctgtctatagagcatctcttttgtgcttgaagagtcgttttcatccttggctatatattgccatcacctggggtgttttaaaagattcatgctccaattagaatctctagaggtacagcctagacatcagtaattttttagaagttccccagtgattctattacccagagaagtttgaaaaccatggtaccagacagagttctaaaggttttagatatattatcacttttaatcttcacaaccacccgttaaaagaaggtatcatcagtttcctcattcaagaatgaatgaatgaatgaggttcagtgaagttaagcaacgagctagggtttatacagcaggaagtgatactggaatccacacctgggtctgtcggactcctggggtcagcctccccaccacttcacaaggctgcatctataggaaacaggttgttatgtctgacagctgggtgaggctgcagtaggcttcggctgacaacacccgagattgctcccaaatggtgcccccctggcattgtctggggaaacctaactgctgcagttgtgttataaaattatcactttacccacgcaaatgggccagagcgaccggttgtctattcctgtggttgtcccagattattaaatgaacagctgcctccaaatatgtttgcagccactgaattcaatggctgcgtgcatttgcatattcatggctcccaacccatggcccaggcttgcaggagtcctccaatggggctctgaaagttaatttatcttgacaatttaaataaatacacttccatcagctttagtgactccactaagtttcagtgagcactttgacagacagggaaggcagagatggaacgagatgggtgggtgatggtggcgtttgctatgagtctcaaggttaagggcagcaagaggaataaactattgaaatgatgaacaaagaactccacactggtcaatcactttcactgagagctccaatttgctcattttacattttattttatttatttatttatttatttatttatttatttatttttcagacggagtcttgctctgccatccaagctggaatgcagtggtgcaatctcagctcactgcaacctcctgcccctgggttcaagtgattctcctgcctcagcctcctgagtagccgagattacagttgcctgccaccacacccagctaatttttgtattttagtagaggcagggtttcaccatgttggccaggctggtctcaaactcccgacctcaagtgatccaccagcctcggcctcccaaagtgctgggaatacaggcgtgagccaccacaccaagcctcattttacattttagacctagggcaagctaactaaaaaatatatatatatagtcataagaacacttaacttgagatctaccctcttacaaaattaagtgtacaatatgttattgttgatcataggtgcaatgttgtaaaatatcacaatttcataaatttctatcattctcataaccttgtggagtggtgggattgtgatcccagaagtcagacagccccaggtgtgaattctagcaccactgcctattggctgaataattcctagccagttacttaacctctttgaaattcatctggagcatttctagagctgattcatcttgcttgactggaactgtgtcccttggttagtaactcatttctcttcctcctcatttctgatagccaccattctactctggctctatgtaattgactgttttagatatagatatatcctaaatatgaactcatgcagtgtctgttcttctgtgactggcatatgtcactaagcataatgtcccagttcctgaagtttcatccatgttgtcttggaaggcagaatttccttctgtttcatagctgaattggattctgctgtatgtgaggaccacattttctttattccctcatgcactgctaaatatttaggttgtttctgcatcttggatgttgtgaataatgctgcagtggacactggagtgcaggtatttcttcaagatcctgacttcagttcttttggataaatacccaggaagtgggattgctggatcatacgatagttctgtttaactttttgaggaacatccatactgctcttagtggctgcaccattttgcattcttgggcaagctttttgattgatctaaaacttactgtttctcacctataaaacgggattcataaactcaaatgcagggttgtagtgagaattagatgaaacaatgcaatttcctaactgccatcattcttgtcttgccttcatatacttgtacttctggggctactagttaattaattttcccctttaaattgaaccacttcttttttaatgtgaatattatttatccataactttattaatagcatcctgcagactacaataacattgtcctttcctaatgcgcattaagcaacagataactttaaaaacagagctctctcagccagccgtggtggctcacgtccataatcctagcactttgggaggccaacacaggcagatcacttgaggtcaggggttcgagaccaggctggccaacatggcttaaccctgtctctactaaaatacaaaaattagccaggcatggtggcgggcacctgtaatcccagctactcaggaggctgaggcaggagaatcacttgaaccccggaggtggaggtggcagtgagccaagctcaccccactgcactccagcctgggcaacagagtgagactcaaaaaagaaaaaaaaaaaaacacaaaacaaaacaaacaaaaaaacagagctgtctccttcatgtgccacctcattggtgtgtggaacgcaattgcagacactctacatggagagagtaagaccacagctgggcacctgcacatgagaaatagccagtacttatctgtttcaccttctgcttaatgccagcctcccatgtgaagacggtccttacacaggcaacactgattgaatctggggtgtgggggcagctcagccaccatgcaggaatagaatcagctccagtgttgctgcagctgcccactcttgtccctcactgtggcagctcttggttaatggcagagacccggggcctcgctgcccgtgctacagcctgggctgtgcaagctaccagggaagcaatccttggcaggcatctcacctttctgtgcctcagtttcttcatctgcaaggtggagataatgttagctacatcgtgaggattgagtgatgtgcctggtgcagagaaagttgccatttaaagggttgccaagctaaagggatttttttttttttttttgagacagagtctcgctctgtcgcccaggttggagtgcagtggtgcaatcgcggctcactgcaacctacacctcccggattcaagtgattctcctgcctcagcctcctgagtagctgggactacaggcccacgccaccacaccctgctaagtttttgtatttttagtagagacagggtttcaccatgctagccaggatggtctcgatctcctgaccttgtaatctgcctgccttggcctcccaaagtgctggggttagagtaaagggattttttaaatgtccagatatgctgattcacatcagtttgtagcctctcttttcttctctccctcctctttccttccttccttccttccttccttccttctttccttccttccttttttcctttatctctcccttttccctcctcctttccttctttcccttccttgtcccttctttccttccttcttctttctctttctcctcctctaccatccttcctctcttcctcccaagtgctttccttccttcccacatccatttttcctttcttcttccctcagtctctgcctttcacacacccagaggacctcctacacctcaaggaatttagttactttcctatacgtgatgcatcctgttttctcatttcacaggtgaaactgaagaggctgcagctttgagaagacacatgattttcacatgttcacacagcaagtgcaataatgagctgacatcttcctaaatgcacactaaaaataatacatgcttgtgaaaactaagatggttcctccattgtcacctaatgcattgtgtacacctgcggtacatgtgcttctcctggagaaatcatggaattgtgttaaggaacaagctcagcctcttgcattggagtggcatcttgtgtctgagtgtgtgtaagagacagaatatataaaggttagatgcgtgttctgtgcagccagactccttggctttgtcttctggttccactgcaatgcttagcacatcccttcttgtttctcatcctcagtctttgtatctgaaatgtggggataatagtagaacttacctcctgaggctgttgtgtggaataaacaagacaacagagaagtgttcagcaaacgcctgctaagtaccagtaaatatgggtgattgttatcattattctgggcattacagggaactacattgcagaaagcaactgttcaagtgcaagatgatgcttgcagcagttgcaggatccaaccactcttctccagtgtgaggtttggctgatcaaactgcctttagtcagatccacctgccacctacatctgtgtgacctggagtaaattcttaacctctctgagccacagttttcttatctataaaaggagaagaatactggcacctgcctcagggtagtggtgaaaatcaaataaagtaacagaagaattacttagaataaagcctgatgcataatacatagtaattacttatttattatttctttttgggacaggatctgctgcccaagctggagtagactggcatgatcatagctcactgcaacctcaaactcctgggctcaagtgatcctcccacttcagcatcccaggtagctgaactacacgcatgtgccaccatgtcaggtaatttatgaaaaactttttatagagaggaagtcttgctatactgcctaggctggtcttgaactcttggcctcaaatgatcctcctgcctctgcctcccaaaatgctaggatgacaggtgtaagccactgcacctggccactgttttctttttaaactactgcctctactcttccctattatctgatgctctctctctctttaagtaaacacacctggggatgttccaggtgtttggtgctggcaggatcatcacccctttctccatcacacacacaacgacaccactaccagctgtgtgctctccacccattcagggaattgcattgctccaaggacgacccagagcagacagaggcctgg

SEQ ID NO: 321 - DNA, 7044 bp, Homo sapiens
tgggacgcgcccagagtgaaggagcaaaggggactcggccgccatgttaggagtactgggacgattccgcggagccgggcagaggttttaggggtgcgcaggagtcaagtggtggttcagtggggacggtgaggtggaggacgatctggtcggatagccgcgggcacgaacctgggaaccagagggtggaggccatgctggggactgatgtagggcgggaccgactggaagcggcatccagaggcccagtgagcctcggtctcagctcctgaaggggttgcatggggccctacgcttccttctccattttttagctaagagattgagagagtcggtttacttttgggcttggagtatcatttagatctgttaacagtacagttgagagagttggtgtcttttgttgaggtgcgaggacccgaggcggcgaccctcgcctttattcggagaagcccacttccacccacagagttggggtagtcctccgaaatgcatttttgttttgccgtttgttttccaaccccctttcactctccccaaagcttcagattcactgatttttcatacaggaatgattaacaaaggcgtccgaagaaatcgttgttggaaggtgaccaaggtggaaagagacgttgctttggccctgcaagtaagaagagagagggaatagcctgaaggagtaacactaaatttaaaatgacacttttttaccaaccagcgaaagcagatgttcaaaggggatattggccaggtgcggtcgctcacgcctttaatcccagcactttgggggcagacgcggggagatagcgtgattctaggagttcaaccccagcctgggcaacatgcggagaccccgtaccgtctctacaaaaacattaaacaaaaaaattagctgggcatggtggtgtacccctgtagttgcagctacactagaggctgaggtgggaggatcgcttgagcccgggatgttgaggctgcagtgagcctcgatcctaccactgtgctccagcctgggcgacagcaagcccgtgtctcagaaaaggcgggaggggtgggatattattgatgataggccttctgacgtctggcaatagattccagagtaacatcggtcatggataaattttttttttaactaagtgactgaaaccaaagttaattgtcttttgagtgattttgcacagtatctcaaaatgaactgtactttttttcttgtgtcactgaaacagtgctgtgtgttctttttcagagtctgtcacactaagatgagaaatgtcctttcttcctgaaggtgtctgatgtgtaaaaatatgatatactttgtgctgtttcctcccttcccttttgcatattattctgaaacaacattaactagttactttgcgtcattgaaggtatgcacttcccctctatgttaggagtgaataaaattaaaaatagatccttataacaaagaaaggcagatagaatgattaaaaatgaccaaaacatgttagaaacagtctctcaggtgtatgcagatggtaattacaaaaatactttttcaaaaaatgatcttctgtgtcatgtttctgggaacaagtcaagatgaatgagtttgatttttaagcagaagtagtatgtgttggtgtcatccatgaatacaacaatgaaaaaggctcaaagttgttgttattcagaaacttctctaagtaatggtggtaagtacaggaaaaggagcaatgtctaccattttctttctaaccttcgatttaactattgtaatgttgtaagcttaacagagacttacacttaggcttaatttcaagctcttcaatcatttttcccggttggtgattcaggtgtattctcatgtcttatgtaaacttatcatgagtgttgttgatttataatatatttctttatgtaagccatagccttgtcagtttgagttatatggaagacaaattgtagggaaaaagagcaacagattactcagaaaccttctgtgtgagctgggcatagtagtgcatgccagtaggcttagctacttgggaggctgaggcaggaggatcacttgatcccattagtttgaggctgcagtgagctatgattgtgtcactgtactccaatctggacaacagtgagactatgtctgtttttaaaaaagaaagaaagcttgtgtttgagaagtgatacctctagaatacagtgatttctataatttgtcatgtgtttgggtagtttgaagtttttctatccttgtatctaatggacatctgaccataaagatgaaaaaatcctgcactcattataaattttatttataaaattgatatttgaggagttggggaggccagcttctgaaaaaataacagtgtcccatagaaacaccacaacttaggaaaatattgttaaagtggaattaggaatatctagaggaggtaaagcttttcatctctcaaaaaagaattagggccaggcacagtggctgacacctgtaatcctagcactttgggaggccgagatgggcacatcacttggggccaggagttcaagaccagcctggccaacatggcgaaaccccatctccaagaaatagaaaagttagccaggtgtggtggcgtgcgcctgtaataccagctactagggtggctgaggcaggagaatcgcttgaactggggaggtggaggtggcagtgagcagagattgagccactgtactccagcctgggcaacagcaagaccctatctcaaaaaaataataaagagaattaggacatggatttgtattaaaattataggtagctcatttaagagtatgaagccaattgctgttagagcaagggtttttttcagtagaggtgtcaggataacctatacagctctaaaagtatatggctgttaccttcccatccctgttgaaatctccagggttagaaccaagtattgtgtttttaaaactataggtgagtctacaagagttgggtggagtagtcctctacatcctgtgtttgtatttttgcagtaagtcacacaataacaaaagctttgagaaagattttaggtttattgctaattatacccatgaatgaattctgaaaatgtgtagataaggaatttacctggtgaacggtttacacatggcaattgtgggagggagaggggagtgagaggagatgagatcagttttagctttaagaggaccaaccgggccaagcacggtggctcacgcctgtaatcccagcactttggggccgaggtgggtggatcacgaggtcagcagttcaagaccagcctgaccaacatggtgaaaccccgtctctactaaacatacaaaaaattaactgagtgtggtggcgggtgcctgtaatcccagcgacttgggaggctgaggcaggagaatcgcttgaaactggaaggcggaggttgcagtgatccgagattgtgctaatgcactctagcccgggcaataacagcaaaactcccgtttaaaaaaaaaaaaaaaaaagggaccaaccatgatatcctgactaacctgtatatttcttagaatgagggtttagcctaatattaagaaagtctaatgttaagagacacctagtaagagctcaacgctgtggtaaaattatgatagttatgcagaaacttaaaagctgaagtatccagagacaatatattgtttagaattttctgaaaataaaaattttcttgccctaagtcttgaatttttaagttattgatgttaatatttatgatctttgaacaaatgatattataatagagtatcttttaggtcacagagacccctttttagagctgagaaatcttacaaattcctcagcccatgttttacagataaggaaatgggcatgcacacagtgaaattaaaaattgctagtggtcacactgtacattgatggcaaaggcagggcagaattagaatccaattatcttacctgttcagtgtctttaatgatacagcaagctcaccactgtttctctttactctttaaacagtggattttttttgtcatgattttgatttcttgtataatgcagttcaatacttgtttaattttaatgttggactctcaatttttaagacagtagtacacatgaaatgtgctttatattttatgtttcaacaagaaaatacacattttccttttaatagaggagcttaagttcctaatttaaataattgagtatgagcttcagatacttcagagtggtattaataaactttgcttttccaaatggtttcagataagcatttaatattcaaagcttcctctttacagcttaggaagtggtctggttaagtgacttgagttcatacaggaatatatcggtatgttcctaattcccatcaagtgtaccattatgtaatcatataatcttgctaacagatctaacagattactttttttttttttttttttttgagacagagccttgctctgtcgcccaggctggagtgcagtggcgcgatctctactcactgtaacctccgcctcccaggttcaagcaattcttctgcctcggcctcccaagtagctgggactacaggcaggcactaccacacccggctaatttttgtatgtttagtagagacggggtttcaccatgttggccaggctggtctggaactcttgacctcaagtgatccgtctgcctctgcctcccaaagtgctgggattataggagtgagccactatgcctgtcctctagggaaaatctttaattcattctggacaatgagaaaacttttatttttacttttagttaacaatactcaggaaaataaaaagtgtgctttttaatcttagtaacccaatttgagtttgaaacaaatttacataattttagctgcttaatatgctgctgaagataaatgcagtaaatatcccaaggtcaagatttgaaatccaaatgtccatagtaatgattaacaggaaaagagagtcctctgttaactttatttctcaattttttacaggtttggataattaagggagcactagaaaacttttttttttttttttgagatggagtctgttgcccaggctggagtacagtggtacggtctcgactcactgcaatctccgctcctgggttcaagtgatttctcttgcctcagtctcctgactagctgggatttacaggcgcatgccaccatgcccagctaatttttgtatttttattagagacgggtttcatcatgttggtcaggctggtctcaaactcctgacctcgtgatccacccgcctcggcctcccaaagtgctgggattacaggtgtgagccaccgtgcccagccgaaaatgtttctttgcaaggataaatatatgaagataaacttgccgagcgtaaatatgttcatgaatatagccacttaaggaaattcaaacatgcagagatgttcagctgtatgcagttatgtattcatgaagtattcatgtattcatgaagccttatttgatgtagaatctgagggtgctgcctatacataaacttgcttaaaggttaaaacttaaggaatgttcatcaaagtcactttcttacacctaactcctgatttcatgaatataacacataggtgcttatcaaactgaataccttggagatgagctgctccagcaccagaagataaaattcagtaactgtaatccttgaggtacctaagtgatacattttttttaagactgagccaaaataaaacagctttcctccttccctaccctctccgaccaaacttttagccattttatttatttatttatttgagatggggtctagccatgtggagtgcagtggctattcacaagcatgatcatagcaaatgacagccacagactcctgggttcgagcaatcctgcctcagccactcaagtaactaggactacaggcgtatactggggcttctagccatttatatggtattaagtgacagcttctatagttacttggtacttgtccctgtaaaactgcacagtgtgtattctcttggctcaattattagcatattctgccatttccttgtgaatgttttgtattttatataggaaaacttaagtttttaaatatcctgaaataactgaagaattttgtttttgcctttaagtggtaatgtataaagtatactattgcagagatacttacagagtgctttcattgcaattaaaatactgcagctaactagcatgttccatatgtgtaatctaaatgacatactggtcatgtgctatttctatggaatactaacagtagtatggtacatttatgcagtctcaacagtttaaagtgttattttggtgataaactgtttacatttatttgtttttatatttggcagtctaaatgcaagagtctccatttcagctctttactctgcatatctttaatgttgggcattatgcctctttcttgagtttcagtcctatgactgttccattttcagtattcatgtttatgtgtctttctaaaattgttttgcttctgtttcttgctgctcttgagacaatttatgggcaaattttgttacttttcaactggccgtgtatttccctgtgaagagttgctggattgtctcattttccagataaactgaattaatgtagtagtgaggagaagccagatttcagaggtttgacaagtgaacaaatgggaatgagaaaagaagtaggtacttaaacttttaagaagtttggctctgaaaaaggcaagaaataatgggttagagagggcaggattgtaaggatttaagataggagaagaggcataagcatatttaaatttccctacttaagggccaaaatcatactgtacctcagtctgaactttttaaaggaattcaaggacacaaaattctgccctgccctgaaatccagtcaggaggaagggagaagagctctgaagtacttttgtaattttcttctacataataattgatttttgtttgattatttttctttcctatagctcctgtttgccaggtttttcatagctgcctatttaaccaaacttgtactcccaagaatagtgcatatttatgattcttaatt

SEQ ID NO: 322 - DNA, 14552 bp, Homo sapiens
gagtgagcagaaaagaatttgttaaaaggagatgggaagactcagagaatcaatgggaggctagaggaacaggtatggaattaggcttccaggaacaatgcttaaaactatcccataaaactggtccaatgacaaagtcaccgccacaacttattaatgccctaccaaacactaaatgtaactgctgccactcccactgcccagcaaggccactactgcactagttgtggccttgcaagcactgccatcccaaatgtcatatgcctttatcagcaaattgttttcaaagcagaatttttcctttctcaagctgctaacttccaaatcagtcttctgcaggcgtgctggccctagctttgagagtctggaaaaattttcagagcttaccttggggaagcaacacttatattaagattggaaattccctaaacatagcaaatatattcaaaacatcctgagctaccagaaaatatgaaaatgtttactacaggagaaaatcaattttagttaagagtatatgctaagtgtcagatgctttaaatcacattacttaatgctcacaaaaatagatatttaactctattttagtgaagggaaagctggggctcagaaaggatgttactagccctgaattgtcttgttggtaaaatggagaacagagattcatgccaggcttttatccttccaaattcttcattttattttatcttatttttatttttattatttttttatttttttgagacagagtctcgctctgttgcccaggctggagtgcagtggtgcagtattggctcactgcaagctctgcctcctgggttcacgccattctcctgcctcagcctcctgagtagctgggactataggcgcccgccaccacgcccagctaatttcttgtatatttagtagagacggggtttcactgtgttagccaggatagtctccatctcctgacctcgtgatctgcccgcctcatcctcccaaagtgctgggattacaggtgtgagccaccacgcccggcctattttatttttttacaacagaactctaatttccacttcccagcttctaatgcacatataagcagtggtgtacaaagtagtggggccgtggggagagtaaaatcatcagctcttgggagcaggcaaccaaagatgccttatgtgggagaaaatttaaaaacaatagtaaaacagactaaaaatagatctgcttttcaatgataatcatcatgtgatatcaattctaaacaatgtcagcaataaaatattccttcttgctgaggtgaactgttccccactccttggtaaccagtacatataggaagcccccaagttaatttgcaagatttttccaaagagaagtttgtttagaacttgtaataaaagtgccataaacagtcttattttcctagagtagaccataaagaagccatttaatacatgatgtactaagtacctatcttttaacattgtttctaagaataaataaattccaattttcattttggaagcacatctctcccaattttggcagtgtgagaaggggctgtttatcttctagtagcatcagaccctctggtaatatgacagaacctcctgggagagctccttgggcagcagaggctctcttggcaagatggctgttgcagatgaggagaaagatgggtcttggtaatttatacagtagaagaggaaagggcacctctttaaactggcaagagaaagtaactatttaggttaataggtttagagagtttgagatcttgaaacattactttgcaccaccaccaaattatatgctgaattcattcataaatagggaaacttggctgggcacggtggctcacgcctgtaatcccagcactttgggaggatcgaaattattaaaagactactgactagatcaatgaaacagaatagaaagcccagaaatagacccactcaaatatagtcaactaatctttgacaaaggagcaagggcaatacaatggagcaaagatagttcaacaaatggtgctgaaacaactgtccatccacaagcaaaataaaaaataaatgtagacacaaattttacatctttcataaaaactaactcaaaatgtatcacagatctaaatgtaaaatgaaaagctataaaagttccagtagaaaacagggaaaaatctaggtgaccttgggtttggtgatgtctttttggatacaatacttaaagcacaatccataagagaaaacactgatagttggacttccttataatgaaaacttctgctttgtgaaattcactgttaagagaataaaaaaggctgagcatggtggctcacgcttgtaccagcactttggggggctgaggtgggaggattgcctgggcccagttcaagaccagcctgggcaacaaagtgagacctagtcatagagacagagagagatagagatagatatagagagagagaagacaagttacagattagaaaaaaaatttgcaaaacatatgtctgacaaaggcctgatatccaaaatgattaaagaactcttaaaagctaagcagtgagaaaacaaacagcccaattaacaaataaaccaaagatctaagcagacacctcaccaaagaaaatattcacatggaaataagcatataaaaagacactcaacattatacatcatcagggaattacaaaatgaaacgatgagttattatcacacacctattagaatggcccaaatccaaaacattcacaacaccaaatgttggtaaggatgtagagcaacagagtctttcatttaatgatggtgagaatgcaaaatggtatagccattttggaagatagtttgagttttttagaaaactaaacatacttttaccattcaatccagcagttgcactttttggtatttacccagacgacctaaaaacttatgttcaaacaaaagcctgcacacaaatgcttataacagctttattcataattgctgaaaacttggaggcaaccaagatatcctccaataagtgaaagaatacattaactctgattcataaattcaatggaatattattcagcaataaaaaaatgagctgtcatgccaaaaaggtatgaaggaaacttaaatgcatattgctaagtgaaagaagccaatctgaaaaggctggttactacctaattctatctgcgtgacatcctggagaaagtaaactatggagacagtgaaaagatcagaggtctccaggggagcaatgactaggtggaacaaaggggatatttagtgtagtgaaactattcagtatgatactgtaatggtggattcatggcagtacacatttgtcaaaatccatagaatgtaaatattagatggtgcaaaagtaattgcggtctttgccatttttaatggcaccaacctaatacaaacagtgagccctaatgtaaatccccctgcctcaacctcccaaaatgccgggattacaggagtgagccactgcttccagctttcctagttcctttttatagatggagtttcactctgtcacccaggctagagtgcagtggcacgatctcagctcactgctacctccacccaccaggcccacctcagcctcccgagtagctgggaccacagacgtatgccaccatgcccaactgattttttaatttttttggtagagacatgatttcacaatgttgcccagggtggtcttgaactcctgagctcaagcaatctgcccgcctcagcatcccaaagtgctgggattacaggagccactgtgcctggcttacaagctctttttgaggattttctttttctttctgtttttggtctatgcctagtggcatttctgagttgctggcttcttcagctccaattctgcaatatatgacgcaaaaagaatacccaaggtatcactaccattttgttccttgagtcctgaggtccctaggtggtctgctttctcctctctatctttcagagtcttcttcagtttgttttataaataatgtccagggtttttagttgtacttatcaggaggaatacagaaattcctatttattccatcttctcacaagcattttatgaacttccctatttcactaaggagttcttcagtaagaatgctgatggtatcagctcctagttgtgtatgaaaagatacagaaagaaagagacaagagttaaaaatggccagtagtcaaaccaaatataaagggagtattaagggcccaggacttcttatgttggaaaataaaactttctatctccagtctctccaattaaaatatagcctggtagccacagataagatcaagggtataaatacaagatccttcatacaggtctttgaaagaactaaagtataactattagaccttatcagcagggcagaggggttttggaattttagggtcatggtcttacagaaaccttttcccaaagtaaaaatctctatatacagaagtatgctttattattattatttgtttaagagatgggatctcactatgttgcccaagctggaatgcagcggctattcacaggtgcaatcccgttactgatcagcactggagttgtgacctgctgtttctgacctggattggtttacccctccttaggcaacctggtggtcctctgctccttggaggttaccatattgatgctgaagttagtgcagacacaaaattgacatagcacattacagtccagaactcttgaactcaagtgatcctcctgcctcagcatccagagcagctgggactataggcacacaccaccatgtctggtgagaggcatgtcttaaaaacaattatggaggctggaaacagtggctcatgcctgtaatcccagcacattgggaggctaaggtgggagggtcacttgagcccaggagtttgagaccagcccgggcaacagagggagactctgtctctacaaaaaaatttaaaaaatttagctgagtgtggtgcatgcctgtggtcctagctatttgggaggctgaggtgggaggattgcttgagcctcacaggtgaaagctgtagtaagccgtgattgtgccactgcactccagccttggcaaaaaagtgagaccctgtctcaaaaaaaaaccccaaaaccaaaaaaacaattatgattgtgagctttggagcatgacatagactataatcaaatacatagcacacacaatttttaagtaaattttataggtaaaaaagctattagcatgcccttaaaaggactgagagtattcgaatatgcaaaaagacctctggatccctaatttgccattggcagaaagcaggttaagaaagttagtcagctgccaacatgagctacttaagatgtatccaaaggacgatggagaagaaaaggtgtctcataatatattgctcagaatctagagccaaaactcacaggacacaatggaatacagagccactcccagagacctaagctgggccccaatcaaggaatattccctttcccaggaatagagggatctgataacatgtgtctagaagaatttcaaaactgctcggaaccaaggactgaagtgtgctaacttttctctttttgaatggaagtatttatgtgattttccactccttatttcaccactaaatattgagtgtatgagggacaggtaacctttttcactttatagatttgcatatcaggacgtgctgccacattggtacctgatacagaacatgaaattctgaagtatgaaaccatgactggacgagaattagggtgtcttgcggtagaagtgaatgtatttgtatgtgagtgtatgggaaaagacatttattttctcatcaatcaccagattcatggctgaggcccctataacaaaagaaagatcaataggagaaaagcatacaaatttctttaatataagtttaacatgacacaggagctttcagaaatgtagactcaaataaacagggaagtttgtataattttatgctatgtttgatgaagaagtggatagctgagaagtatggagaaaggtgatgtgacctaacagtaataaactggagggaacttagcaaggcttgtttgttcagatccttctctgtgaccctgtgccttcagagataaggatgttcctttcctccgaaaataggaaaggaacctctgacaagagagtcatatgatcttcttcaggggaaggtcaggaaattaagttttatggctgctccaggaaagaaaaatgagggggaagatgagagtgaccttcctgcttctgctgttttctcaaatgccatgatatcatattttggagtaggaagagggatcataaggagggatgtgaataattgtggccagagagtggactgtggtagattctaaaaatggctacaattcttcaaccctttctatatccatgtcctatgcaatgtgactttgcagtttctcccattaagcggcggaatctatttcttcactccgtgaattgagctggccttatttcttgctctggttaatagaatgcagcagctggataacatgcaagttctaagtcttggcttcactgttgctcattctcctaggcactgccatcatgaaaataagcccagactactcttctggataataagtgatacatagtctagttacctttgttgccttagctaatagctagccagtcaccagacatgcaagtgaagctataataaataagccagcccctggccattctgtcagctgaataaagggattagccaagatcagttgatactgggccagatcagcagaactgcccagctgactaataggttcatgagcaatgataaatactattgttttatgccactgaatttgagattggtttgttaaatatacagcattattgtgacaatagataacagacatatatggagtactgaagtagcggtccaactggcttcccttgactgcatttctgcctccttcaatttcttctccatactgctgtaacagtgatctttctaaagtgcagatctgataatgagtttccctatttaaaattattcagtggctccccaggtttttcaagataaaggttatgtttagtctcatacaatcatttttttaacctttaagctctgttgggcttgacaataatctagtcttagctaagtctaccttctttctttcttttttttttttttttgagacagtctctctcttgtcgcccagactggagtgcaatggcgtgatctcagctcactgcaacctctgcctcctgggttcaagcgattctcctgcctcagcctcccaagtagctgggattacaggagcgcaccaccacacccggctaatttttttttttgtatttttagtagagacatggggtttcaccatgtcggtcaggctggtctcgaactcctgacctcgtgatccacccacctcggcctcccaaagtgctgggattacaggcgtgagccactgtgaatagccgtaccttatttctttttattcaccttgtgcttaaattcaaagttctctgaattctgatgggtctagagtgagcttgggtatggttgttttaaaatatgtctacaagagtttggtactcttcccctcaagaggtagagcctcttcaaaaggtagaggctaattcttctccccttgagtggacttaatgaccaggttttaattagttcctcttctccccatccctatgtaatcactaatctaacttctgaatctatagatactcaatttttagagcacttatataaatggactcataaaatatgtagtcttttgcgactagcttccttcacttagcatgttttcatagttcatccatgtcgtagcttggatcagtatttaattacttaaaaaaaatagaggcagtgtctcactatgtcgcccaggctggtcttgaactcctgggctcaagcaatcctcctgcctcagcctcccaaagtgttggtattataggcatgagccactgtgcccggactaattcctttctgttattattgattaatattttattattcaataatatcaatatattgtatgaatatatgacttttttattcatttatcagttaatacacatttgtgttgtttttactttttggctattataaatagtactgttataaacatttatgaacaagttgctgtgtggttgtatgttttcatttctgttgaatatataccaaagagtagaattgctgggtcacatgataaatctacatttaacattttgaaaactatcaaacttctttctaaagccactacaccattcttatgagcaatgcatgaatacccaacttttgttgacattttttattatctgtctttttactatgaccatcctggtagatataacgtggtatctcttatggttttcatttgcatttccctagtggctaatggtgttgagcatcttctcatgtgcttattgtttatttgtatatcttctgtgaaatgtctattcagatcctttacccctttaaaaaattgggttgtctttttattactgagtagtaagagtggtttttatactttggatataaatccttcaaccaatggtatagtttggatgtttgtcccctccaaatctcatgttgagatgtgttccccgatgctggaggggggacctaatggaaggtgtttgggtcatgggagcaaatctctagccaatagcttggtgccctccctatggtaatcagtggttgtaggctcacatgagatcttgttgttaaaaagagcctagcacctcttcccttctctcttgctacctctcttaccatgtgacatgccagctccttttctcttctgccatgggtaaaatcttcctgaggcctcaccaaaagcagatgatggtgccatgcttcttttataacctgcagaactgtgagccaaataaacctcctcctttgtttataaattactcaatctctggtattcctttacagcaatataaaatggactaacacaaccagtatgttatttccaaacattttctctcattctgtgggctgtcttttcattttctattggtgttctttgaagcactaaactttttctaattagataaaagtgcgatttgcctcttttttttttttaatcttgtgcttttggtgcgatatatgagaaggctttggctaagctaaagtcatgaaggtttacttctatttttttcttctaaaaattttatagttttagctcatatatttagttctacacccccttttgagttttgaatgcttaaagaagggatccaactcctttttttgcatgtgtctatccatttgaccctgtaccacttgttaaaaggctttttttccccattgaattatcttggcacttttgttgaaaaacatttgaccgtaaatttagggtctatttctagactctcgatcctattttactgttttacatgcctatcctcataccaatatgcactgtcttgattattgtagctctgtagtaagtactgaaatggggaaatgtgagccctccaactttgatcatttttttcaagattgttttggctattctgggtcccttgcatttccatacacatcttaggatcagcttaaacatttttgcaaaagaggcagctggaattgtgatacaaatggcattgaatctgtagatcaatttgaaaagaactgtcatcttaacaataagtcttctgatccatgaatatgggagatctttccatttcctcccatttaatatgggaggtcttttcaaatttctttgaataatgttttgtagctttcactatataattttgcatttctttaaatttattcctaagtatcttttgatgctaatgtaaatggaattgttgtatttttattgctagcatatacaaacatgactgttgtattgattttgcatcctgctgaacctgtgtattatttataataattttttagtggattccttaggattttctatattcaagatcatgtcatctgcatggctttacttcttccttcccaatctacacagcttttatttctttttcttgcctaattgccttgggtagaacttccaggatgatattgattagaagtagcaagagtaaacatctttatttttttcctattcttagggggaaaacattcagtcatttatcgttaagtatgttagttgggtttttcataatgccctttattaggctgaggaagttcccttcaactcttagtttgttgagtgtttttaatcatgagtgttagattttgtcaaatgctttttctgtgcccattaagatgattatgtcatttttgttttttattatattgatatggtatataatgttaatagattttcagagattaaaaaccaactttgcattcctgggataatcccacatttttatggtgtataattcttttcatatgttgctggatttggcttgtgtattagtccattcttgcactgctataaataaatacacaagactgggtaatttataaaggaaagaggtttaattgactcatagttctgcatggctgcagagggctcaggaaacttataatcatggcagaagggaaagcagccacctgcttcacaaggcagcagaagtgagagaagtgtgtgaaggaagaactgtcaaacacttataaaaccataagatctcgtgagaactcactcactatcacaagaacaccatggaggaaccgcccctgtgatccaatcacctccttcccttgacatgtggggattataatttgagatgagatttaggtgaggacacagagccaaaccatatcagcttgttaatattttgttaaggatttgctgtattttgaattgattcaattttttctaccctttaacattgagtaaagtacaatatatgcaagtatttttagctaattattgcatttgaggattcattgagtggtaaagataatctgtaaggtcttgacatgtagtgatttgcattttgaggaagtaggtgtctaataaattatataccacaggaacagggtacatggtgttgcttagctggtgaaactagccaaagaataagctttcaaatccccaaatggctctattctctaatttttattttatcaagcactttgggggccaaattacatgctagagtggcatacctcatatgaagcctgttcctctcaaggcccagttttggcaaacaagcttattaaaacacaaaaaaatacctattcaaaaccaagaataattttttaaaactaaaacttttcaatctcttaaagaacatcaaatgggatccaattaaaatctcacagaacttctcaaaatcatttccccactcctctccctctcaactgctcacagaaagccacatttaagggcttttgctgctcgcccacccccacccccccgcttttttttttttttttttaaagacagactcttacggtgttgcccaggatagagttcagtggctcaattttggctcactgcaacctccgcctcccgggttcaagtgattctcctgcctcagcctcccgagtagctgggattacaggtgcccaccaccatgtttggctaatttttgtatttttagtagagacagggtttcaccatgttggccaggctggtctcgaactcctgacctcaagtgatccgcctgcctcggcctcccaaagtgctgagattacaggtgtgagccactgtgcccggacttttttgtcttgtctatttttttcccccatctcctgccttcctgtatccacccatttcacctttcagtagagaagctgcacatttgtggcccctaggccaaatatggcctatgtgtgcatttaatttaatacggtgttttacaagcaaatttaattagttgtcaacatttacaagttggcaaatgaaacataaaaatctgtatctgatttgtgtcgagaaatctcttaacaagtttgaaggtttggcaaaatgttgccttcattttacaactggctagcagtgaatagtgactgccttcttcaaatatgacatctctctagtttgccagtgtttacattccctattgtttatttgtggccaattttactatttataatatagacctggcccctgtagatattggagtttgtgccttttaatgctgtcctttccattgtaaattagcctttctcagattccttccaattttgcaacttttctattatattgaatagcattaaaaaggtctgagagctcagcaggatcccttgagaactctcaagagtccagaggtgagctatagccttttggacactataagcattaatataatccctgtgcagaaccctatcagttagagaagagaaaactcacacaactgattagagtaactttgtatatgtaagacctctttccgggatggaaaaccagctctgagaaaagggagaatgcttggccatctgtgccagtgttgttagaaaagtagtgatttacaaaatcggtctcctagaagacagaggggatggagacagaaaacaggtattacagtaatatcaaggggacctgtgagaaggaattgcaacggcaatgacttgccataaatgacatacatacctcagctaatcaattgagagctgttactttctctggaggtgtctcctacagggctgtacaaatcccttgactgtaaggaaacatttgtgcttactttagtctgtttctttactctactctttaaattcttacttgtatttctcaaagaccttaattatcttagcgatactgagacaactttgtggcatttaatatttgctacaattttccttataaaacacattctccactctcttcaataagaatagatttcattaaggcagggcatggtggctcctgcctgtaatcccagcactttgggaggccgaggcgggtagatcacctgaagtaaggagttcgcaaccagcatggtcaacatggagaaaccctgtctctattaaaaaaatacaaaaattagccgggcgtggtggcacatgcctgtgatctcagctactagggaggctgaggcaagtgaatcgcttgaatctggggggcagagattgcagtgagccgagattgtgccactgcactccagcctgggtgacaaagcaagatcttgtcttaaaaaaataaacttaaaaataaaaatagatttcattataaggtcaagctaaaaacaagaccacaaatcaaaagctgcatttgcaattcatgtacatgtttggacttttagataacatttcagcaatcctctatctaacaatggaaagtaacatgtttgcaattggcaaaacagagtgacgtcaggttgcctaaatgtcattatatactaattattgtataactaacctctacttgtttttaaccagttattttagaaagcggcagatttccttagtaattaattgaataatttttgattgataacaatattttgatgtcagatggaatgcaacaatttagaccagagtaggttagcatactaagtcaccaagtctatacatatatataaatcatattttatcatttgctcatttatgttcctactccaagccatttgttattatttgcatatgtagaccaaagaaaacagtatgtgtgcttaaatacacatatataaactccgaacaattatatataaagtgcttagatttctggcctatagtaaaccctcaacaaatgttggctgtagttttttgtaattttcattaattattctctttacagtgctttgtctcacaagtacttggatctcatcctcgctcgcacacatttccctgttttgtttgtttttggtttattttttgagacagggtctgcttctgttgcccaggctggagtgcagtggtgggatcacaactcattgcagcatacaactcctgggctcaagcgatccaatctcccatctcagccctcccagtagcttggactataggcatgcaccaccacgcccggctaattaaaaaaaaaaatttagtagagacaaggcctccctatgttgcccaggctggtttcaaactgctggactcaagtgatcctccgcctcggcctcccacagtgctgggagtacaggcctgagcatacatttcgccaaatcttattcctactcaactggccacagatagttgctggacacacatgactttcctacactgtttagtttttgaaaacctccaaatagcaaaacaccaagtaaagcgtactgcctcgccccgtttttttcctgtcctagatcatgtaccctgttcccaaacagagatgaattagcttcatatctaaccacaaattctccatgagcacagagatcttcgtatatctataataattgtactcaggaaactcaaggtatgaggagagagattcccttccttcggggcttgtaggagacttcccacggaatcttctttgggaatgtctcccttttaagccctgaaagaccagataaatctcaggtgaacctagagaaacagggagcttcgtatactcaaaagtctatacattacgtattattgaacggcgacctgcggccgcccctgctgctgcgcatgctccataactgccgcttgctatagctgggagtactgtattatctctttgctcttcgccggctcttccccagacttctgttcgaacttccc

SEQ ID NO: 323 - DNA, 6510 bp, Homo sapiens
gcaatggtcagagagggactgggctttgtctcttagggtctccaggatcagcagctgcactgatatttctgacattctggcctcaggccctgagacccttcccacatgcttcggcagagcagttctcctaccctacattcctgagggtggctctcccaaccccctccatgagttaatctagaaatgaggtagagaagaggccttggtcacaaaaaatcacaagataaatttttggaagagaagtctcagaaggcaatgcttagcaccttcctaattctcaaattgtgaaagtggcctttgagctggagggaggggttgaatcctgatgctcatttacacatcagctttctgtctgtgctttgggtttctcagccacaaaatagagatgattcatgctgtcttcctcagagcctgttgtgaggctggagagctaatacatgtgaaacgcttagagcagtgactgctcttatcatgtgggaactccagacttctaagagggatttctctttgccctcctggaaaagtatgtgtggtgtgggtgagggatgggggtggcagggtgaggactagtccatccagctgtgtgggccctgagccttccagccatgcaggtgcttctaagggcaggagggacactctctgagaggcccacagacctgcctaaaccccagtaaaggctgaggctttgtggagggttgccttatggagagttaaagcattgctgggggttgaggcatccctgaaggccagggagggacatggccttggaagggagactgagcttggtttgacactcagccctgacctagctatctgagtcaagaccactagtcattctacaactgtaggaaaaaatgcactgtggactcttgaggccttttaaaggactgttaaattaaatgagattgttagattaaatgagaaatgggtgttgatgttctttgtaataaaagcaaacttcaggacaataatgaagaagaagaatccatagcatctctgctagggttgaggagggagatgtctgagcctttgggtgcttgggtgttggagaattgctcttggacacaaactgcactgggcccttccagtcagtggctgaggtggcagcaaaccttgagcttggggaggtcttcagctgccagtctcaccctgggtcctccagccctaggatgggccagtggtgggaatggggatgtggaccagacatccttagcacagggccaggaagctaccaggctggccttaaggagcccaggcagacaggtgtacaggcaggagtgcagcagggtcagctgcctcccaggacctggccctccattccaggagggtggagaggagggggcactcttcaaaatcagagttccagaagccgcagtttccccctgtctgaaggagaaagtgttccacggtgcctgccacagttacacagctgccaccgactttctcagcagattccactgcagtgcaaggaggtgacaggagtggtcaaccctcatctacctgcaagtgtgagatccactcgaccttattccccaggggtgcacccagcagtggcactaggttcccaaaagggcatcagcagctgccaaggcagaagggggaagcgggtcccagaaccacccacctccggctgtccccaccgcgaggacccagcagtctggcgcccccaccacggcctggaagatgacggagggcccaagactaatattcacgacagccagaccacgcttattgtttagaaggaagctccctttgttcttactttttaaccaaagagaagcgaaaacatttttttcctgatcacattttcaccgacacctgagccgacaagccagctcctggcccccggctcaggactcctcgctctctcccttctcggggccctgtcgccgttgaaaggcccgctgcaggctggggagggtgatcggggccgcgggccatctcccccgagccgggcgggcagactgcggaggcaggccccacacgcgccgcttttccgagcccggttttcttcaggagcgaagctgttccagctgacccgcgcgtctgggggcctatgcccggcttccgattccatttaaaacgacccgcgcatcttatctccgtcgcctccccggggttcccacccacccccctccggcccgggccaggccagcccagccccggcggaagccaagctgggagcttttgaagtccggagaatttcaatccgagaggagccggctggaccggagcccgtcgccccagcgggggaagggacggggggcctgccgtgtggcaggtgggggatgggtgtcccccgccgcgagaaatgagaagccgccgggcctggagcggcctccacctcagctgctatcaccccctctccgctgtcatgggattgcccaggcttaatggggttgtgcagggcttcacttgctctcggaatttaccttccttctcgagccgtgccgcgaataaccttcacgacacagtgataacgatgttattaaatactccccccacattcaccgcccaaaaaaccaaaacagtgttcttatccagtcctctctttttttgtcttctttcctttaaaaacccaaccgctcttaatgtgaggttgatgaaaggatgcttttggaagaagtgacatttggttaaaacgttttccccctaatgcgccggtggaaaggggcgggggtgggtgtggttccctaggctcctaagactggccagtcagctttgaaagagcggggcagaagtcgggagagggctggggaaggctttgggctgaggggatgtgtccctgaagcttcagatctggagcccaagggaggcaacctccctctgaaaagccggtcctcagctccatccagccctctccgcgggatgtaagccctgctccgtagggcccgacccaggaagcagactaagtggcactccttgatctctcactcctactcggctttcatctcacccagaagaaaagcggatcaaacagaggattcccattgaatgcagagctgggggcggggtggggagccaggagtccctctgaggacccagcccccaggagatgggggcagcaggctactcacgagaaggttaagcgctcaaggaggaaaggagggtgggcacctcaaaggcccagtgctggagggccctatagagagtaggcaaccttggaagctctaagacagatgcccagggggcttgccattgacaggaaagagagcaagccaggtgctccctcaggctgtggctgctggtagggaggacagagaaagatagaatacctggacagctctccaaggcaggaaaaggttctaggatttgactcccctcactcccaattgatcctctcacctctaaaacatttccctggattttggggctagcagtgctcagcatatagtggcttcaggagtcccaaggagtagaaatatctatgtggacactaccttccggatcccgctgcctccgcccccaggcaagattaatgaacatcgtcttagactgaaagagaagtggaaagccggagtgaagaggaaactttgtctttctttggaccccttacttcctctaccttccttaaccctatggataggaagatggaggagagaagcaaagaaggagaagaatacagaaagagaaaaaggaggagagaaaagtaggagataacagataaaaaggtcacggaagaggacttacctgtaaaagctggggctttgctagggacacagaaaggagggaggtgctgggctgccctttgcagctggctgcctagggctagaagctcttcgggaggaggcggagaaaggggggttgagcatagaaggtgcccacctcctgctctcagcaatgtggggatagactcagcccacccacctggccccagcacacttgcttggagctcaaaaagggtcagtttgaaggagttttataccagcttcttccctgggagaggagccaagagaggcctatggcagcttccagatattaagttccacaacccctgcccccacctccagcccttcatcagagtccctacttacttgctgttttagggcattttcagcgacttcactctcttctacctcaaacgccatccacttttggagacaggtaccactgcccctaggcagggacttgggagaggaccttatgagtcaaacctctatgaaccccaacctttttgtactcggggaggctgaacccctgcccaaaatagcgcggtgaaagctactgccttctcccaagtaggggcctccagtactgccacagcaggggccgcattcctggcgcctcttcattcgaaaaacctctttccaggagacttcgctgattctgaacgaatactttaaaatatgggcaagggaaaaaaaaagacaactcttagaaactctccccacccaacatacctggagtgcaggcgaggtccaggcaaacgggaaagcgacttcttgtacgaatagccatctcaagatgaagccaggctgtggaaaacttaaggccatctagatgggaaggaggtatttaaaagaaatcagcacacactcttacagaagccaaggcgggtctttaaattaaaaaataataataaggtatttatttcttgccccttagggaagaaaaatagcaaagtttggttcgcaggagtaaggagacagaggtgggtagggagagggaggagaaaagaggaaaagatggcccagcctcaagctctccagtcaacttggggcgggggaatacatttttccgtagcttgtaaaaagacttttcagccagtttgaggttagctgccaggggcagacagttgtaataatgccgacagaattgaggcttgtaagccgggcttcacacttctaaaatgcagttatggattctttcatcggtgttagatcaaggcaccaagttaagaaaacaaaagtcaaaacaacaataaaagaaaaaatcaaaagcttatttaattaccgagtcccgctgcccctgcggaactcgccgcgcgcgttaagctctcttttctttctgcggaattccatttgcatcccctctgcctgggtgtctccctctctcagtgtgtgtgtctctctgtctgttttcacactctcctccccaatcgagcgaggcccacacctggcgcatcactgccgagccattagctgcgggtttcctttcatcttcgctgtggcagacgtttctatttatccacttgcgctcgccgagtggcgtcaccagcggtactgtaatgacgattgcagcaggaggatgacagcttagaaagaagagggcaatggggcttcctcccagaggcggtgcggcacagaggagcgctcgcttcacaaggtgaccctagctcccaccgccaccgccgcggtcgcggtccagaccgcgctccagcagctccgcgccctcccaggcacccggcctttctttctccctcttgcaaccaagatccgtccggccgctggagacccagggagccggggttaggaactcacttggggctttcccctcccccaccggagagccccgggatggagagccgaaaggacatggttgtgtttctggatgggggtcagcttggcactctggttggcaagagagtctcaaatttgtccgaagccgtgggcagcccgctgccggagccgcccgagaaaatggtgccccgtggttgcctgagccctcgggccgtccctccggccacccgggagcgcggcgggggaggcccggaggaggagccggtagatggactcgcaggcagcgcggcggggccgggcgccgagccccaggtagctggggcggccatgctcggcccaggacccccggccccctcagtcgacagcctctccggacaggggcaacccagtagctcggacaccgagtcggatttctatgaagaaatcgaggtgagctgcaccccggactgcgccaccgggaacgccgagtaccagcacagcaaaggtagccaccgtgcccctccgctccccgggcctcccactgcgcccacccttcacttcggcgcaggccaggaggaagacactcccttcccctagggcaggatggctggggggacccacctgagcaactctctctgctatctgcgttctggcgggggtctcctactgtgttctggcattggcgggactgagggtgacagcagtgccttgagtgcggggtgctgagggggcggatgcaagtcctggacttgggggattcgaagctcaccccaagcacccagtgtttcaactgctcggggaatgcttcaattgctcggggaagacactttccccaggcgagggcaagatcaaacgccgatccgggcagtttgtggctggcagggtgtaagaggcatggaggcgcggaagccaggagtccataaaggaccgtaaaattgcggcccacttgggcagcccgggtgctgcagccctccgaccagtttgcacgtcggtcagaggtccaaattaccttgtcacttcccgggcttcgcggcgccaggtcggaaatggtcccaatggtctaattgccttt

SEQ ID NO: 324 - DNA, 22131 bp, Homo sapiens
cgaactttcaaagggacaaggacgtgcacgccacagccacagccccagaccagggtgtaggccgtggggctccagctcccttctgggcatcactgctgtgtgtccttgggagagtgtctccgcctctctggcacctcccttcactctggaaacctgtccatcaggccaggggactggggtggcgtgcggcctacctcctcccaccttccgagcccaaccccaaaactggataagcagtcagcttgcactctgaacccagaactgaaacgaggattaagcttcgctttgtgcgtgccacaaaccagacaccacatccaacctccggctctagggccaggaactccaatcaccaagcatttttggaaaaccaaatcaaagctagatggcttttctaacatgttatattgtattaaagattgaaaatgacattgagaagtaaaaataaattggaaataactggaaaaatctaaatgtccagtaacattgggggattcattaaaaattctgacccaatggaacgtcgacgagccaccacaatgacctttttaaagaatgttccctgctgggcaaagatgctcatgaaatcttacttgaaaaataaagtaggccatggaaaggtatgtacagtaagatcacacttaggaaattatatataatcggggtgctcaggctttcagaaaaaaaaccagaagaggcacacagagtcacagggcacagagtctgggtggcgggcccctatgagattttcactctctctatgtatgcgtattttgtgtgttatacattttatataatgagtgtattaattctgtgatcagaaggaagtcagtgtttttgtgttttgtgtgtgtgtgtctcaaggcagcattataaaagggactaggtcatcagcttcctcagctaccccacggcaaaccgcccttgttctttttttaacttacaacagctcagaagccaaacttcaaactgctctcgtcaagggttttttccttcacactaagagccagagacatagcaaggaacccggccctgaagcagtgggcacaggctgctgaccggctccgccctgcctctgggaccctgggcaggctgcttgacctctctggcctcagttttccgaactgtgaaatgggagcattaatgacaggatcaacccctgggaagcgcgggtagggttatataatgagaacaccggtaagtgctgggtcataattggtgtcaccataactaacataaatgacaagagaggcagccagtgcctgcacgcccaggccatctgtctttcatccctgggctgcatctctacccaaccctgctctagactccacagagagatgcagaccactccctctccccaccaaaaaaagaagagagatattttgtgtctttaaagaggcaatgtcttccgatgtccaagtcaaacggaacagaaaagtcaggccacactccaccgcctgaccctgggatgcagatcacagaagttcaagggaagatgggggtcagggcagatgcagccaaggctggttccagagagagggcagggctgggagctcagtggggagcttcaccgggctggaagcagaatctcctctatcctggtgtcctaggacaggcttttcatgacatatagtggcggcactaactcacgccaccctccacccatggttacagccatcatccactgctttgccacaggtggctttggaaggacctgagcagggacctgttgtataagctgttctaggtgagctcacctgagccctagagtcctgccttcttgttcccagctttaatattggcccaggggtcagcagagccatttcctgtgtgtcctcgggggcacggcagtgaggaaggaggacctccacggcttacccagacacctccctccctctatccgtgcaaatcccgcgactactgtaatgtcctccacggtaagaaagggcccctcggtcccctgtcaaggcgctgtctgctgcaggtggtgccagccttgcagtgctgtggtaagaggggcatgctttgtgttagaatgccagtctctgcagagttggaaagcaccctcacccgtggtacacggtcctgtcttctccagacagaaacaaagaacacccacaggacagcccaggcttcacccaagcagcgccctggagaagggagtgatcttgtctccttcctgcgtcatctttcaaatggaacaggatctgggggcaagaccagcaaatcggagctgcctgcctgggcctgggaacatcagcgtgggatctcccgccctttcccctgcagcttcaatccagctagggctccgttccctctggaaggtgctaagtggttctgggtgtgataagccttgtctggtcatctggccatgctgggagacctcgctgcttagtgggatttcaaaggagagggatgttggaagtgggaagtttattatcattactactactgttttggtgaagtgcccatggctgagtgagttttaaacatccaagggtggagatttgggcccggcatcatcattgcttctaaggaaagtcagaaaacaccacatgtatatggagcatttgcgttagacatcagaagctagaggcggcgcccttctctgcagcaccctcagctaccctgggccggggcacctgcagggaaaacgctttcatggtttagagacatagacgagccacacagccctgtgtcaatccagtggggccaaccctgctcggagcctgctgcaaacaggcctgtttgtgttggccgatccgtgcctccatcagccagggtgactcacctgcatttagcttggagcgagaaccaaaggccaagtcccggtgagaaccctttccagaggtcctaatcgagtcatctcacggggcttcgcaagcagtcattaggctgaacaactcctgactgtacatataattatgctccttgcacacagggaaactgaggccaagagacttcactttctcagttctgtaattgggctagcatccagactctcttgtctcgttgtctaacccagaagcaggggttattctggatgaaccgggaagtttcctcccaagtctggtgtctggatcagacatcacctgctctctaccaggcagccgtgccagccacagaaggacggtcgggacagtagaacggggctcatgaagaactggatcccagcagatgtcctgtctacagcacacggtggctactcgcctgagccagacctatgcccagaaggatattttttgagaagctgaaagctctggttttcatgtgaaatatgacgatgttttaaagttcactgacagattcaaatgtctttaaaacactgcacagtccaaatgcagcaggtgtggagtagattcagtcctaaagaaatgaatatggggccgggcacagtggctcatgtctgtaatcccagcactttgggaggctgatggcctgagctcaggagttcgagtccactctgggtaacacggtgaaaccccgtctctactaaaatacaaaaaattgggtgcgcatggtggtgtgcgcctgtaataccagctactcgggaggatgaggcatgagaatcacttgagcccgggaggcagaggttgcagtgagccgagattgcgccactgcactctagcttgggctacagagtgagactccatctcaaagaaaaagaaaaaaagaatatggaccatttatctagatcagcacagtctactagaaatataatgtgaaccacaaatgtgattttaaattttctggtagctacttttaaaaagtaaagagaagcggccggaagcggtggctcacgcctataatcccagcactttgggaggctgaggcgggcggatcatgaggtcaggagatcgagaccatcctggctaacacagtgaaaccccgtctctactaaaaatacaaaaaaattagccgggcatggtggcgggcgcctgtagtcccaggtactcgggagtctgaggcaggaggatggcatgaacccgggaggcggagcttgcagtgagccgagatggtgccactgcactccagcctgggcgacagagtgagactctgtttcaaaaaaaaaaaaaaaaaaaaagtaaagagaagcatgtaaaatgaattgtgataacattttatttaactcgatgatccaaacgatgctcatttcaatgcaggatccatatgaagattactgtttctccccgcctcgcatctccatttgggccggccacatttcaggtgctgagcgactgccggggccatcacacaggccagccagagataccatcagatccagcaggcggggcacccggctcacaccagaactccattcaccaaacctgaatctcacctaccaggtggagaacattttcaaatgtcccttgaatgcctgggacttctggccatgctgggagaactcgctgattagtgggggtcttaaaggagagggatgttggaagtgcgaagttgattaacattacagttttggtgaagggcccatggctgagagttcgaaacatccaagggtacagatttgggcccagcatcattctagcttctaaggaaagtcagaaaatgctacatctatatggggcatttgcattagaggtcagaaaaaaggacttggccttaggttcttgcttcaagctaaatgcaggtgagttaccctgaccaatagaggcacagaccagccaacacaaacagggctgtttgcagcaggctctgagcagggctggcccgactggattgatgcatctttttttcttcatcattcttttctttcttcatttccaaagtcgttgccatcacccttgttggccagaactgtttcagtgatacccacgtggcttctcggccttctctccaccttcacctcctctcctcccaaagctaccagtgtaatctttgggacccgcatctgatcttgccacacaccaatggcacccctgcagatcctcttccctccctaggggtgccacgaagcttcaagacaccgcgcctttgtgcataccgttccctcacctggcacccccaccacctttgctcaggctgaggaattcctaaccacctatctacagactgttaaatgttgcctcttctgggagttcttcccaaataaccttttcctgccccacacagcaaaacgaatccccccttgcgttctagaccttccactggaacacctgctgtgcagtcctgggcttggctcacatgcactccctctacgcctctgagtcagggttatctgagcgcgtgctctgcactgtcactgtacctctgaggtctacgtgaactgccccctgtgggctgtggtgcaaaacctgtgtatgtggtggggtattatagcctttacgtgctgttgttcacagagtcctcataacaaccttataacgcagctacaattattatcccccttttgctgttaaggaaaccaagactcagagaggctcatcaacttgtctacagtcacacagctcctgagcagtgaagccaggattcaaacccaagaaatctaagcattctgttaggccaactctgaattcctgcatggtgacagggaccatgatttgttaatattctagcgccatgacggggtacaagtgcttcctgggtgagtgcatcgacaaagaacaacagcacgaaggcacagtcagagcctcacggccagacctttgcctggctgccttgctctcctccttcagctctcagggatgcgtcacctcctcagagccagccctgaccgcctcagctaagcaggcagcctccccacgccccactgtctgtcccactttccttttattatctccacagcacacggcagtgcctgaacttatcccccttgccaatttgtccatccaacgtctcccccgctatgatatctatcctagtgagaacaggtgccagctgagcgcgatgattcatgcctgtaatcccagcctttgggaggttggggtgggagaactgcttgaacctgggaggcggaggttgcagtgagcctagattgtgccactgcactccagcctgggagacagagtgaggctctgtctcaaaaacaaaaacaaaaacaaacaaaaggagaacaggtgccctttctactggccgtggctgtatctgcagttcctaacacagtgcctgcacagagctgatgcgtgctgcaccctcgctgaatgactgaatgaaagggtgaatgaatgcatccctggctcctctcagatgctgccttcttcaccaggtactggcctctgtcaatccgtctggacagagctctcaggccagacagctgagaggtggcgtagaggccaccaatatgtcacagagttatagcaataaggtgcagcaaggctgagaaatctccataggtaaaagaaaatggagtcgcttatcctagtgatgaaactcctcgctctaaagccagcaaacatttcctataaagatccagataataaatgttttagacatctgggccagacggtttctgtggccaccactccattggagtgagaaagtgaccatctgcgaattgtaaatgaatgggtgtggctgtgtgccaataaaactttatttacaaaaacaggcattgggtcagatcacagggcatagttgctgactcctaatgaaatagcttcacatcaatgaaagaactaagtggacatctagcacagagtttaaacattatactggaatagaggttggaggtattgtatgcaaagtatttgtttaggaagattttgcctatttcaaacctgcataattcaaggctgatttttgcaaagaagcacacatcactgaggaattgttctgtatttctgtcgacaagctcgaatggcactgacttttcacgttagggaaaatgtggtttattatcaacgtaggcagcctgctttaaagtcacatgtttttactaattttaaaaattggggtgtgtgtagcatttattccaattttggtctagtgaaagtccatgaatatttgtcatattgccctagtccgaaatcccagaatttgaattcatataaaaggcagctctgtggcatgtgttggtctcgctgtctctcccctttgcccactagccactcagtgctcccttccttctgattttctctgcatatggaagagcgttttgatgtagcaggcacccaacacatgaccacacagaagtaaagcacctgctttacctctcagcttgagaaggagttagcagagcagcagggacctcagtaagacagcagaaagcacttttctctttttttgagatggagtctcactgttgttgcccaggttagaatgcagtgatgtgatcttggctcacggcaacctccgcctcctgagttcaagcgattctcctgcctcagcctcctgagtagctgggattaccggcgcctgctaccacactgggctttttttttttttttttgtatttttagtagagacggggttttgccatgttggccagagggtctcgaactcctaaactctggtgatccacctggcttggcctcccaaagttctgggattacaggcatgagccaccgtgcctggccagaaagcactttctgattataaagaacgtatagctgcgatgataaagaatgtagagctgttattctgattataaagaatgtatagctgtgattccaattataaagaatgtataggttctgcagtcttttcccctggaagtttgtttgtttgataatagttagtgtggactcagtccttcaggaagcaggaggaaagagcagagaatattcctggcatcctttcacacctggcatctaggaagggaaatgtcctttaccaagtatgacttgtgcttttctttttccatgcgctttaccaagcacttaaaattcactgtggcctcaccgcttaaccacatcaaaagcattttgcaatgatgctttttcctctacgaaacctgaagctgtaagtggacctgctattacactggtaattaagccactccctgggccagtggatacacattcaagacgtcaaaatatggtgcaacaggtgccttcctcagtggggccctggtggcctgactcccctgttccccttgataccttgttccatttcccacggatttgcctggaagttggtgggggggctacctgttgcagtcacccaggggcagacagtggctttgggacctcacccttccagtttcaaccacacccattcagcagcagctcaccccagcaagcagctcaccaaatagccgtgtggcgaccagaagagatggtttcctggggcactcactggagacaaagcaaccacagccatccaagtgctgccatcctgagtttatgatgccaaccagccctgggtggattgaaggaagtcctctgagtgaccaaaaggatgcctgccagtccctgtcatcccctgcccgctgaggcccagctctgctcagatgtctgccgtcctccacgggctctaagggtgcatcctagctagtctatgccaatcccagtagtctcctgtgatactgttctggccaatgagatgaaacagaaagtctgttgtggggtttctgggaacggttttcatgatttaaaaaaaaaaaaacattgtagagacacaggacaatgtgattcctctttttgatttccttttgttccactgaacaggcactgcttgtgtatgtgatggcaggagcagaggcagcaatcatgagcgtgagaggacagctggcccaggccaagtcaacaggctggaaatggcacagcagaaagaagaaatgaatccagagcctcgatgaagttctgagtttccaaagaaaccaaccctggaaccgtcccagctgcagaatttctccttctagaaaatgatacatcccttctctgttgaaggcatttccagtcaagtcttctgttacctgcagcctgaagcattctaatctacagagagcccactcctagattcttcctggatctggtttgtaagaattactcagatttaatgactttgagccatgaaatgatggagaaacaactttcctgggcaaaaaagggaagaggtaccagctctccccttctcttgtcccaaacccaacggctttagcccaaagggcagaggaaaaagtgtggagcagacgaagcccaggagcttgagcactggatgcactgcatttaatttccgagtgccacttgtccattcacaggcgcaaaccccaacccacaggagatgctggctactttatggttgcttagcaaccagtgatcacccttctcctgaactgcagtgcccaactttacttttgggggacctcctctacccaattctcagtaaagttagctcagagacgtctgacttcttcctggctaatcaggataccccatccctctggaaacagtggatggttcagaactaggcacacgacctgagccagtccaatgagactccacctcggtccttgcagggcagtctgtgaagggtgaagccaagacagcgagaggcagggccaggagctggagaatggctcaggcttaaaagtacagctggatctcagcttttcaattctgcgagccagtgaatttctccctttcttttcataatcccgcgcagcttggtgttctaccttacctatccaaaggaatcttaagtgaggcagctcccccatgagggacactgacccagacgctgggaattggattcagcttgcaccccctcaagaccgtgcattaagaccaaggtgcatttcttatgtatagcatggtagattgtggtagtgataatgtggttccccataaaattccttgtttccttctggtaatggagcccctctttcttccagggagctgtaccatgtagtagagatgaggttcaatgaatcttccctcccacaccctcccacactcacccaaagagtccaagaccatggcctgtccaattggaactaatccatccagagcggctggtttaggggtgagcccatgacccaaaccgggccactcatactgcttcatgggacttttgccaaaacacatggaaggaagggtctttcttaaaaggtgctctcagcttgacattgctggggccgtgtttgccaaactgggggaagccttgaagagaaggacgccgcacagaggaaagtgggggcacaaatgtgcgtcctcgttttccagagccagcctctgccaaagcgtcaccctttatactcccagatgcaggaaacttgtttagtgtaagccaatttgagttggatttttgtcacttactaacaagactcctaacgaatgcattcaataacaaatgcagcaacaccagcaaagatcagcacttgtgagtctccccgtggtagataccgtgataggatttcccatgaataatctctaattacccattgaggacacaactcccatcttacagataaggaactgatgttcagaaaagtgtcctaacacatccaaggctatctacaaggtagccactagcctttgtgagaattaggaaaaggtgccccctctcagaggaggcttctgagggcacagggttaggtggatgggatctcaaggtctctgtgcacattggagggaggagggaacccttccttgagccagacatagacccatgccagggtgcacggcctaggagtggggtgtgggctagatggcagccccctcgccccaggtagccaggcaccttggtgcaggtcacactcatgcagctgaaggaccccccccccagctccccagacccaaatgacctcacttatatgctatacaaccaagcctggaatttcagtcctcctcatcagttacagtccagccagagaaacacaatctgcaataggacataaatatatgaaaagattcagggagcttggaggcaagtccgaagtctgaaaaggaagctggaaattcccaggcaagaggtgacgctgcggtccggaggcaacacttcatcctcctccaaaatcctagttctgctctcaaggcctttcagctcactggatgaggcccgcccacattcttgaggataatctcctctactgaaaaccaactgattgtagatgttaatggcatccaaagaccttcccaacagcacctaggttcatgtttgatgggctcactggggactgtcacctggcagagttgacacataatgaatgcaggtggtctcgccactcagattcctctccaggagtctccagccctcatcttctggtgtggggccatggcctagactcgcctggcagggtcctggtttgccccgcctgccccagcgtaattagcagccccctttacactttcaataacgtcttgcttgcattgtggaagacagcgtggcaattccttaaagacctagaggcagaaatgccatttgacccagcaatcccatgactgggtatgcacccaaaggaatagaaataattccaccataaaggcatgcacgcgaatgctcattgcagcacgagtcacagtagcaaagacatggaatcaactgaagcgcccatcaatgatagactcgataaagaaaacgcggtacatatacaccatggaatactatgcagacacagaaaggaatgagatcatgtcctttgcagggacatgggtggagctggaggccattatccttagcaaactaatgctaaggataattgggtggaggacacaatcccacaaggcgctgtcccttgcacggccacggcagagggaatgaagaggctcctctttgcattggagccctgggactcctcctgttttccacatccctcctcagtgtgtaaataggtcaggagccagctccacacctcccagctccggagacggcagggccgagtgtgtgcagtgtccgtgcagaataagtcatccactgaattattgaagaaacacacaagggacactgcccttgaactgggaacacgtggaggctcctgtttggttcctgcctttatacagctcacactcttagggggaagcaggtgagcagaagaacggatgcaatgcctcacacccagtgccctgaacagggaagggagggaaagcccgggaaattcctagccaattgcaagacgcatggatcccagccccagtgaaacttaggacccaaggtggtcacagagggaagccactcactgctcccttcacaagcacagctgcaaggagctaaggctgccaggctggcaccgccatgctgccgtcttgggatccactgagcatgttaaggccgtgctcccaggctgagctcaggaagaagcgcaacacaccatttttgcttgactccactaatgggaaaccttgaaaccgaaagactggcttctcttgccttctaggccagaagaaccactcccgggcccaggagagatgaacaagcatccttagcataggccgcaggccccacggggaaagtgggttctctgaccccatgcaggctgggttgaaagtcaggccccgccactgactggctttgtgccccagagcctccgtttcctcctctctaaagtggaaagactatggcacaagcccgggagaaggattcgatgacgtgacacttggagaccacttggcaaaaggtctcgccctatttgggcttcccagggacacagattgcgtggcttaaaactgcagaaatgtattctctcacagccctggaggccagaagtccaaaatgaatatatctgccaggctgcgtacccaccacagggtccagaggaggctccttctgcctttgccagcttctggtggctccaggcattcctcggctcacggccacatcactccagtctcggcgtggccttctctcatatcttacatctccctccgtctttctcttacaacatcaccagtcattggatgtcaagcacagccggataattcagggtcacgtcctctcaagatccttaacatgattacttctgcaaagacgtaatgtagagctttttccaaataagatcacagccacaggttcccaggatcaggacgtgaacaggtcttttgggcgaacaccatttaactcgctagaagcactcagcgagcagctctcagaaacagtggctctgaggacagcagctgttaggattgtcagttctctgcctgtctctaccctccctaattctagggagaaacttcatttactccacaaaccctaggactccctaaacctagctggggtctctcctgcatagaatttcagaatgcttaaaaataaagctgtacaaacgtgtagatatgaaaagtcgtggagtgggtgccagctttttgccattggtcgtggtggcgttttattgtttctctcttagggaaaactgtaggatggagtagaagaatgagttttctggcagggtgcagtggctcacgcctgtaatcccagcactttgggaggctgagggaggggcggatcacaaggtcaggagatcgagaccatcctagccaacatggtgaaatcctgtctctactgaaatacaaaaaaaaaaaaaaaaaaattagctgggcttgatggcacacatctgtagtccaggctactcgggaggcagggaaatcacttgaacctgggaggcagaggttgcagtgagctgagaccgcaccactgcactccagcctggtgacagggcaagactctgtctcaaaaaaaaaaaaaaaaaaaaaaaaaaaagaagaagaagaagaatgagttttccatcaaaatggacagccttggtccatggtcaaaatggacagccggcccaggcttgcctggtggccctctaagcagaatccaatccctgctgaccgtggcctcttctgcctccggggtccaagccaccagcctatctcctctgaaccactgtggctgtctcctaactgtttctctgcttcactctttccctgccactatgtgtccttgatgcactagccagaagggtcctgggaagactgaagtcagagcatggctctcgtctctccagaaccctccgtggctccccatttcactcagagtcaaaatcaaaaggcccatagacgccatcatggcccgatttctttccctcccacttcctctccacacacctcttctgtcagctaccttctgacgctggcccctatgtcctgacttccagccattggccccattgttcttcctcaaaaaccccaggtatagtggcacttcagggccgtggcactggcagacaccccattatcccagcaggcacttctagaagtgccctcagctctctgcacccactcctggtgtctttgctcagtggtctccttctcatccaggccttccctgcccatcttgctaaaactgcagcccccctttcctagctctctggatggcatgagccgctcacctgccccgcacgccacgcaccgtggaacaggctgtagcacgcacatgtgcagaccccggcctatcgcctcctcctactggaaggtgaactccatgagggtgaagacatctgtccttctatcccctgctctgttttaaccatctggcaaagcaagcacactcagcgcagcacttattagaagggagggagcagaacaactattctgggactgacttcctgctggaggaggaacagaaaataaatacataagcagatgagtaagatcatcgacgggcagaaaaagtaccacaaacaaaataagagtaagactgctccgagacaaggggctggggagggggaacctgagtaggaggcagcctagtggacgcgtcacccaggagcagacatcgttcagccatgaggaggcgggggatgcagcctcctgatgtgtcagctctgaaagctaatgactgtgcctgcgtgtgtgcgcatgacatgcgtgagctgtaagggcagctccataattagattatatatgtgtgtgcgtgtatatatatgtctgtgtgtatatatatgtgtgtatgtatatgtctgtataataatatgcatacacacgtgtacatatatataacctatatatctctctatatagattatatatgtgtatagtatatacacacatatatattatatatgtgaatgtgtgtgtatatatgtatatatgtgtattatatatacacacacacatatatatgtatacatatataatctatatctcagagagagagactgacctgccagcagatgggcagacatttgtcagacatggagagagtgtctttattcctaaagttggtttctcagctgcaagggcaatggccaagcccttcccaatcttaccttacgaaacaagggtgacaggcattcagggatagcaaaacgatctttcctatcctattttgggccttagagaaaagcgtaattgtgcatttaaactgttgtttgggatgagggcagcagagcacacagctgttggaaccagtttctcttcatgctatcacatgaggctggagcctgaactatctctgggaggctgcagaaagtgggaagggagtttcagatccatgctggaagaacagggaaaggctcccgcagggctccgggtggtgtctgccgctgattcagcaaaggacttgtcctggacacggggcatgtgggagctgagcacgggatttcaggtcctgcttcacctccttctcatagggaagaagctgtccactgctcactcctggttaaattcaaggaagaagggatacacaagtgtggcagccctatagaaaagagaaagactcgtaagtgatgctattagtaagccatcttggcttccggccagtgaagacaaatgaatttaacaaagaaaagtcaactaaccagaaagtttacagaccagtgaatcccacagggctagcattatgtgccaactcggttctcagagcttactgagttatctcacttcattcctaccccgaacctgatcaagtaagtgtcattgttcccattttacagcagaggaaacagaaagaatctcagagaggttaagtaacttgcctggggtcacacagctgaggacatgggtaaaccaacacacattaatacctcccacattgcttcttccgccatttcctccctgtttgtggctccaaagaatcccttcagacaccatcacggggaatatcaacatgacaggaaagtggcagcctcgccccaggccaggagcccctgaacaaagccataaaccaagacttgatctttgcctggctccagacaggacagcagaacggggtcccattctgaaagtcaggctccatcacaagtacccactgtgcttgcatctccgtggagaggcaggaggccaggcgtaggcagctgagcccctgggggagtggaatggtgtcggctctacccccagtagccccgtggcctgggtctagtgactcggactccccagccccagttgctcctctctgaaatggaaatcttctctggaccagcttcctggggtacctatgaggaggcagtgagctgcttcctatcaaggcttaaggcagcacctgtcaaatgcttagtcagcctcggctcttgttagccttttgattatttgcttgccttgattatcagcttgtattactgtgtgcctgacactgacatgtccccaaactcctccccacaaatgtcacattccagtgcctctccttattgtgctctctccctccatttatattgcatttcaacaataataaccgctactcatcactgagcacttatttggtgcttggtattgccatcaacgcttccaagtgtgttatgacatcatcctcatcgtgccttgggaagcgggaactctgctggtcccattttgcagatgagaaaaccgaggcagagcaattagaagtggcatatctgaggtcatggggctagaaagtggaagagggggattcagacccaggcatccgggtcgtttcctccccagatcatcactgtggtgcggggctgctcaggcgtttggtgagtggctgcagattcagagctcacctaaggtgaaaagcaggaacggggttccttctcatttctttgtaaggcagagccaagctcgtgggtgtccccactctgtccctgaagggatagtttctctgtgtcatctttgcctcctctgtcacccatgcaggggccgcaggcctgtgatgagctgacccactcagctcccagaacaggcaaaagggtcccagggtgcaggagggaagccgaaagaaaacagatgggaaggggagtaattaaatcagcacatcccaaacagctaagggaggggacaaggagcaaagcaatgaagaccaggtatgaagtctgaactcacagaatgggcacgcgcttccgataagctgtccgctcaagctgtttggaatacaaacaccaaccaaaacaacacacgcacacactcttttgtgtcgtgtttctggaattctgtgatgtttcttttctcatatattcctccaaaaacagtccagtacagaattgcaggttgaagcactgtgaataggctctaggtttgccccaggttaagggttaatttgttgagtttcagaacaggtaggcgacgccctcctggattttaaacagataacgtccttgccatgtaagagcacttagaaggctggctttatctctttaaaaaaaaaatatatatatatatatacacacacacacacacacatatatacacacacacatatatatacacacacatatatacacacacacatacacacacacatatatacacacacatatacacacacatatatacacacacatatatacacacatatatacacacatatatacacacacatatatatacacacacatatacacacacatacacacacatatatacacacacatatatacacacacatatatacacacacatatatatacacacacacacacatatatacacacactatatatatatatatgattgtgtttgttgttgttgcagttgcagagatgaaaaagaaatctgtgtctttaaatgaggaggggctgcgtaaggaggcttgggcagcaaaaaggctaatacgctgtggaagagaaggagtttaatctaatttagttggagggtgtctgtctgcggtgttgttttttggagtgtgggaatagaggcgggaagctgcccccttgaatggtccctcctgagccaggagcagtggggagccagtcgacgccagcgatccaaagcccggccttgaaagaggattaaatcaatgctctgatttgcaattcacactagtgcaccccgtggaacctttggtaatatttcaaaccacatttcaagggaagtggccttaaaatagctgcctaaattgtgctggagccacactggacaccccactcatccactttaggatgggggtgcttcggggttcatttctcaccttcccccaaacctccacatctcacagccagtgtttttaggcagaattaaaacttttgcgcctgttgaattcgctgcgacttgcatggcctttctggtggtacaaactgtgttttctttgctaagtatcacttcagatcactaaaggtattttccctggagaaaaagatgggggcacgccacggggagcatgcctacttgatcagaaaacataattttttgtgcatgttttatatctgataagtttctgcagaaacttgatactagatgaggtcagagaaaacaaggtctattcacatcagacttccctgcatgtgaagcaattattggtaaatagatcagttttcattctcatacttgaaggtagaattggaaatgtcccggactaaatacaaacattgacgacacgagaagacaagagaagaaacacaagaatcacttacgtggatcctcacacttgaatgtaccaagagaggtgattcaagcagcagctactgaaaggcgttgcgacagcctgaaccactttttatctcaacattcaccagcacgattttacttctgtttatgagctttcttcctatgccaccagtttactcttgcaattagcttgtaacatgctaagcttatggtttaatttctttctgttgctgaaagactcagtacttttttatcttaaagagattatttgggttttctctaatcccatttcagaaaacctcgcacagtgcttataatttccattgactattacataataagaaaagatacaactttgatttttagcaatatccgtgtcaaagtacttttatacttttgactttgtgagtttaaatggaatgaaactgggcctctctttcaattcccctccacctccaaaaaatatttagttcttgttcaaaacactgcctgactcctgaaatattctctctcaaaaacctcatactttccctggtgaacgtttgcaagaacctgaaggcggataatgtttactgatagctttccgatagacagacatttttaggtggttgggggtaaaaacatattccttgtctctgcacgttatgtgaaatcatgtttaattataaagtttcattaaaaatctttgctcaaaattttagaagcctaataagatttccattaatttaaacatatcactattcccacgacggctccaaagctttcttttccgtctttcatccatggttaaatatgtaaataaaatgtctaaagtcattcttcaaagaagacaaaagaaaaaagagctgagggaaagacagccataaaattcctcccaattctccataacatttgccagaggggggtcggttgccagccagggctgagcagcgggggaccccggctgctccttagactcacacatctcaaatcccacacacaggaaaaaaaataaaataaaatatcttttcagctggggccatcaaaagagccttttcatttattagttacagacttatcttccagttgctgatttctcagaaccctcatttctctataataaagtctatttgttggtttccatctcagctggacagggcgaagcacttctgcagacatttttataaaaaacgagagaaaaaggcaatctgaagtggttatagctaaaataatgggcctgaacgtggctgaattaaaacagcacagaaaagatcaattaggaggcactttctcaaatagctcacacccagctcccggcgtttggctctcactcttgcactaaatatttctaatagttgctgagggagagacacaaaaaggaaaagaaggaaaatagggcccaggaaggacctttgccaggaaaattctagaaaagccaagtgatttccgctgaattaattttaatttaaaggtcctgaaaaattactcactagacaaaaaacaacaacaacaaaaaaaaaaacactataataaaaatggcagtctttcaaaaataaaatcatgcaacttttcacttgggaaataacacagttgaaggtggtgttctaactgcccggagtttctaccttctttttcactttctccctcaccccgacttcctccagcacctcctagtgagacccaggacacccagggacagcgacccaggggtgggtgcctgaacctgcctattaattctgggattctgggcgctcaaatgtctgttgaacggatgaatgaatgagtggaaaggtgagatttccccaagtttcttaccgatgtaaaaattgtagggcttgttttaattaaaagccaatactctccgaggaagtggccccctcctgcacggcgtgcagaaagctggtcagtgaggggggttcctggcgggccccatctccttcccgggcgcttcctagggagaccttgccccgtgcgcagcgtccccaccgcgggggcccgtgcagccgccccccacgccgggtggagcgccgccaacgcgggaagccccagcactgcctccaaagatgtccgcacactccaccctgctccctggaactatcctcaaacgggcagggggcaagcgaggccggtggacgcgggactcgctcctctgacctctccccggccccccgggaggtagcgggagattgcacacgcgatcctgcgagtttccgaactttggaagatcgtgacccggagagaccctgggaggagagggccggccacctcctaggggtgctgtttttttaagggtcaacccaggacgctacgggaagcacctggcgcatccttgggaacagtggggcttggcggtgggcgcccaccgcgaacgccctgggcgggggaagggaatggcggggggacgtcgtgtcctaagtgaccccgtcacagacccgccccaatccgaggggggatgagctcagaggacctgcccaggacgctccttctccactttccaggaaaaccgagcggcgtgcgcgcctccgtgtcctcgcgggagctgggggtccccgggcaggcgctgacgcgctcctcccacgacccactccatcccaccctactccgggtcctcctgcggggctgcagccaaggagggcgctggccgggcacatcactcgccaaatcacataaataccccacgagcgaatgacttcctataataaataaactcagccgccaagaaggcatctccagccctgctggcgcgaggccccggctctgcggcttcggagggggcgggggtcaccgcggtacaaaccaagcccgcacttcccgcggggtgggaggcggtgttcaaagtcccgggacgcttcccgcccctcccccttcccgccttcttagaggagacctcggatgagcggccctaaaatccggattctcgagcccctccccctccccttagctcgtctctttgaaatttcaaagaaaatccctcctcggagcccggagcccggggctggtagcacctccccagcctcaggaagatgcgggcaggtttacaagcaagggcctactttatggcccaggctataaaacgcaaatcccacctccctttgaaagcgccctccgcccgggactcaccataaaaggaagagaagatgcaccccgcgcccctcgccgcggaccacccccaaaccccttctcccgccagtccccgaacttcccgtaacctcggcgtcctcggggtgccggggaccatcccggggaccgccgggaaagggggcgccggcggagaggatagcgagaggcaaagttggaggccaggcagagagagggcgaggagaggcgggcgggactgccggggagggtcgcagcgcgcagagccccgcgcgccaggcgggctgtcccggggctggcgggcgacgcgggcgggactaggcgctgcgccccccgcaggctgggctgcaggccgggggggatcggcccccgcggggcccgggagcccgcggcggggcggcgggga

SEQ ID NO: 325 - DNA, 177546 bp, Homo sapiens
catggttgttggcttaaccaccaggcaacactgtctcccactgccctttctactgccctgggcacccagggctggcagcttgtgctatggagaggtaccttgtgagtgagaggaggagctacagcagggccttctcaggaggaagagggataggacattacagagaagagtttacaatggtatgagggaggaagagaggagaggagaaaggattaaaaaaaaaaaacaaaaggggaaatttataaacttgatgaggtgaagatagaaattaggcatcttctgtgctcaagagccccctttcctgtcttctcctggtcctggagcacaggcatgtagacacacacacacacacacacacacacacacacaagcacgcacgcgcatgggcacctctctttggctataagctactaggctctagagaagaaaatcaaagagagggctttccaaaagagcagggtctgccttgccttttttttttgttgttcttaaaaaaaattcaattcatgattattcattctcttttttgctttagaactgcagggcttctagaaaaaaaagatcagcaaaacaaatcaatgatcagaagaagtaaacttcgaagaacactgtttataaaccaagatcaaaatcaaggctctgcctctgatctggagtcgttttatgggcagccacagggaggaggagactgagacctgcatcccaggatagggtgtccctgttaataagaaacagggtttttccctcttactaggttgctgcctggattctagcattttctccaagcctacaaatactgattattatttttacatgggtgatttcttgccacttattaggtcctgaaaacttaacaatataaaatatctatctttagacaaaaaggagaggttttggcaaatgtcatgcctatgcctgtcagagatggcaagtagctatatgcattggttttctctcatccagactgctcattttaaatagtattagaataagctggtcattgggctttactccaaatctagctctatgatcatagaaaaatcatttcaccattctggtcctcagagtcttcatgcacaaacagaagaggttgagctacatcatctctcaggtcccttttatctctcctggtgattttgtggttctgtcccctggttccctttgaagcagccatctccagcgaatgctatgtctctgcatctccctcagtttcatgaaataatttacttgacttgttggaggtttttccttttctctttaaaaagtcatgttcatcttagtattattattattacaaagagtcatattattactactgttattattatcattatttgagacagagtcttgctctgtcgtccaggtgggaatgcagtggcacgaacacagctcaccacagccttaacctcctgggctcaagagatcttcctgcctcagcctgcagagtagctggtactacgggcatgaggcaccacacctggctaagtttttgatttttttttttttttttttttgcacaggtagggtcttactatgttgcctaggctggtctcaaactcctggactcaagtgatcctcctgtctcagcctcctgaaatgctgggattacaggtgtgagccatcactctgggcctaagagtcatattattaaccatcttttttttttttctccttgaaacagctcctatggaaaaaggtaattaaactccaaggacactctaggtgcctttcagagttgttatgagtatcaaagttagagagcttcataaacagtagcatgttaatcttgccagctctctcctttatccttgctgatcaccgtactgattattcacatgtagcattttataaatattaatgtgtatagatagacgtgctgcttctccattatctccctacttggtatagctcgaacatttggccaaagaacaaggaagtgtatctctggataaaatgatgagatatgatatgatgagatgagatatgatgagataatagatagaaggaagaatctttggaacgtaaaaaaaaaaagatgataattgtaacgatgatgatgcattaatggcaacgtgaatagctctcatttgctgggcccttgctacctgccaggccttccgctatgggctttatatgaattatctcatttaatcctcacaaccctattaagtaaatggcatcatactttttttgcataaggacttagccaaattgtccaaggtaacacagtctgtaattgaaagagtcaggatcagagcgccagcctgcctgcatccaaagctcctgtgattactcagccctgtgagaagaagacccctgagtcatgacttttctctgttctctcctgtttatttacagtacctgttgttgctatagcactgactgtctgggatcgccttcctttgcttattccatagagttcaatttcgtattcagtagcctctctgagacctgttatgtccctggtacgttcgggggcaagtagggttatttccagtggctcagactgctttttggtatctctgattttgagaacaaaattgtcgaagaccccttcatcagctgtccaggacagacggaaaccgtctggggtggcatctgaaaccagaaggttgtcaacttccggttcggcttctagagggagagaaaatggtgggagaaggaggaaagacaacatcatttaccagtccgtgcaatcttctctccagtaggggtatcaatatgtagtgatgccccggctttcagagatagaagtgtcctgagataccaaaaataaaatcattcaacattaacaagtccagtagagtcaggagaggggaaagatggagtagacacattcaatacaagtcaagcatatgtttgcatatgtgagttttgtctaaaagcaattcagtaaatccacatctggactcagcattggcccgtcccacatattattaaataagttcaaagccagtaaattgtttacatttgctctctgtcttccagtggctgagtgcccatcccctgcaagacctttttcttttctttttgaaaagacaaataaaccagcattaatgatctgtagagctgctcatgatgatactgctgattacattctccttgagcctgcccaaaatggcttttaaaatgttatggtctttttgctttgttcttagtgctgtttcactaaagaaggctcctacccttgactttttttttttttttttgcattctttcttgttattttattaactattagataaatgttcagatggtagaactgaggttggaaccttttgtgctacatactgtggacccagggtttcatcttgcattgccttaactagacaaaactcaatgtcaatgtagatttagagctgagtttcccaaagtgtgctcacagtgaactattcctgtttgatcctcttccttaaaaagtatcctttgtcaaataagtttggaaaatactgcctggataagtacttcttggagatgatgcacgttagggtgttctgaaaagccgtgcagttaaagatcctctttaactttgtttaactcagtctttccaaacttatttgaacgtggaatttcctcaccgagtaggacctttgaacattctgtggagctagtaatctctagaaagactttgggaaacacagatgtttgactattccgttgttaatttctgtaggaatcattagtcttgagaaaattatggatttagtccgtgttgcagagtctctctgatattagtgattaccgataaaataagttcacatttggttttccaatgacgagcccactgggtaagtttgttaagatcatggttgagattttgagatggcaaaagttttaaatacgttttggaaatatactcattggtatatttcttttgagaaggctgaaatgtagctggggaccagccaggttgatcacaagggacgatgatatgaggtaagcacacaagagctatggacaagacaaggtctaaaggattttgaatacaaagcagaaatatttcgaccttctcatttctggggtgggagtggggagtgttcattaagtacatatgacaagagggagtgtggggagaaggtgaaacagtagactacatttatggattaagtagggaatgtgaacaaagatgttaaagtcatggcgatccggtagacagattacacagaaggggaccaggaagaggaacaaatggctcacttgatttgaaatacctgtaacaatctcagccctcaagggcttggtttgatgcccttgggtgaagccagagaccataacctcatagccaatgccagttatgaggcctctaagctccagcttcctctgggttcctgaaagtgtgaattcctgggggtccagcagcttcccagaatccaccaccgttactagaaagctgtcaaaggcattctccgatgccatccaggaaactgtgaacccgtagggattaatgtcggaaatggttaggttttccagaaggggcagggcctctgaaagaagggaggagtgaaaataactcaggttagcagcactgactctgtcaggatagcacacgtttccaagaacaccaatagatacccaagtccatcattcaatttgtgttatatgcttagaaaatgaaaattcagtaagaacttattgggtgccagatagtgttatcttgtgcaattctcttaatagcccatgaggtaggtattattctaatttcacacgtgagcaaactgagtttcaaagaagttgattgacttagctaaagttacaagcttgtaagaagagatagagcgaagattttagtcaggtttgactccaaaggccatgtagttctttatacaaataggttgcattttgttgagtttggatcccgttgtctacttcccactgccttcagctctttttttttttttcgagtataatttctttccggtatacttcatgtgtttctatcccacttctagtgcacagtttgaatcaaattaatgaagtcaattagtgagatatcctcacaagctgaaataaagggaggaggtaagttttttttgtgtcaaaattaatagctcatggttataacccactaagaaatgataagatttgctaaatcttttgctgtttattttcctggataaagttagaaaacaagaacacatctgggtcttagtaaattctgtcaccatctctccttcattcgttcaccaaacatgtatgtcccaggcattctgatttctcaggtgctaaagggccttttcacacattgggatatccaaaaggagtgagcttatgttggctaagtttccattgatacttgccaactgacaaggcttcacattgttatcctagttagtcttcaaaatgatacagtaaggtagatattgctacctgccttccaaccccgatcacatctaaaaaaaccagagaggttaatgacttatcctaggtcatacatctgctaggtgcctaagctgagatacaatcaggtcttccgactccaagttctatgttctttccatacccaaagccaaccccaatcagtgatggcaatcctgagggataaggaggattagtggagaaggttcagcgtctcttttctaggtgttttttcttttttctttttttttttctgacagtactggtaaatgcatttttttttttaatcagaagaaaaaaaggagacaggaatttcaaattagctgcatctagtttagacacttcttttccattacagctaaatggaaacttacaaagagataaatgctcttgcattaattcactaatgcctagggtctaatccatgagacataaagaaaaatgttttaaaaagaagtgtttggtgactgaatgaataagggaatgaataccttcattttgtaaatagagatttaaattttgctgtggcttggacttcctgtagttattttgaaacacttggtgtttattctgaggcagttttttccacgtaaagatttcccaagaatcataattctatcaaaagcgaggatgaaatctcttatactgggcaaacaatcttcatctgagagacaagggtctcgaattctgttcctggattttgtttagataagtggcatctctctttgatagctggcctctttgcacctccacaccatcaaagcagtgaattccaatgaaagtgagggcattcaggctaattaggcaatcaagggcttgttatttaagagtccctcctgttttgtttttttcttttttaatatgcttcttttaaaacgcaatcttttcacatcatggattagctgagacaatgctgtaactggatctaggattcccaagactgggtctctcagcttccttttcttctgttatgtgggaggtcctgcaagccgctacaagcaatggcctgatgggatctgtggccatttctcccctcctgaggagtgagaatctcatctcgttcctccttgtctcagtcccttaagaaattaccatgttctgcatttgaagactcatctgaatgatttaattcacattaggtaactggataggaaaaaatactcattttttaatcttacattaaaacacatccaaagttctcttaaaaacgagagggagttcatgattgcataggtctattgttctatctagccttattggttatttttaagaaagccactttcctaataatgttgggagacagcagaaagaacctagcatgtataaaattcctactggatgctaggcagttaaatttcaccaactctatttaatctatgagacaaggctcccagaagtgcctgtggtatcctctctccatgcataaggaaattagggttcaaacaagttaagaacttgctaaaattatgtagctaaaaagctgtgggagaggtttagaaaccacaaaagcttgatctcaaaatcctcactcttccaggacaccatgctgcctataattaaatatttaattgtactaattgacatgtcttagtgatggcaatttagaccctgggagagacctggtttaatgtgaaaatcagatggcaaagtccgtcttctgaaaattatcactaatgaaaaggaagagacttctaaatattttctgaggctttttgggctagaatttagtaaactgacaccatgtgcagcctttgccattgaagtttttgctgccaccatttggcagcatttgccaaattgaacattggcaaatgttcaagaagtcaagttgagtgaatgggtagggcttaattaaacttgaaatttatctgccatctgaggttgaaccttcatcaatcttccaaccccgatcacatctaaaaaaaccagagaagttaatgacttatcctaggtcatacatctgctaggtgcctaagctgagatatacaaccaggtcttccgactccaagttctacgttctttccatacccaaagccaaccccaatcagtgatggcaatcctgagggataaggaggattagtggagaaggttcagcgtctcttttctaggtgatttttcttttttcttttttttcttttttttttttttctgacagtactggtaaatgcattttttttttaatcaaaagaaaaaaaggagacaggaatttcaaattagctgcatctagctgcatctgtgttgtcagttttaagaataattattttttaaagaaaaagatggttatacttttgtcacatatatgaactgcgttacctagcatgatttatgaacaggatttcgatcttaggcctttactaacttaggagtcactttttaggcagaatctctaaactagggataaaacagccaataaaactgggcacaaaaaaccctaaaagctttatacaactcttgagaacgttctctccacttcctaagagcagctgtgaaagtcctctcctttataatagtatctgctttctctttacttagaagtttacatatattatcttggctatcatgagtaatgtattgtaacctgtgtctgtcaatggatgaatggataaagaaaatgtggtgtatagatagatcatatttatatataaatatatacattccatatgtgtgtatatatacatatatatatatatacacatatatatataatggaatactttatagccttaaaaaagaggaaaattctgtcattttcaacaacacggatgaacccagaagacattgtacagagtgaaataatcgaggcacagaaagacaaatactgcgtgatctcatttgtgtaatctaagaaagctgaacacatagaagcacagagaagactggtggttaccggtgactggggttggggagatgaagaaaggggagatgttggtcaaggagtacaaagttcagttagacagaaggaataagttttagtgatctactgcacagcatggtgactggccatagttaataataacatattgaatacttcaaaattcctaaaagagtagattttaaatgttctcacagcacaataaataaataaataaataaataaataaataaataaggtgaggtgattgatatgttaattaggttgattcaatcaatccacaatgtatatgtatatcaaaacaacacactattctccataaatatatacaattactatttgtcaattaaaaataagagagtacacatttgcagtgaagattgtatttttgttgaattttcctttaagatgacttatctccttttctctctgtgttagacaagtgagaacctctgattgagtacctgtaatgacaaaggcagtgaggggtctggtgggatccccagccaaggtggttcctgccacactgacgtcatagccagtgttctccaccaagcctgtgatgtgagcttgctttgcatctcctgagactgtgaattgctgggactcatgcagtgagtgagcgtcactcacattgataacaatctttgcaaaaagcccagcttgagtggtccatgacatgttgaagctttttggagtaatattgctaaagattagcgtgcccaactgtggctttggttctaaagaaggaatatgggcagagagaaagagagagacattattagaggaagcagtggatttttccagaatgtagccatagaacatgaaagcatcaatatctccaaatacatacagaagagacagtatgttaggctgtgtctacacctgcattgaatatgatgatagaaaatatattgctttctctgcaggtgtatatttgtgttctttatttttattttattttttagatctgtgttcttttaaagcataaacaccaccatttgctagtcatgtatgaagaagagtagacaagccattagagtggtagattggagtaacgtgaagggtattaaggctacattttctaaagtttgtactggggacacaagccctgtaagatgttccaagaaaagacagctttatgattaagtatgcatggtaaacaccgaatattatgtcttaccatagagattcacaaggtgggtttgcattttaaaggctctgacaggctggttctgtcagtaaacctgtttaattttgtttggcccaaatttcataaacttattgatcaatgtataccctatctgaggaatatcctttgaacatctcaaggagctggtgttccattgaacatgttttagaaaatgcttctttggagtttcctcatttagtattcttttttagtatctactgtttgcacaaattaaaggctaatacccatacaagagaaatttttacagtacttaatatgcattgtaggaaaatctatattttaccatttaataccgtaaaggtgaagatggcttccattcaaaattcccagtgaatgcaaaggtgaaagaaaaacttgaagttaggcattgaattttctgcttaggaaactcaattattggataatttggacagatagatggtttccctgaggttaagtatctcttttctgttaaagtctagacattcagttttgagagcaactcatttaatgttaaggggtctatatggctagatgtttatggggctggcctcctaaatgctcatttatcaaataaaactaattttaaagtaagtgcggcccagactgtattttagagagaggcaacagtactggaggattcagatattaagatcaggatttagggttgggaagaggcacaatatttcttccaaggacttgggagttattttgcttcagctccaaagtttggaggaaagaaggggctcatttggataaactttaatggcacaattatacagcataattcgatgtcataaaatctctaagaacaaaaaggatttggttcagaagcagaatatagccattagcattgacatgggatatcctccttatcaattagtttcagaaggtaacaatgcaatcatttgcagctatagctttgacaaattccctcaaccacacaaaagattaaaatgttccaagtggaactctgttatttccctatattttgctgtagaaacaatctcccaaattaaggatgcatgctgggattcttctcatgctaccagacagactatcaatgccaacagattcaccatgcagaataagactcaggttcttgaggtcagctttacctccagctgcctctcaaagggtgcaaccaagctgagaaatgagatgcaagaaaaaacagagaaagatagtggtagttagggtatggtcaatgttccatgcaaaatgaggggcatttttctcccaccactttaaaccttctgaaatgactcatggacatgctagctgcttccaggaaaaagaaacattttcaaaatttaatgctctgaatattcaccacatgcaccaagatttggacaagatgatggcttgaaagaagagcctgagactttgtgacagctatcagtgggtgacaaaatgtgcttgacaaagtacatgtcaaaaaagagtagtcttcagacaaaaatcacgagaacaagataagactactgggtcctctcatgcaattcttgggttgtgattcagagtctattctcagcatgctcagggcacctttattttttaaaatcctgctagagagaaaaagagtgtagatctttctgaccaagtcaccagaaatggcatgcacatacctctttgaacatgacataggcaaactttgattagaacgaccacaggcagatgataatgggtgggattgaaaaagattattcaagatcagatgaaaagatgatttagaaattcaaccaaagcaagtcaggttaactttatacaaacaaacagaacaactccagatgtgaatggatatttaggaaaaagaggtttgacactgaaattctttaatttggggtgagagttattttaaagctttaaagctttgatttggatggctctatcaaatttgagaaggattgggagcaactaggagggtgaaaagtgggtagcgggtgatttttggaaagctattcagaggaaattcaatgaagagtgaagaagccataataggaaatacctgtggttgcttggaccatcagggtctgagcacgctgcccgccaatcagcccatgaaggtgggcagtgtaattagaagaagctttgaggttggtgatgacagagctgcgagacaccccaggcacagacagcaccatggtctcatgggggtgatcggaattactaacttctataagaaagctatcaaaggcagactcctgagcttcccacgagatggacacactgccccaggtcatgtttgagacagtgaggtggctaagaagaggtttggctactaaagcaagaaaaaaaagaaaaaagaaagtgtgtcaatttaaaacaccattgtagagtcaaaatcaaaacacataagactaaatccataaagttttagactttaccctttgttaatggtaaaataatttgtcccttgttgaaaatcggtttgagccatgagaaacaaacatatatgtttgcctaattttctcctctaagtttttttatacttgaacctggctgagatagcaactggataatgttggctctctctgccttatccatggatcaccctgacgacaatttgtagcctcatgtagaatgaggacagaccctctctcaaccatgggtgacctaaatgacaggcaattttgatgctacgatgtcaacccttttcttggatttcccagaccatgagtcccctttttgtaaactataaggaaaaattatcctgtgtttgttctgtagacaatatttttttttctagtttgtgatttcttcatttctcctgtgtttgttctgtagatattgtttctttttttctagtttgtgatttcttcatttacctctccagagaaggcactgtctaaattgtgctaagaatgctactttgaatgtagcattagaaaggggggctcccctttctaaattcacatagggttgtcttttactgcatggcaaagagcatctgacttagtgcacatctcacagacaccacaaatttaaagtgagagcagtttattcttttgttttttaaactaagtcccttgtttgaacacaactattctacttttatttttgccatttatcattcactattctgagggcaagacagcatgttctgatcttctagaggtggtgttggaactggggtggtctgaatggcatggctgcctcctgcactcatctgataagtaatctttgctgtttccctttactttcccagttggaaaaaaatacccaacaccatcaacatgattattaaatcactgggatatttgggtattgcgaggtccaagagactaggaagacaaagacactaagataatacaaaataaaatttacaagacctctttgactgaggcagacatctttcaaagtcaagaacaggtctagttatatagctttttagttatgagaggttagaattcttttctctagattccatatggcaaattagactgaactacattttatgctgtaaacatcctggtcagtgataaatcaggcacatgtctttatggcaatgcattatttgggctgctgttggaaaagagttatgttaaacagcaccccagcctagcaccatggaagagttagtgccctgtggcttgtacatcaatgggagaggagaaggagaggcttcaccctgcaaagaagactgtggagagagtgcgttagaaatgggagaatgcacatgtacctgtcgtggctgtggcactgatggttttggtccggatgctgggagcaagtccagagaggtagacaataaaatcagtactagggggtagccctgagatatgggcagttcgttcagcaccagagatattatattccacagtctccagcaacctattggaatcaataatttcaatggtaaaggtctcgaagatcccatcggtagccatccaggagagattgaagctctcgggagttatgtcagaaacatttaagtttccaatttcaggttctttggctgtaaaaggaaggggtaggggagaagaaaaaaataaatttgagttaattatttggctgtgttttaagattgaggttgttaatagaaccattgctgggtagagagatctgataattcagggctatgatggaaggaagcaatgttaccaattagtgccaaagggagagaaaaagcagttttgttaaaagaaattagaaaaaggaaggtatggcaattagatttctctacatgcagttgccacatataatcaggccctggccaagaagatgtgctgaatgatcttatcaggaactgttgcatcttaaccacacttgcctctgggagccctacctcagggttgctggccactggtcaaaagatatgagtcctggcaacttccagtctcttgaattgcattaaggaaaccaagattacttggatgccttccacagacattctttactttgaaggagctcccatctattcaaatgagggctaaataattctgatgccattaccttcccaaggtggtaacttgaggcttctgattttgtgacttaatggtaattaccaatttctcagtgtaattcttggtatttttttcatactttagagaaggaccagccagccattctcatattctgttaaaatagcttgtcctctcttaactgctgctatgtgggccaaaaaggctagtattgcattgccaaccaagagggctaagccaaggcaaggcagtttaggccatccctttcagcgaagaaataacattttgtcttgaagatggtcctgccagtgctttccccaaccataagaataaaacatgcagagggcaggtaggagcagggtttgaaaagctagtactgtctctttagcaagaaagaaggctcctggtctctgagatccttctaatagatttgttgagatacagatcagatgggattatggaacttcctgcccataggccaattcatcagtggcaagaatgttgctattgttaagaagaaaaacacacacacataaaaatactgaggacacccaagccacaagatctgcagaaaagatcagaagtggtgggtgattactttgccttctgggaagggatggtttatgggtctcagaaaaaggaggtccgggtgccttcagagtagcctcggctgcaaattctaggcatttcagggtcaccgtcctggcagtggttgcctgtgctttatgtttctttatctcagtgaaaattagtgaaatgactgaggttaaaatgcagagctatgctcttgctagattcaactgggatgtacaggtatgcattaaagtttagttgcaataattatttaaaaaggggagcagtcatatgcaaaatgaagcgatagtctctaccgagcttcaaacccatggaggcacataataaagatgagcaacggaaaactgtgtcagaggaaggctgctgactttggcaggcccccgggaaacactgaagtcttgtaacaggggtagagtgacgagtaaactataatgcaccctcctgggtctggggctgggagtttgccatccaaaggccaacactccagagagaaactcttgattaaaagagcaaaaagggtatcagttctttgacattcatagcccaggacattccttgttccaaaagctgctgtgtgtacttgtgctaatgaatggctttctctttggtacagtctccagtcataattgtgtaatttctttttttttccttctggtctagctatttgctaatttgatgttctaacaatgactcagtatctgagagaactgcccggaggagggtaattcagttctcttattatactgggtgcattttaaagaaacatttcttacatgcaagaaccacactacccatatccttgagggatttagagatagaaaagcaccatttccaactagcaaaagactctcagaagtaaataatctgtgttccaccagaactcatatatagggagggaagcttttagttatctccaagcactggagaagtgaattaaaaccatcaggctgattcctgaaacaaaaattcatcattcaaaaaagatgtagaatcagccaggtaaagtatgaaaggctggggggctggagatcagaaagggcaacacctgcatcattcaccatccacatggcaaaggcatgaggacaaagtcatagcccacagggaggtctctgagcatgcacagccggccactgaaaggcacatgaaaaggattcagttatggcgagatgctgactccgcgcatgatctcttgaaaaggaagcaaagaaccttggggagaaagcattgacagggagaggaagtacctgtggaggcctcagcagagagtactggtgttctatagccccggatcaccccatagatggagactctataaggcgtggcagcctcgaggcccgggatgtccacagccctgaggctgccaggcaacgtgaggttctgggctgcctccactttgttgacctcctgcacctgaatgacaaagtgctcataggcattgtcagctgcggtccagttgagtctgaggccatcccagccaacctcagacacggctaaatctcccagctgtgggagatcctctgaagaaggacagaaaagtatttgtcagttctataaaccaaaaatgaggaaaccaaacatcccacagcccaactctaggaaagagagaaaggggaaagataatttttttttttaattcttggtctctgagcatttgcaatttgaactgtggttccctggccacagttgtcttcaggagttgaaaatggccagaaagggaaatatctacatggtttatccttgagatggcaaagacatctgcaccaatgcacaacccaccgggagcatgcattgctagcaggtgaaattcacatggaaaagtaggattgtgggttagggtaagagatacagcaatggttacaagtgcagaatttggaggcaagtagtccttgattagaatcccaatactagcatttgctagctgcataatcttgggcatgtcactcagcttctctctgagccaccctctctttacctttaaatggagttgatggtactgtttcatgggattgcgtgatgattaaatggtaatatttatcaacttcttagtatcatacctgatacatggcgagtgcccaataagtgtcagcttaataaagaaatcattgttcaagtgttttcccttggaatttcttactcatgtcagggagaaatccctgctttatttcattatttataattagaaagattatctcatcactagccactggctacctgcctgggttgataaagtgtatgctgtctcaggtgtgaacaagtatgatgttttttctttggtcttctatcagctttcagggatcaaaagttgtgtactgggttctcagcttgtttcttcttccacctttttctgctcgtactttatgtctaaaggaagaatggctgtatcacagagcaaagctgtttgtgtgaaatgagtgtgcctacttttaattaaaagaaaggagatttttctcagtaaatggtgcagaacagaacccactattactgcttctacaatgtagaaaggaaatttaacgtagttgttattggtgatttagaaagtttggatttaggatatggaaaaacccattgttttgtgggatgcttctgagggttaaatgcagtctctcagccactgttttgaaggctgaagtggccatgggttagaagttagggaggagaatatctgcagggatttcaaccaaaaatagttgaaagatatagatacttgctcttgggtatccaaggattcaatgccctgtgagagtctgagcaacctctgagcaacctcttgcttttaagaggggttattttcaaactgtgttccacatagatctggggcttttctagaagaactgtgttgagaacatgggtggaggtatccccctcttacttccaggcacaccaagaacagctgttcacttatctgtcaaatagtagggttccttggaagatttcatttgcaaaaggagttgtactgctaaaaacaaaagtttgcggactacagaggaagatatgagcatcttgcacacagaccacacctgtctcaaaggccctttttgctcttgtttgatctgaagatattccaggcaacacaggaataaaacctggcccccttatttttggaattttatgtagtttctagcaaccaccaagtttatctgttatataagagcaaggaaaacaattgttttgaattgagtgatttggattgcattatcaaaaggcagcatatgtagagtggggcatgggcttagggctcagcacagaaaccctatcaccaaaaagttggccctttttcccatagccctttttgaagctatttctagaaatctcatgtacagcacagttttttataacagatggagcagctcatttttggtggaaaattgagaggaattgtttttccttcccaaattgaatgaaaagcattgaagtcaaaggtggctgtcctttcttggaaatgtccctgctttttgtatctgttgaggagagagtcctagatagtttcagcagaagctaactgcatcatttctaaaggttattatgtagagatctgcctatcaggtgggtgttagttggtggctctgaggctagtaataaggtttttctagaaagttctgatcttatttttgtgccacagccctaacgtttgtgctattttaaaaatcatgactctgttgctgtatgataaatttagctatttgctattcagtatttactacgtgatgggcgctttactaagcactgacattcattaacttatttattgctcacgacagtttcctgaagtagggttcattgctgatttaaagatacaaaaaggaggctcagggatgtaaagaaatatacccaagaatagaggtagggcacgctggctcatgcctgtaatcccagcactttgggaggccaaggtgagaagatggcttgagcccgggagtttgagaccaggctgggcaaaatggtgaaactccatctctacaaaaaatacaaaaaacttagctgagtgtggtggctcacacctgtggttccagctactgtagaggctgaggcaggagaatcacttgagtctaggagttcgaggctgcagtgagccatggtcacaccattgcattctagcctgggcaaaagaatgagaccctgactcaaaaaaaaaaaaaaaagtatatatctatatatacacacacacatatatatatatacacacacacactatatatataagtatatatttgtgtgtgtgtatatatgtgtatctatatatatacatacacatatagtcccaagaatatttagctagtgaggtggaattccaacacagaccttcctgagttagagattcacgctgtctgtcaacaacattggggtaggattctgccacacgggtgaattttctctatttcaatgacatgctggctcctatcatgtctccagtctgggaggagggtcatatacctgtgacgacctctacagcaaggggtcgagtgctgtggcccctgacctcgccgtgcagggtgactgtgtaaggagtgccagccctgaggcctgggatttccatggaacgcaggctgccaggaaccgtgagattgtgagcctcttccacctggtcagcctcctggacctgaatagtaaactggtcataggttccatctggcgtggtccagttcagtctgagagcatcccagctaacctcggtcactgtgaggtttcccatatctggaacctcctctgcataaggacacagagttgctgagttacttaaaaaggcaattgcacgctgggattcaggtgagatggcattttggctaaggttgggatgagttgtctggttagtgttgattatagatgcatgatttacagcaggtgttgagcacactcaaactgttggcactaaagccagggtttttctattcagcttttgggaatgaaaagtagttttaggaattgttcacaatttctattcttgacatacaaatagggctatggggagtcctttggtgttcttaaaatgagctcatgagctcagagctattttttcttcatttacaggttgggctttccaactttttagatattgtgactgaaacttactttgaaagaaaagccacctctcacttttttaaaggaggagtaggtggaattttccatggaactgggctacaactaggacttagccaaataagggatgtgacatttaggaagaagcagagatgattcactggtatttccccaatgtggtaggagctgatcccagtttaaagcaagaaagtgctttgattcctcccgagcagagacaaaggggaggaagtgaattagtgaattcgtctagaatacctgtcaagacttcaacagagagaggggttgtgctgaagtcctgagtgaccccgcggatggtgatggtataatgagtggctgctttgagcccaggcaggtctgtggacctcagtcctcctgggacggtgaggttctgggctgcctctactgtgtcagcctcctgcacctgaatgaaaaagtactcataggccccttctggagcagtccagttgagtttgagggcatcccagcccacctcggccaccacgacctctcccaaattgggagtttcccctggagaaggacaaagaactagtttagtgatcaaatcacacaacaagatccagggaatctttaacacaagaataagctgaataataatattactgaaaaaatgtgactttctttagataaacatgcatcatgcaactctttaaattttagaaatggagcaaagagaggaaagtgcaggaaaatatttgtttttgtttgttttttaaatcttaaagaattgccttaaccctcagtagatgagagaattttgtgattttctttccctttcatatatagtgccttaacgtcctttaacaggagggaggctgtttatggagctaaaggccctctgcatgggagctgtgtgtttagtcctgcaggttgagctctgtacaactcccaagggtgtcattcatgtggagtgaagtattaaaagttgccttggggttctgtagcgtgatggcctcgtgtcacaattagaccccatagacataagtagtggcagaacaagtccattccaaagctagtcgtgtctgattattcatgggcagtttcctgctgggaaaaacagaagctataaatagaaaggaaagagatacctgtggaggcctcagcagagagcactggtgttctatagccctggatcaccccatagatggagactgtataaggcgtagcagccttgaggcccggtatgtccacagcccgaaggctgccaggcacggtgaggttccgagctgcctccaccttgttggcctcctgcacctgaatgataaagtgctcataggcctggtcagctgcggtccagttgagtctgaggccatcccagccaacctcagtcacggtgaggttttccagctcaggggcttgttctgaataatgacagagatggggtcagttaaactattcctcagaaagttttgcttctgagaacctgggaatggcaaacccaatgccacatctataggccattgcagtccaagtgccaggctttgttcactgcatcccctactggtgctgtccctattaaaacaccagcaggacaacaatgtcatatttcttttgtggccgggcatggtggctcgagcctgtaatcccagcgctttgggaggccaaggtgggtggatcatttgaggtcaggggttcgagaccagcctggccaacatggtgaaaccctgtctctactaaaaatacaaaaattagccaggcgtgttggtgggcacctgtaatcccagctactcaggaggctgaggcaggagaatcgcttgaacacagaaggtggaggttgcagtgagctgagatggcgccattgcactccagtctgggggatagagtgagactctgtctcaaaacaaacaaacaaaaaatttcttttgccttcatgcatatttgggtttttctcttggaaatggtattttcctattgatcagtgtcctgcagatttagaaaactatatgtctatgttagcgatgctctgagcttcagttttcattttggaacatgtcttgcatcataatggggtggccctcagttattctgggggtcttggtttgagctgtccgaccttctgtattttgagacaattggctcttcttagatacccttcttttttgagaggccaaggtgggcagatcatatgaggtcagcagttcaagaccagcctggacaacatggcgaaaccccgtgtctacaaaaaatacagaaattagctgggtgtggtggcgtgagcctgtaatcccagctacttgggaggctgagttaggagaatcgcttgagccctggaggttgaggttgcagtgagccaagattgagtcattgcactctagcctgggtgacagaacgagactccatctcaaaaaaaaaaaaaaaaaaaaaaagcctcttcttttttgtgctgcctcaatatcctatgggaggtctgttgtatagtttatattgggatttcatcagtttctagcgttcaaatcatttacatagatcatattagtaaagatcagagacacattgacacagtattattaaggctgagctaaggaaggtgataaggctttgaaaaactgttccttaatagaaaaaagaaagaggtcctgggagaagcagatcttatgaagctcaagtaaaactgaatgcaccctgttcattcatctcgcgaatgcacgaaattccgtaaaaactcactggtctcaacctgacttaagggagataatttgcccagggctgagcttaagtggactttgcatagtttaggaaggaaagtatttctctggaaatggatcctgtaaactagagagtagaaactgactttaaatcatttaaaagaacaaactgtttttttctatttatacttcacattgctgctaatttcaaatgagccttatgtgtccattagagcaggctactaagttgaaaatcttagcttggaatttgattgaggatatcctttcagaggagaaaacatttcttttctggaattgatttaactcagacatttctaagttctggggaacattcttcctgcttgtttcatattgtcagagcatacactccttcaaattttgtttgatcgagaacagaggtccgcaaactgttacccgaggcccacatctggccagctgcttattttggtagtcagcaagctaacaacagtttttcttacttttttacatggtcgggaaataaatccaaagaagaatattatttcatggtgcatgcaagtcatataaaattccaattctggtgccacagataaagttttattggagcatagccatgcttgttcacttatatattgttgatggctgcttttgtgttacaaaatgtgcagttgaataattgtaatggaaactctctggcctataaagtctaaaatatttaccatctggccctttacagaaaatgtttgcaatacttgatcttgaatacagactcctctttaaccccgactcatatcctaaagcttacaccagaggctccaaagcagttcttaaccacctaaacatggtctttatgagaaagggaggaccccaaactgcaagtgatgtatctagatttaggaaaagaaaggaggtgtcaactacctttaatcctgctgggccttgtgaggccagaaacagttccctggatatagtgattatacccttgacattgggatttaagcacaactaaactcaagagcatgtccttctcaaatatttcagcagtcctgatacagaaagagatataggacaaaaacagagctaagtgaaaattaaatcaaccctatgtcttcttagctctccttcttatcccactttcctgtttttgtttctctgctgtccacctgtcaggaactaatctgtcattgacaacgtaccccttcgtgtgaattaagttactgtcttttttctacgggtgtctatcttttaatccttatgtctaattgttacataaaacatttttttctataaaataaattttaaatgcccccttgaaagagatattgggaaagttaccttacggggggtgggggaatgagattgtggattgcccattaagctgtggcaaaagatggatggagagaaaagatgcacgttggaaaatgtctcttcctaatgagaatcatcttatctctttgaatcggatatttagtatgccactgatactttcatctaattgtccccacatcctgtttcatctgttcatatagttgatagagtgattttttttttacataatgtcatgttgttcagtaaatagtaatagtgatggtgttggtacttctgctaacacttttggctatttctctactattttttttttttggtaggcaaatcaagaaagagcattggtttataactcagagaggcagtactgtggccatgtcagtagtggatgctacgtgtgccccatccagatccctttattaaataaatgctagccaagtgagtaaaaggtacaacttccacaaataaaatcagtagctaaattaaagagagagggggtcagaattatgaaagaagggggaatattatgaataaaaaatacagtggacaatagttgagatgaggaccaagaggcttcacataaatgctggctccacatttcaactgcaaatgacatactgtggacttactgccctagaagccaagtgtttccattatagattccacactgaatttcttggcatttctttatcaaaaggctgttgtcttcttcttacagctgtgcactggaatctacccttgaacaatgtcagtgggcctgggaaatcagaattttgaaacccattgctgtgctcctggtgggttgagcagctggtctggaggaatttctgacagtgccaacttaaaaatctgtagattgttaccatcttctagatagtgattaccaagtgctggcttgatgaggaactcacttcagcgtccacttaggggagaaagagtgattctcccacagcaggggcatggtcacatccaagcctgacaaccccaaagggtatcttcagtcgctttactctcatctctcagagataagacaattgaaatgagaagccttggctgccttaaaacattcggtgatttctttgtaactgccaagaaccaagcccctttgcagatgcccctgatgatgtctctagcctcctaccctactgttttcccactctatcatatagcaggactgtatagcttgcagttcactaaggtaaagtttctcatgcttttcagcttttcagatgctattccctttgctggaaatgtcattactctttctccacttgcccagccccttttctttttcagaactcaaccaaacatcacttcttccaaaaagccttctccagtgcttttcattccctttgcttaggtctgtgatgggtacctgtctgtatgctcctgcagcctcccacaaatccctctaaaacagataagctacagtgttataatttgggttttggttctctctcttatagcaacgtgcaccatttcttgagaagagaagctgtttctttctcttctatacaccggcatcgcctgacccacagtaggtatgaaataaatatttgctggatgaataaatatttgaataaatttcagtttggtctgtgagaaaatcaaaatagcaaataagagcagaatgttctgtattactggtagctgtggctaaaaacaaaattccacctttcttcttccaaaattcctgagagctactgggttgtcactgtcaaggcttatgttgctatgaaaatatgctttgctggctttatgtttctgcctatcacccctgcctcctgtctcttatggcatgcagcaaattcatggctttgaccttaagcagggtttagttgggtttataagagtacaaaagcagagagaaaagggagagagaggagaggagagagaagaggggagaagagaggaaggagaggggaggagaatagagtggaggagagggaaagagaagggagggaatgggagaggaggagagggaatgatgcctggtacacactaatttttttaaatgccaacagacacggtacctttcgttcttccctcctcccttctttccttcccttcctccctccctccctccctctctccctccctccctccctcccttcctccctccctccctccctccctcccttcctccctccctccctccctccctccctccctccctcccttccttccttccttccttcctcccttcctccctccctccctccctccctccctccctccctccctcccttccttccttccttccttccttcctcccttcctccctccctccctcccttccttcctcccttccttccttctttccttccttccttccttttctatccagattaagcggaattgaagactttccaagggaatgatttcccttatgccttaaggaaagaattggggtgttaatgcagaggtggaagggaagaatcagaagattctatggaaatgctgactctgaagtagccagggtccctaaacactcatgaagctcataccacatacttgtctgccttcagggcactgggattcagcagtggatgatggaatcagtccttatattctgctcactgatggggaggcaggccatagatattatagtaaaccaatacttgcataatatcaaggcagataagtttcacaaggaaacctagagcagcttgaaggggtagatcaggatgggggtgcctttttaggctggtagtcagagaagccctctgttctgggtcatatctgagctgctgagtgaaatgagggagcacgctctgtgaagtgctgggaaaagagtggtatccagggagtgggagcagcacactccaaagcccgagggtgggagcaggctcagaaagcttaaggaacagtgtgaaggcccaagaggccatggtgaagtgagcaagggaatgagtggcaggactgaggtcagaggatgggctggccgtgccagattctgtagggccctgtaacccatggctgggtctttgggcgagaggtgtgataggtggccaggttatgcatatttttagtatggtgccacatcaagaaaaagacttacattatggcccaatccatcagtaaaaccctggaattccccaggaaaaattcttcagggccactgattcttcatttttctctgtaagccccacagacattgagtggcgcctggcaggcttctgctattaagaatccagtgatacagagctggaaggttcttgcttctgatggttgaacctaaaactctgcaacatttcaggacttatagccacatggctccttcacccaagagctctcgcttttcctgttttctttcttcctctatgcttaccaaggtcaggtgcctgggcttctacttctttagctattccatttaacacatctatgtttgcctcttatgtctctgtccaaaagcgtcttcccattgtaagcctttcctgattctctgaagttagatccagtgtctcctgagcactggctgcaccctctgtaccctcgatcgtagtgagcagaatgttatctcagtgtctgtttgttcgctacacagtgagttccttggaattaaatacccgtcttctttgctctagtaaccccagaacttagcacagagcatggtgatagtattttattgactgagtgaatgcagaaggctttaaaagttagaattcaaggagggaaagaagcgtctgcttcaccttaaatgaaacatatatattttttcctgtggagaaagggatgggggaaatagtctgtggacagtggagaagaaccaataaaaagaactttgcacatttttcccacactgaagaatgtctttaaatacgaaacatgatatctttgaaatggcattaaggaggcgtggtggggaaatgcaactgctgaggctttggaatgccaatatggggctctcattcagaaacagaataattctagctagtaaatctcctggttatagccacattacctcctttctctagtggagaagccccacacctcaggatcttagggagataaaacttcttcagtgactgcgcaggtgtgaggttttctcactggaggaaggaggcaatgtggccatcaccagaaggtggaatgattgaggggcaataggaatctctcttagatacagcatttatcaaactcaagggaaagctaagggagaggggcagaggaaggaggaggaggaagaagagcaggagtgagggaagagggaagaaagagagagaaagagaaagaaaagagagggatttcatcttttgggcatttctgattcatttgttgccccttgacactttataacaagctcatgtttataaagctgaaatttaaatctctactatagatttatttcttcttggttctatccccgccccccaccttattttttaattaaactattctttcagagcatcctttataaacatcttatagttgggtgggaagcagtcaatgcagagtcaacagaattgaccacgtaaactcatttcagactctggcagggactgctcattgtctgccaaatttctctcttacaaatgacctcaattttatgtggaagtaacatgttcagacagaagactacctttccctgcctcccttacagctaggagtggccaatgaactatggggagaagtgattggtggggtttccagaaagactcacccagaaggtgctcctctttgggagttttggttcttcctcccttatgctgcctagaacacagatggaatggctgtattacagcagccatgttgtgacactgagatgactttgagaatggaagccaaggactaaaaatggtggaaaagaaagaagcagcctgggtgcctgacaatttgaaactactaagttatccctgtacctcccagctccagattcattttataagaaagaaaaccaacttctatcttaagtaagtgactgtgatttgagactgaagatattgtgagaaagactcttcaagccatttccaaatatgtccacacttctaacccttttcttgcatatcaagcttcaactggaataacatcccttgccataacacctttgccagctctcctgatttccttggatcactctttttctcgagttctgtctagcattctgagtatctagtcttccgcaagcactatgagcaggcacaaatgagtccacataacaatgctgactttgggaactacttttcctcaaatatcagtacggtacaatgtatgcagtaggtactcaatacatgcttactaattaaattggaagtaaagactattacttgccaaaccctggaaaagtaacattttccacctatacatttcgaatatttggtggccaaaattgaataggcttatttttcataaaggaagaaatattttaaaaacctggttgtctcttcagtttagccaccgagtaaccatggcctcaggttcagtgaacaggttgcatgggccagaatggacacaagttgcatgggccacaatgtcaggattaagctgtcgtcatagacaaactaggttaatgtcttaatgactaagagaaaagagaaaatgagagggcaccatggaagtctcaaagggccgtgtgccactcttcaggggtaaccttggcagaaagcaaaagacctggaataaaaacagtttgtagaaaataacaacaacaaaaaaaatattattaccaacatcttggtcatctttaaatgaagtaaaatgaaaagtaaattaattattaggctaaaagaaggaaataaacaagaaacaattgaaaagatgctgtgatgcacagttaagaaaagaaaacaaaaatcataggtaaatgcaaacacaaaccctgatgtttaaagttctcctaggaagaaatattttaaaacccctatttcccagtgggggaaatttgctgtatcagttgacaggaggtagaaaagacgagtaagcagccctttcaaagtggtgttcaggggcttcagagatggagaaagtggcttgcttttgcatttggctttctcatgtgaggacaccctggctgaggagatctgctaacctcagaatcaacctagagtttggaggaagctcagggcagactcaccagtggatgccttcacacgtgcgggcttgctcttgtgtctgcctttctcggctgtcaggaggacattgtactcctgtcctggttccaggcctctcaggacataggaagtggtgtttcttggaagctgcactcccacccactggcctgtggggagactgtaattgaggcggtagcggtcaaatttggccaacggtgtcttccagagcagggtcaggctggtctctgcagtttcagaaacctgaaggtccttgggcgtgtccaactctgggaggagaacagagagatgaatgctcttcaggctgcaagacagggctgcttctggggctgaaagtcaactgcatctgggctggaatcctaggtctgccacagaggagctgagggaccacaggagagtcacatctctgggtctctctttttacttttgtaaaataggtctaattatacatcacccacatgaccccatcggagtctgagaagattgaaaataatgtcatggaatatccattccataaaatgctgctcagatttaaagcagttaaaaggaaccaactattgataaaagaagcaatttagatgaatctcgagagaattatgctgaaggaaaaaaagccagtttcaaaatgttacatgctgtattgctatgcactgaatgtctgtgcctctctaaagttcttatgttgaaacctaatccccaatgtgaagacatttggatctagggacctttgggaggcctcatgaatgggagtggtgcccttataaaagagaccttgccccttctgtcctgtgaggacacagtaaaaagatggcctgctgtcagccagaaagcaggccttcatcagacaccaaatctgctggcatcttgatcttggacttcgcagccttcagaactgtgagaaataaatttcttctgtttataagttacttggtctaaggtattcttattcttgttacagtaactcaaatggactaatatgtgtaggatcccatttatgcagcattccttgaaatggcaaaatcatagagatgaagaacagataaatgaatgcccagggttaggcagaggggcaaagggagggaggtggctgtggctgcaaagggtagcatgtgggattcttgtagtaagactgttctgtatcttgactctagtggtgcattcacaaatctacatgtgtgataaaattgcatagaactaagtatatacacacacatacgaatgagtgtatgcaaaactggtgaaatataaatagagtggacagattacgccaatgtcaatttctcagttgttatattagtctacatttatgcaagacgctacccttgggggaacctgggtgatgggcacaggggatctgtctgtatgctttctcacaattgcatgtgaatctacaattatctcaaaatcaaaagattaaaaaaaaagaattggcatgtaaatgtccggccttgcatcccgcataatgtggaagctcaatgatgatccatctcctctttacacactagcctccttcttcctcatagtgcctgtggggaggtaagctgggggctgggggagaggcagaggaggagttttctttttgcagtgcaaacttcccagaaaaatggaaaaaaaaatcttgaggaaagaatcaatgacctcaaatcaggtagcccctcagcatcctcacctacaagctgcggctacaggatacaacaggtaagtgcagggcctggacttaaactacaatcctgttacttataatctgcttgacaggggtataaaagttaggtgttttctcagagaaaaccccacagttgtgtttggactagataatggtttatttaaaagatgcaactgattaccaacttacacatgttcatgaatttcttacaaagcctggttccaatttttctttaaaaaatcccggctggacatagtgactcacacctgtaatcccagcactttgggaggccgaggtgggcggatcatgaggtcaagagattgagaccatcctggccaacatggtgaaaccccatttctactaaaaatacaaaaattagctgggcgtggtggtatgcacctgtagtcccagctactcgggaggctgaggcaggagaatctcttgaaccctggaggcggaggttgcagtgagctgagatcatgccactacactccagcctggtggcagagcgatactccatctcaacaacaacaacaacaacaaacacaaaatccccagtccccttttccatacaggggatgatgttggcatcatacagatggaccgtacttatgttccttttgaatttcaacattggggctagatggtactacagggccctttttcctccaggcttctactttttctctttaaataggttttggccacattgactctgtctcatctgcccagcaccagctcagtgggatgggaattccaggtgtgccccacctgtggctgcgttgatggtcgctggattgctctccttgtcttccttcacagcagaaactccaatcccatattcagttcccggcctcagacctaaggagagaatgtgcaagttgagattcatcctgaaatcagagagactttcagaggatgataaaaatggctttgagttggtctctggaggctacaacaaattttcggaatgttttacaaaagaactcactgcaatccaataagcagtatttcaggaaattggacttatttctgagggttgcaaatggggacatgtgggagcaggtgcccatcctttaagggccctctagggctggctggctcaggcttgcagagatgcagagctcacctgtgagtgtggttttggttgtggcttgttggctctttggaacatcaacctcagcgtggtcccctccagagatgggggcatacttaattctgtaactgtcaatagctgccttgccattcctccattccagggtgatgctgttatctgtctgggaaacacgtcgaagattcctgggagcatcgaggcctgtttgagagaaggaacatttgtattgaacatatcagtcacaagagagcaggagtctttgacagctcaagctgacatatgaaacgtgcctggaactggagagaaattacaaaattctcagcacactcatctgtccccatagtggatgtgcaaatctaaacaagtgctacagatttggcacctttccctattatggatgagtgcgacactttagtcatttgtgtttttctcagactttgtggttaaagaaacaatgcaaagacttaaaaataagctcatgagtgtaaaaactggtcttttgcattttctcatcatatttcattctttattttatttttttgagacaagagtctcgctctgtcaccaggctggagtgtgttggtgcgatctcggctcactgcaacccctgcttcccaggttcaagtgattctcctgcctcagcctcccgagtacctgggattgcaggagcacaccaccacgcccagttatttatttatttttttgagacggagtctcgctcttcacccaggttggaatgcagtggtgcgatctcggctcactgcaagctccacctcctgggttcatgccattctcctgcctcagcctgtagctgggactacaggcacccgccaccacgcctggctaattttttttgtatttttagtagagacggggtttcactgtgttagccagaatggtctcaatctcctgacctcgtgattcgcccgccttggcctcccaaagtgctgggattacaggcgtgagccactgcgcctgaccccaatttttgtacttttagtagagacagggttttgccatgttggccaggatggtctccatctcttgacctcatgatctgcctgcatcagcctgccaagtgctgggattacaggcgtgagccaccacgcccggcctcctcatcatatttctaataactcacaaagtacttactgagctctgaaaaatatttactgaatgaaaaattgacacttttgaacttttaaaataatgccgtaggctaaagtgttaggaggctcatttgtcatatatgttttccatataccatattttactttaaaaatatttatttgaactttattttaaccagaacttttgtctgagaatatcagaccagcatcttctacatatgtcccccacccccaaaagtgctttggaaggttatttggaattttttttgaaaaattaattaataaattgctacaatattttaaaatttacaggagtagaaatacccctttcatttttcgtactgtaaaatgagcctggaagataccccaacatggagtgggatggaaatctttcaatctttcctttactatatctgttaacagggggaggccttttacctgttgtgaaggtctctttggctgggttgcttgacatgtcacctctgcgggagatgagggacacctcgtactcagtgtcaggcttcaggttcccgatggagtactggttctcgtcctctgtgagatcgatggtggtacggtctcctggcacgtctttgatgccgtaggtcagctcaatgccatcgatctcagccaggggcttgaaccaggtgatcaaggcagtggtgtctgtgacatctttcacctcgatctggctgggggcatccaagcctatgatgggcagaggacagagaggcttcagaggttagggccattgcctgaggcttagcagagagaggactttgtaactctccagacctgtgggtgaatacttatactaactgcttgactttactttgcctttctgaaccttagtttttggtttgataagctataagtagggataacagcagctacctctagtgttttttgtttttgtttttttcaaatcttaagagagataaagcttgcaaagcatctagcacagagactggcccatggatgtcacatgaaaaaaaaaaaggttgttcttttgttattattattattattactgttctcataagttgaggaaacatgctttggggatactttatttgaaaagatgaacttagtctctttaaatttttaattaggcaaaacttcctggatgtttcctgaaaacttttccatcagaattaccaagcagaaaagtgaggcaatagactgtcttgacagtgtatggaaacttatttttgatagaaagaattcacgcaagaaagtcattgctatttcaagccttgcctgtttttgcaggctcatcttgactttttctgccccacctactctggtgttgtactctgatagatgctcagagctctggaagcacattatgctgttgggcaccgcctggtctctgtacatgctgttctctcatttcttctttctaagatcatacttccctctaaaaatctcctatgcatccttcaaaatcccacttaaatgttgtctcctaatgagaagcctttttttaacccggcttcagtcaggtaaacacatattccctccctgtggctgccactgtccttgaagagcattctaatatcatacgtgtctcattgtttcataacagatttctgtacagtttgagtcaatttaggtagggttattcattgattgagagagtgagtcttttaaattcccagcagagacaggcatattctgggtattcagtgaatctttgaatctttctttcttcttcttctcctttttttttttttaaatgtgttttcagcattggttcagtaaacaataacaagtgacaggaagtgggctttatacagggaatgaaaaggaacaataatttacagcagattgtgagaaaactgcagagtctgtttttgaagtctaggtgttgacacatcagtcccagctcacagatgatgtaaaatgcacaatgaaaatgatgtcgcaaaaatggacagaagctgcctgctctgtgttcttataggtgctagcaagcacccaaaccgtacctactaccttccttagtaccccttgcattaaagaagttgggtttccgtcaaggacactgatatccccctagatttgggacccttgaatagcagaaactaacaatgctctgtatttatcaggtgcaaagatggtgctttgttatttatgtcttgagtcttatgacgaccccacaaggagaatactataaacccatttttcagctgttggatctggagcttaaagaaatagatttttccaaggtgatggtgaatggtaaagatggaattcaaactcagaactgattgaatccaaagcccatccttttccccctttacatgacaacacctctcaaacatattgacctcaaaagtaagtataataccacctttatatagatgccagacagaaggagccaaatgtgttctgaactagaagtttaaggccctttacatctggaaaaaaggttaaaggtttaaaggtttcaggtatatgtggtaaattgtggccggccgtggcggctcatgcctgtaatgccagcaccttaggaggccgaggcgggtggatcacttgagatcaggagttcaaaaccagcctggccaacatggtgaaatcctgtctctactaaaaatacaaaatgaacaggtaaatatttgtccccctatgttgaaatttatgattatgcaacttcaaatgttggaatgtttgttctaaaataagaagaaataaagcagacaattcccaaatttagataaacaaaagagcagtgaaaaaaaaagttcagtgcacctcctccatagcaactaagcatttgctttgtcttttctttgtctttctggtgatctaatgatttttttttcctgttggtacctgcttttctacctaccacagagaggtggtgtcaggatgatggaaaacacttgcttatgaaagagaaaatcctttgaattggctctgagctaggcaaaatgtgcaaatatttaaatgcaagatgttctttcttgtcattagcaactgatttaatttttccaacaaccccctgccaagaagagtcgattacttaaagagttggcgcatatgttatcttgaagaaaataaagaggttttcctatatggaagtgcaaaattatgcatttttttctttttaaaaaattgcagctgtgcacggtggctcacgcctgtaatcctagcactttaggaggccgaggcgggtggatcacttgaggtcaggagttggaaaccagcctggccaacatgctgaaaccccatctctactaaaatacaaaaaaattagccagatgtggtggtgggagcctgtaatcccagctacttgggagactaaggcaggagaatcacttgaacctgggaggcagagattgcagtgaactgagatcgttccactgcactccagcctgggtgacagaaaaaaaaaaaaaaaatgtttcctggtggagcaactccaaattcaggtctttttctcaccaaatgatctagtactgctaaatcctattctactcccaagaacttctgacatcattagtattgaatgaaattttatttaggttcccattgaagagatggaatcaacattctacataaaccagagcctagtcaatgttagtggaaatggggttaaagttataaaacttaccctggcttaaagttatgcccctgatggtgttaactatgggatgttaaagtgatttagcttctttaagccttaacattaatattttcccttcctctgtcctacaactgggtgctaatattaaactagtgacatgatgctaattagattgttagcaatgggcttaattatcttcaggtagtcacacccctttgaaaggagattttgaaactcctttcatcaagagatggatctgtttctctattccttaaatataaactggccgtgggatgtgctttgatagaagtgatctaatgccaattttgaacctgttcaatagctgtgtgaacaggaccagcatcctggagaatgagaggctctgcgaaacagaaagacaccatcctggctgaggccatcctaggccaatccaccccttaagcacacagatacatgaggagtgcagtcaagaacagataagctgctcagctgagcccaaacccaaatcaccaacatgcaaagaattgttattttaaaccactgtatctggatttttaaaaatgcagcaaaagttaaatgatgtagatgctatatgagaaggcactttctcaaccaggaggtgctatgaggtacaatcagccttatcattctataagtattaaaggtgatactcacgtgtggtggtcaccctcttcaggccagggccccgggtattgtttttcactatgtgcagagatatctcatactcttgcccaggagctagaccagtttgccggtaagaggtctctggcctcctcaggcttttggtgatctctccctcatcttctttattctgagagatagaggcagcttggtaagagttaggggaggtgccagtctcttaatttatgtgattcattcactctgcattcattcattcctctgttattctttcatcgattcattaggcacttactatgcatcagatcagtatgtaagctactgaggatacagagatgataaagacatttctctagtttgtttctcccattcgtaaacttttacccctttgtcatgcaagtcaaatgacagaatgtgagagccaaaggaattctgaaggcacaagctcaatccctccttgggtagactgaggccagcatcagaggagtagggtgattgttggatagtcacacagctggttggtggcagagcctgggcttaaattcagagaacaagttccctgcttcacatgtacttttgggcctggagagaagggttgctcaaatctgagatgtacctttattttgagggagagactgtttcttctcttctttgcctctgagtagagatttctaaggtgatgatggacaattggaaccttgaggtgacaacttctatttgtctagggtgtcagccgtaagtgctacacttacttattaaaatcagggaaaaaccaacatcccttaaaatatagatgcaaacacaaatgatgctaatgagagccttgtcctccaccaaaaactaaggaaaattagttgatacagaagtcttcagaaccctttggtcatctttcaaatccttgagatcaaatggatctgctcttttgtactccttaccatattccggaagatgatctcccaggtttcaaaagcaatgtctagaggatcccactccacttccacagatgtctccttgatggacttgaatttcaggccttcaggtgcaggtaagtctgtaagtaacaacataaatagaacgtaaggatagggcaggtgtgtgattgggcaacgcggccacgattccactaaaccagactggatgtctgcaacagtcaggggctgacaaccagagcaggtgtccttttaaagcttcttctgggatgaggtctctatgaggctgtataaaaattaatattaggaaaaatggtatgattaattttggcaatttcatatgtttaaatctaaaatgaacgcaggctttggaatcagacagacttggggttagaatctaagctctactatcaatgtgaacttgagcaattgcacacagtgctctaagcctgagtttcttcacttggaaaaagaaggtaaatatgtctacttcttgggaatgcattgaggagtgagtgatatactccactccagtgtgtagactgctgggcctggttcgtggcatgcagaacaagttgaataaatggcagccaatgttattattaaggaaaaaagggtcaatttctagccagagcttgctttttagatatgaaggtaattatactgatgctaaactcataaaccagaatgtttccacttaaagaaaaatagtcagtgatctccactgaaaagtaatagagtggtttagaacataaacctgccaggactgccagggttaaagttttgcctctactccttgttagctgcatgacttgggataagatgcttaaccatgcagtctcagtttcctcatctgtaaaatggggttaacaatagctcctatttcatacatatactaactcatataatgaggactcttttttttttttttttttcttgagacagagtctcaatctgtcacccaggctggagtacagtggcatgatctcagctcactacaaactctgcctcctggtttcaagctattctctgcctcagcctcctgagtagccgggattacaggcatgcaccaccaggcccgactaatttttgtatttttagtagagacagggtttcgccatgctggccaggctggtcttgaactcgtgaccccaggtgatccacctactttggcctcccaaagtgctaggattacgggcatgagccaccatgcccggccaaatgaggactcttatactaatatgtagactgcttacaacaaagtctgatacacagtaaacacttgctaaatgttacttgtaatgattttctctggcaggaagtatataggagagcaaggagaaagatttgatggaaaatgagggatttctttaataagtgattctatggacttaattctaggctcttatttggtataactgtaaagaacaactataggattgtaggggccgtggcgagggagggttatacactgggtgggctgacatcaggtgaggctgcccaaaagagttctgctcactcacacgtggccaccctggcgctgacaggaatgctcttcttgttctccaggatggcaaatacacggataaagtactccacaccaggctccagctcctggatgatggtggacgtctggtccccaggcacacggaactgcatttccagaccaccctcgtgggtgggcgtgtacacgacaaggtactctgtgacccgcatctcattgtcccaggccaggttgaccgtctcttccgtcacttctgtcacaacgaggtctttgggaggagacactggcaggaataagaaaggacatctggtgtcaacagtgtgtcctctaaaatctctctaggtttgtttgacctgtcttttccactgtcagccacagaggtctgaagatcttctgttgcctctaaaatgcagatggcatcagggaccccctgctgtgatccatcttaagacctgtggtggctgttccttagtccatttccttcaggctggagtcccaggtcagcagtgtgcccttgggtgtttctggcctctccaactttctgtgcttcctgggtcttagctcagatgcaggctgttggcatgggaaagtgcagtctgagcctcactccctgctctgaactttgagttacgtgtccctagcactgggagggtattttgggcatatctggtccaactttcttatattatagaggtgagtaagacagaacgccttgaccaagcttgctcacctcatcaagtttagaacttgtatctcctccctgccagcctggtgttctttccaaccaggcttccctgcttgcgccacattgaacacaaagccatttatttatgtttagataccaataactttagtaaaggaaaaaattctccattatgacaatgataatatgggtagatgagaggagtacaaagaagacactcattaaatatgagcattaattttctctcctgtgttttcacttaaccagggtttactaagcacttaatatgtaccaggtcccatactaactgctagaaatagtgcccttttaaggataggagcttgcagtctttaggattaaaaaaacaaaacaatcaaaaaaacaaaaccagttacaaaagacaatgaaaagacaggtcaatcttgtagataataggcatttcgtctttagccaagtatgcatttgaaacagttgtttttatgtaatctcactgcgtattcaatttagctgaatttttacatccatccaaatacagagattttgtttactgttggtttgatgtcagtggagagtaggaaataaagttgatatttagcaaaagagagagtatccctttatctacctcatcttgaacactagatgtgttctggcctctccaactttattttaaactctatgtagatgagttaggcagacttgaataccagctctgtgatgtgtcagctgtgtgtccctgggacaattatataacctctctgagcccttcagcccttaaataggtcaccttgtaacaacggaatgacagggcccccttaaaaagtcattatgggtgtgtgtttaaatggatatattaatacgtacaaagaatcagtgtgcatgaatgtttatatatataaacgtagttttccaacccatactaggagtccactccatcatggccattatatgctggtctgcgccctggcactcaccctctgagcagtcttctccgctgtagccctcgttgcagatgcagcggcccgagacgcattgtcctaagttgttgcagtcactggggcaggagtgctggccacagtccaggcctgtgaagccctcgtggcagatgcactggccgtccacgcagcggccctggccatgacagtcactgggacatctttgctccttgcagtctttgcccataaatccttcatggcacacgcactgcccattcacacagcgaccctggccatggcagtcatttggacaggagagttctgcacagtcagggccggtgaagccgtcctcacagacgcactgtccgtccacacagaggcccctgttgctgcagtccctggggcattggcgatcccggcagtcttcccctgtgtagccgtcatcacaaacacacatgccattcacacagcggccgtgctggtgacagtcattagggcagctcatgtcactgcagtcatagcccttgaagccttgctcacatacacatttgccctcgacacagcggccccgactgtgacagtcattggggcaccgtagctggctgcagtcctccccagtatagccctcatcacacacacactgcccattgacacagcggccatggccactgcagccattgggacacttgagctccccacagtcagctccagtgaaaccatcatcacactcacaccgcccgtctacacagcggccacgattgtgacagtcagcaggacacctcttctcgctgcagtccacaccggcaaagccctcatcacatacacactgcccctcctcacaccggccctgggtgtggcaggcatgtgggcaggtgggtttcccgcagtcttcacctgtgaagccttcttcgcagtagcaggtgccattgatgcagcggccccggtcgaagcagtcattggggcagatgagctcactgcagtcttcgcccgtgaaaccctcatcacacacgcactcattctccacgcatcgtccacggttgtagcaattgttgagacacagaggcttgttgcagtcatcgcctgcaaagccatcgtggcacacacacaagccatctacacatgtgccgtgctcctcactgcagggcactgggcagatttcacggctgcagtcagccccggcgtagccttcgaaacagatgcagactccatttacgcacttgccctggtcattgcagtcgctggggcaagccagctggctgcagtcctcgcccgtgaagccgtcgtcacagatgcactgcccatcaatgcaccggcctcgaaggtgacagttgcctggacattcgggctcagagcagttggggcctttccagccaggttcgcagacacagccacatccttcagtgctgaagttgccccgaccgctacagaagggcctggtgtccaagcggcctgcaacaaaagaaacagaagttctcagccaggcttaagcagccacatttttctgtatctacccagggcacccagattcaaattcagctgaaggacggttgcaccctcaggctccatctggcttgagaaccatttgttgtagtgtgtgaaatcagatgagactcacatcctgttataccaggtaggaattcataacctgaattccctgaaattataggcttgtatgccaaaacagtgtgtgattatgcataggggtgtgtgtgtgtgtgtgtgtgtgtgtgtgtgtgtgtgtatttccacccctggggagcggattcatagtttttgtcacattttcaagaagtcttactattcctatgatgattatgagtcactgccttgtgaaatgcattaggctggggctatgttactatttctttcttttctttttttttttttttttttttgagacagagtcttgctctgtcgcccaggctggagtgcagcggcgccatcttggctcactgcaagctccgcctcctgggttcatgccattctcctgcctcagcctcctgagtagctgggactccaggcgcccgccaccatgcccggctaattttttttgcattttttgtagagatggggtttcaccatgttagccaggatggtctcaatatcctgacctcgtgatctgcctgccttggcctcccaaagtgctgggattacaggtgtgagccaccacgactggccactatgttattatttctttagtgcctcatcaaggccaggcacataaaagatgcccaagaaatagttgttgaactgaatgtaattctgactttttgattcaatatctatgccacatttggcaagggatttagactatctggagcttagttttcttatacgtgaagttgggccaatagcccacttccctggggtatatccgagttaagtaaaccccttaagagctcactcttgtgtccttgttatttttttctgttttattttccaaagttttttgtggaaggttggctcaagttggtatgtgggtttatataaccaaaacattctaattttccgcaactaaaatgaggtagctaatggctttctaattctataaggacacctttcagtttggctctgtccccagaaaagtatagtgcctttatcttttatttctttctatcctgaaggctaagtggaggtcaacttaaagaatgtggggtcaaggttgacattactcgagccccttgaggcctaaatattgccttagctcagtttgcagaagtcattggtctgatctccatggagcttaaggagaagaaacaaaacccagttctatattctctgcactagagtatattcactctgtagtctctgtacgtagaaacagcttgtattaatatattttatctcattcttgacagcaggaagaaagaattttttaaaaaaagctgatttgtaaagtgagagtctaagtatgtactatctagtatggtggcccttggccacatgtggttattaggcattgaaacgtggctagtctaaattgagatgttctgtaagtgtaaaatacacatcagattccaaatagtataaaataatagactgagaagtatccattaataattttgatattgatttcaggctgaaaaaccaatattttggctctgttgaattaaataagagatgactaaaattatgtttacttgtttctttctcctttctttaacatgactactagaaaatttaagattacatgtgtgagtcatattttcattagacagcactgctctaaacaatcattttaactgactacttagcattactcctactgtgtattctcatctgcatttttccagggagttgacagaagtggaagataaactaacttatgcctaaagaaaatgtttttaaaaattgccttagaaacctagagcctgtcctgcagagccgtaagactatttcacttagggtggttaggtttactcttgaaataattgttgaagaacattttggtaatttttttctgagtggcagaaacagattttcagctctgatttgaagttgttgaaactcatgtagctttatcaactttagttattggagataaagacataattccaaagcagcaaaattccttgaaataggatgcatgtggaaacagggcatccatgggagagtatgagctctggagacacacaggcacatgcaaaatccctatctctctctctctctctctctctctatctctttttttttcggatggtgttttgctcttgtcactcaggctggagtgcaatggcatgatctcagctcactgcaacctctgcccctcggtttcaagtgattctcctgcctcagcctcctgagtagctgggattacaggcatgcaccaccacaccctgctaattttgtatttttagtagagatggggtttcaccatgttggccaggctggtcttgaactcctaacttcaggtgatccgcccgccttagcctcccaaagtgctgggattacaggcgtgaaccactgcgcctagccaaagaccctatctcttattgctctttgtgccatcttgtgccagtgggttaatccccttgagattcatttctttgatctgtagaagaggacttatcttcccctcatctaatctttaccttaaagggctgttgggaggattaaatgagataatacaacagtgcctgttacacagagggagcttatatgattgtaatcattgtaattgctattaaattggaacttttttctaattcttataactcagcactatcacaggcagcactgtgcatttgtaagaatactgaaatgtgaggaactctactccttattggaggaccttcaggaatcccatcctctttccaggcctcagtttctctatttgtaaaatgaggtgatggggccacagcagtacctatcagagagtgctctctggggtagaaatttcatggcgtactcataggttttggggtagaaagtgggtagatttcatggtcaaatacgttttagaaacttataattaaggtaaaatagggtttttcaaagcaggacttatcagaagcctgaaaattcctctgagaagcagttgtcgccgtgactcctccaagcaggagagagatggctgcagtctccacacttatttgaacataaaatctctttgtaatgaacactctgggaagctagttttctagtgagcccactttggaagcaagtgatggatgctgctatgctcttcatttctccatgtttgcacagtgtgggactgggcgggccaccagctcatacctgtggcaggctggagacagcagcctgctcctgcagtacattgctccctcagggaagacaccaggttctccagctcctccagtctgctcagcagctccttaacatcaggggctgcggcacagccacaggcccggcgggggatgttgatgcgatgtgtgaagacaatctggttttccccatccactgtgtgctcctgaaagctttcgctgggctctgaaggcggtgccaggtctttctccccactggctgactccagatccaccgaacactgggatcccactggcagcttgatgttgtaaacgtggttaaacaccactggctggttctcttctggcagggtggcgttcaccccactctgtcgcttgtgccggatgactttcttgaggaccccaccttcggtagcgagggcaaggaaagcaagaaagacacctgccaacagctgagtcatggcccccatggtggaggtgggtttggctgggtgctgctggggctctagggctctagggtatctcactttcagcagaattggggatttagaagcacagagtagacttcaaatcagttgtccctgatcttcttgaaagaattattttctacaagcaaagatgaacaaaaaaattatgagtatctactattgaatatattgaatatctacaattccaagtgaattttgattttatatccctgtatttgaagctctcctgataatttttcattatatacccttgaaataacatacaatggtctctaaaagaactttgtcacttgaaggaatgatttcactcactattcaacttctgtaaatttaaggagacagaaaaatagagagaaaaaggtaaaatattgaaataaaatagacataggtttgtatcttggctgtagctctggtcccttggatacgttatgtaatttttctttgccttatttcactttctgtatagtgaagatcatagttgctaatgacagggttaaaagaatgatgtagaagttatttgtgtattcattaattccttcagtatttactatgtcttctgagtgaattattatagtgttataaaggccctggtcccggtagatgttcagtaactcttgcctcttattgattttcaaaactgatttccacaccatctgctggttctcttctgtcatgagaggcagaggttaaaataaaggactctaggaggcaaacagttttaatcccagccgagcttcttactagttatatgactgtcagtatagcattcagtctactcctctgcacctcagtttccctgctccttgatttatttccaaaaccttcaaaagtccagtttttagaagagcctgacagaatattcttgaaccagttgtctaaactgaggctcacagctcagaaaggatgtctaagagcctctgatgtcttctccaatcagcaagtacttatagcatttttacagaggtctgagggtggtagaaataaatataagaccaagtgtatacataccatcaggggacttaacaatagaattaagaagaaaatggaatcatccatccagtacttaaggagcaaagcaagaaagaatgtataggatttgttttgtggtatagtgtataactgcctatggggtttgaaaataaaaaggaatggtcaagagaaaggtggggcatagcttatgggaaagggagggtaaaatttaagctgagccttaaatagtgagaagaattagatgggaacagaatatggaggagaatatgctaccatgaagcaattctcactttgccaagttatcttattcatctctcttagagctattcacctgtatgagcaatcaggtagcagagaaaaggggacttgttagaggcagttgagaaactaaataaagacaggaagaaatggcagttataatatttactaaaacaatgctatggaggcatgtgagaatgatctatacacgatatgaagtcattcatggttttctttaattaggagatgcacccgagtaaaattcaaatgataattgaagagctattttatttatttatttatttttgagacagagtctcactctgttgtccaggctggagtgcaatggcatgatcttgactctctgcaacttccgcctcccaggttcaagtgatcctcctgcctcagcctcccaagtagctgggatttcaggtgcacactgccatgcctggctgattttttgtattttttttttttttttagtagagttggagtttcaccatgttccccaggctggtcccgaactcctgagctcaggcaatccacttgcctcaacttcccaaagtgctaggattacaggcatgagccaccgtgcctggctgctatttggtttttagcatgtcatttacaaattgacatttccctatgcccatgatattcttatactcgcacactgtaagttagttatttatgtcaattagtggtggtgcttggattattcagcctataagaaggtttctaactttttttctggaaagattttatcctaatgatagaatgcatcaacatgatcccaactgaccatctccttcctcatgacagaaagcctttgcaaaacttagagaggaattgtggcaaggaaaattgaactgggaagcattctatatgactgatcaggggcctaaggactgagaaagcactagtgaatttaactaagaaggtcgtatccacatacctaccacattctaattatattcttattgacactttaccaactgtccctgtaatatctgcaaaaacaaaacaaaacaaaaacaacaacaacaacaaaaacaaagaaacaaaaaatacccaaccctcttttgagcatgctttctcattgaaattagcttcttaactaacaatgtgtgggtctgtaatgtaggtaaggccactgaatgaagattattataaaaaaggagacttggcatgttctctcctttcaaaccaatttggccatcttatgtgtttactggacaaatatttattggctgcatagtctactagaatggctgctctaactctcttcaccttcacaaagttctactttcctaccccttttccatcaattcttagctttttttttttttttttagaaagggccatgggccaagtttgaaatgtttttggacttctccccaacacttttctgtgtgttgctaaatgacttaaatttccatctaaaaagccattatagttgctgattgagactccaaggcaaagagtttagggtaataatgaccagagtgtgagtagagtgaggatttctcactgtgtgtttaagagacgtaaactggtaccaccaaatgttgcatcgttgggggaaagagtatgttattcttgagcattgtgtatttcctattggctcatggtggtctgagggcagtgggtgtttttgtactttgggaaaaatccattatattttcagtgttgtagaaaatggttaggctttggaattaggcatacctgggttcaaatgtcactcactagccctgcaactttgacaagctacttatcctctctaaaccatgacctcatatataacaaaggagtcaaaacctttccagagaaaattaaggattagagacctgtacataaagtacccagcatggtgtcaagctcgtagtaggcactcattaaacagtagttcctattttgttgcgctcctggggaacaaaacctaacaagagtccatgtcaatagcctccttttacttaagcctgagcttgaccgcctagttgaatacagtcctaaactcagcagcaacttggatctagatcaaagaggagctgcagaaatcactggtgggtgaggaggtaaatttactagaactagaaatatttatatgagagagggaaaaaataggaagcaaataatgacctttaagaatgtaaaatattctcatgcagacaactggctgttttaagtctcctttgtggatgaacccagggaaacttacttgagattgcagttggaggtatttaggtcagacatgaagaatcatgttctgatagtaggacttttataatttcagaatgagcaacttattctacagagactctttagaaaacacagattctaatctttatagaaaattgatcagcaataaaaggtctggaaaatatcttgtaggaggaaggactacagacctgggcaggtttattttgtagttgagaaaaccaaggttgagtgggtcagggttaccatgtagaaatcctggcaaagcaggcactggcttgcctcttgtagcccctaaggacagaacaagtgcctctgtgtgtgtgtgtgtgtgtgtgtgtgtgtgtgtgtgtgtgtgtgtgtgtgtgtgcgtttatgtgctggggatgatgcagggagggagggttggttatgagaagacaaatttcagcacaacaggagaaagacttttctagttggaattggtacccaatagaaaggtcttctttgagaatgtagcaggttccaaagcaccagaatgtaaatagaatggcattgaagggcacaagttttataggcaaattgtcttaggtttgaatcactgtttgatcacttcctgttccttgtgcaaggttattatctgtgaccataagccagagtactgtcatcaataaatgtgttaagggagtcctcataggatcattgtgaaaagtgcatgagataatgtatgcgaaagaaatggcaaacagtctttggtagcagtaagagcttaataaaaggaaacatttgtaatgaaaaatatggactttaatgaatgtttttcttttctaggattttctttctcctaacctttgaaacccctactttggcatatgtctgtttttaagcaaagacaagagttctacagcaaagtgagaacttttcctctctcagtgatcccagaaaatatgcatgtcgtggtatgtgtatatatatatgtatatatatatgtatatatatgtatatatatatgtatatatatgtatatatatatgtatatatatgtatatatatatgtatatatatgtatatatatgtatatatatgtatatatatgtatatatatgtatatatatgtatatatatatgtatatatgtatatatatatgtatatatatgtatatatatatgtatatatatgtatatatatatgtatatatatgtatatatatatgtatatatatgtatatatatatctccatatataatataatagttgctccaattatattacatataatattataatatgtgatgtaacataatattacatattataatacaatgaaagataatatattattacatatcatattatatatgtaagtgtgtgtatatctttgatggtgatatttaaggatctggtaagtcaatgattgcaaagaagggaatcaggaagagacatagtctttgcattggcacaaaacgcagatttttggggtcccatatccaggacaaatctatttccaagctaagcatgttgtgctgctttttgctccgcctcagcttatgtatctaacgcaaaacaagacacacttgtgtcagactttgctttctttattaaaattaatttttagagtcaaacaaatacctgtgacttatgaaattgtttttgtgagattttctgtgtatctccatccctgtcaatgtctcaaaagctagttaatctggtgaacataaaatccacaataaaaacttccccgtgagatagaaaatttaaaaagagataaaacacttcgaattcattggtcttgaattcgaagtgctctgtcccatattccgcatgtgattattaaaattaatgaaaattaaatacaattaaaaatctcattgctcagttgtatcactcacatttcaagtacttaagagcccatggggcttgtggttacaatatgagacagtgcagatgaagaacatctctatcatccaaagaagttttattgagcagtactggtttagaggattgcttgtttttactaagcgcatggtacaaaatgaggaaactgagactcaaagcgatcaagaagagtctataagaaagtttcaatgttgttaagtttcttgactaatgaaaatgggtgagtacctcagacacaagagcccggggattagggagaaaaaatggcttctttttagcaactaactcacttaactatagcaagcatgtatgtgcattgtagtttccataccttacatgtttgaacatatccaggtacaagtgagaagcaatcctcaatgctattgtcctttgcagatctgaagagataactaccctgtgtcagatcagcatcttttcccccagccttgtccttgggttaagaaatatttttttcttcctccctctgcacaccttagagtctcgtaagaatcttctccccacgttaaactaaaaccaagttgctccaggaaccactctggccaagtctaatgtctctttctgtctgcttcagcctctccttagaagctggaggagcttgtcaaagacaactcatgactcccgtttctctgctgtcctgcactgctgtgctccagagttttgagggcactcagtccatatccttcagccatctaaacatttccattaatgaagcagttgcgtgtgggggaaagagtctggtctttggtgtaaaataaacctgtgttcgaatccagttctatcactttagcagctgctccctatggccattccctttctcctctgaacctcaatttccccgcctcctctccctggagatacatatgtctatctcatagtgttgcaggagagtgggatgaaatgagaagacatatgttaagctactggcacagtgcctggcacacattaaggtgtgcttaatatgtggtagctaatgatagcagcagcggtaataacaacactgatccaatagagaatagatcagaaagaaaaccttgtatccagaagggatgggggaatcagggagatacattcatgattataacaagtaacaaaagagattggccaactcatatccattgaaggtcccaagaaagacatctcaaaaaagtggtatttgagatgtacttgaaagatgggcaagattctgaaaaatggttggatacaactccagtaggtgggttcaaattgaagcctacagcaccctagaaaaaagaaacaccatgagaaaaggcaaagaagttggaatgcatgggtggtgaggagaattaagaagatagctgtaataatagtggcatctccttgtgggtgccagatacatgccaaggtggtgtagcatgcagggaatatggagaggtcttgttctactagggtataaaataatgcataggaaagcagaaaggtagagactacatggtattggcagaagccatattgggaaggatataaaagatcaatatgaagagctggtacttaactcagtaagcaatatggcacctctgtaaggctaggtgcctaactgctcacagttagtcatctgttgagaaggctgggtagaatataggctttaatatttagtcccccattctccaaatacctggtacatttatggccccagcccgctacaaaaaataagaagataaaaacaatggtcctgaaagcttttgtggggagtgtggggtggaagaagggttaaatgttaagctttaatcttatttcaattgccttggtgttaaatgttatcagtgttgaatcatttcttcagattttggcattatagacttttattcagagcattactgtgagataaaaatttatttaccaggttgggaaaccaaggccagtgtcatgccagtcgtaatggctttttagctcataattttacacattaagctgcctcttggcttgctgtcaaatccttctttttttctcttttactagtagagctgtttggtagctaaccttttggaagcagcagggaataggctaacagttatttttgggcacctcactgcaggacaaagatcattgctagacgaagaaatcaacaatctgattttttccctggtcacagctggagaataaacaacttcatttttagataaagatgaaacttccaactggctagaatcatatttcagaattagttacttatgatttcatttttagtagctcatggaatatatttatcttgttgacttaagcacatacatgaaatattctaggtttgggaggacgaggagaattcctattgtttagaaatgcagatgaatttgtttccacatcattttggcaacccatgaggcagcttacaccaaatttttcttctcgcttacaggccaaagagttttattgtgcatggcctgtcaagcatagagttgcttacatgggcgttcttaaatgtcctagaaattcctcaccctttgtccttcccaacatccataaattcctttttggaatgtgtcaggaagagagaggagccaggaaacagccttaagtgtgtatttttttttttttttttttcctgaggacatctgatctccatagttgagtgagtccggtgcaacctgtgtcataaaagaattgagaaaactctaactgccaaagcgaagaccctcctaaccctaggtgtttgaagaattccagaactgagaagtggttgtccatttaggcagcacagtggcttagctggtgcccagttaagatgctgggggagccagtgattatccaagaggactgagaattaatttctaaatggtttattcttgcattcaacagagatgtgttgaacaagtgtaagaacgggctatgggatagcctagtggtggtggggtgtttcagaagccaatgatggataggtcttgcccttaatgagctcacagtcaggtatagaaagcagacatgtaaacagatacttgttgtgaagaatgataaatactaacatggacaaatatccaagaaacatctgtgcaatgtttgaggatatctgctctacatcagtcaaacactgttagatctttactctgccacttgctattaatttgaaccacatggaatcaccactcttttaggtcagaaatagttgggtagtagcaaatccaaagggttccatccagtagctgttttggttgtgtaacattgcctgtctgggccttaattttcacatctgtaaaatggtaacactaatatcaactgcacaataaagttctttcaactgaaagtgagaaaaatgagataatacaggcaaaacactcagtaacaaatacttaaaaggatggagaccttagcaactggtgtgtattggtattatatgattattctgtcttgtgcttggagacagcatttctaacagaaggctagtctctgaaggatgagatctataagacaaatctgggaagccctctctttcccactgttgctttttccatggaaatgtataaatcttagtatttcaatttgtcaagtagcagggacactctaaaatttttaggaaaatgaggaggctgtggctacagccctggttttcctgttatcctatctcttctaactcagtagcaagaaaagcaaatgaattagcctggtgtggggctcttttctgggaggtcaggaccctggccaaggttcctcaggggcagtgctgctgttgggatggctgtccatgctgctgagccagggctttctactgaatagactgcctgtggtttagtctttcaagactgtgttcctaacgggaaacatttggcccagcttctcagtactttccaaagacacagacagacatcaaattataggatcaaaatcatgcttgagcaggacttagaagcaactgtagaagatcatttggtataggcatggcaagtctgtggcacaaaacacttcattctagtgcatggggcagacacagctaatcgataacaacacaattctgaggagccccacttaagaatcattctaaatcatcacttcaggcagccaattaagtagtatataaatagaggtagtatatcacatgaaacttatttgccataatacctagttatttaagagaataactgaattgaaacacccagagtcactagctaatcagtggtgactttactaattaactcctaaagctgatattaaaatccagagattttgcctttgggtcaaggaattcgattaagatctatctcttcctctagaccattgggaggccttcaaaaaggagtgcatatgtacggcatggtgactacagttaataataatgcattgtatacttcaaatttgctaagatagtagtagaccttaagtgtctttatcattgacacacagaggtaactatgtaaagcgatggatgtgttaattagcttgaatctagtaatcatatcacaatgtatacatatattaaattatcacgttgtataccttaaatgtataaaattttaattttaatttgtcaattatacctcaataaagctgggggaaaaaaacctttaaaaatgcatatgaaagtctttcagtaattcttagtctgaggtcattgtaatgatctccagagagaaatatcagtggtgggatcctggagagcatttgtgttaaagtatttctagacttcttggccctgatgagttttttacttttctgtctatctatccatcaattcatccaactatctactttttcagtacatacgtgccaagccctgagttaagtataaacgatacaacaccaaagaagataaacatgttctgtataatcgcaaagctcataatttcctcccaaagagtcacaaaatacaatttatttattttttgagatgaagtctcgctctgttgcccaggctggagtgcagtggtgcgatctcagctcattgcaacttctaccttccaggttcaagcgattctcttgtctcagcctcctgagtagctgtgattacaggtgcccaccaccacgctcagctaactttttgtatttttagtagagacaggatttcatcatgttgaccaggctggtctcgaactcctgacctcaggtgatctgcccacctctgcctcccaaaatgctagggttacaggcgtgagccactgcacctggccgcaattgattttaactccatgtacagttgatttagtatttgtgatattcttaagtgccactgcaggttgggaacatggtgcactctcccaagccaatagcaagagtataaatgttaacattctttcaagagcgaaatgctatttacttagtatggacctcccaatgtgctgggtactttggaaaataggccaagtaaggagctattttttgttcctagagatctcagaaactagaatatcatacacaagcaaggtctggtattaatgccagcctgaatgagataattatgtgacactttgcactgggaagttcatggggggcttcctagaaaaggaaagaattacaatcaccaaatagtggttgaaaaggccttggaagatcattaagaagttgacataataataataatcaggaagttgacatcatcatcatcaccatcataagtaatacagatatcattaactataatttattaagtgttgattttgccagagcctgtgcttagttagcattttacatttccaatttcaaattcacatacaattatgagatagtatttgtaccctcattttgcagctgaaaaaactgaggcatagagtctttacatggcttgtgcaagttcagacattattaagttatggagtcaggatttgaaccaaatcccatctgagtccaaagtcagggctctgaaccatgattttatacagccttttgtgctggagggccaagcaaaggagctatgagtcaagaccagccccaacctctgactatataacttcccaacacctggctcaaagcagaatactatcaatcctccagaagtagaccattaagatgccagacagcctgtggctgctgtggagatgaagcaagctgacagatacatttgggatgcttccatttctcagtgatcattcagcgagggttccagatgccttgaaggcttctagaagcctttttgccatctctgcatgaataaatctatcagtccttcaagatgctgcttaaagaaatctactattgaaaggtttatcaggtaactttggcctaaatttatctttctctcttctgaattgtctggggaattgatatgatattatttgatttatcatttaaaaaaagatttggaatggctttattatgcatgcataactccttctcttaggaaattagctaattctagattgtatttatattagtctataaacagttggtttgcatatgtgcagttagattgtatgtagactataagctctatgagggcagggatatatctgagacattcatctctgaatgcacaacacaaaacactttatctagaacatagtaaatgcacaatatgtttatattaaatgaaatgaagctgaatgtatttcttggtttgaacttacacatagcaggttcttatattgtggaattaatgaatgaacaaatactcttactttcctgatggccctaatgtaattagctctcctgtaatctcttctacagtaagatgtatcaaggaatttgtcacagcctcagttctgtaattagttcgttttaattcattcagttattcagtgagtatttactacgttccagacaccacactaagtgcagaaggtacaaaagtgacaaagacagacctagctccttcccatgagattctagacatcaacccaagggcttttaagagctcagtactttctactttgagacaagatttctctatgatcaagtaaactcctttggcagaaggtggaattggccaggcctaagatgcactcagcatgaaaatttggttttggtgtgaaggaagcatcctgggttattagttagtaaccctttcaatttcattgcagtatttatcattttgttgtactgttgttaaatataggtctccctttctcattttaaatttttaccttcattacttttttttaagttcccagatacttggcctcttatgaggccatataacaggaagtgcaataaatggaagatctggaggagaagctctgagctcctcttctgccaagcaggtctgaccaacagggtcattgtgtgaccttgggcaagtcgcatccactcttgaggtctcagtttctcttgtaaaatgagcaactgtgtatggtttccaattctaagatccctttggttccagtgatctgtggtccattgctaatttcacaatatttttgttgaacttaattttgaatttcactttagacccaagtcaactggccaacattaagtacaaaccctccaaatagtgtttctttccatagtttggcttaagcattggtggtgcctcacgacttcctccctcctgccccttgaacagaagttccattaccaaccaaattaaatccacaaatcttaatccataaaatatttccatccagacacaataatgagattcatatttgtggtttagtatacctaagaaatgctcagatgaaatatgactagatccattgatacattcagaccacaaactgccctggtgtggtctggtttcaatttttgaaataaaactgcagagcacttgctttctctcttctatttcttgcctagacagaaaagaaaataaaaagtggttctggacaagtggcaacaatatagattcctgtaaaattctggaaaattatttcaaaaataaatttgaattcatttcccaatggaacaatgacctcttctattttggtcttcatccagaattttaagaaatctagttggctctttcagaagcattgaatagtgagttctcaaagtcttgagccaaggttaagaaatggaagagatttatctaggaagaaccgattacagacagacttacaacacaaccctaaataagagaacttctgaataggggtctgtgagatggttgcctttgtgaaactgttatcagccacccaaagtcagaaatttagtcccgaaagaccctgaaaaattttaagaaggcattgtgatgggagagacaggggcattgcctttagagtcaggaagacttaagaccaatttctacttatctgctggggagccttggacaacgtcctataccttctgaattgtggcttattcaactataaaatctctccagggttgtttgaggcagtgaatgggacaacaaagctataagtgcctgacatattaataataaacgttacacatatgttagtatatcttctcctcttctttccttttcctgtctccctttatgagagagctccatgacattgggcatattaaaaaataaaagagtaatagtgtagaggtggttcaagcactggttaagaagtagaattggtttgggatcaattatgtttcaactcaaagagctgacatagctacctggaactgccttgagaaagattctgtggctatgattaggctttcgggaaaaggtgctgtgatggattagcaatatccaccatgggtacaggagtggagagtgttgacgtgtacaccaaatatttggcatagcaaaactagacagctttggaaatctttcccgatccaatgtgctaatattcaaatgaatggaatcctgcttgagtgggatttgcatcagaaggagccagatggagccattgacaattacaaaatcctgtttaaatcaagttcaataaagtctcatacattttgatagaatatgactcatgaaacaaaaatacgtctctaggactggaagcaggaaaccagactctcagggaaaactaagactactcccgtaattaatttgtgtgacctcaggcaaagcaaacatactttcattgtctattttccctttcccaaaatgggaccatctaaatgctataataataatgaacattgattgcatatgtcgtctgtgccagacactgctttttgtgtcttctgtggattatctcattgaatcctccccaagacttctgaggtagttgtctttatttttcacagtttatggaggagaaaactgaggctcacacagctcaagatcacatagctagaaacggggaacagaaatttaaatcaggtgaactgattcacttgttttaattatgttaaagggtggtttgcataactaaggtcggggtccagagaaactactggtaatgaaatatctttatgatctacaggcaggacaggaaaaactgcagaaaaatctgaaaaatagagatatgtctaacccccttaacttggctttaacttagctgtgtaactttaaacagcattttctaaagtgtaatctacaacacgttgataggtactaatctgagggaaaaagatttcctaattaaacacgtttggaaaatgttattttaaaccaaatatgattttaagccaaacaaattacacaactttctttacttcaggtttttccagggtgtttaataggttcatgctcgttggaaatctcgaagaaggggacagtttatagagtgtttcccaaatctacttgattattctgtttgaagtgagtcacaggattaggttggatggcacacgatgggggaagaactgatagagaacaaatcctagacccttactcctttcatttcttcctgtattagaaggaagtagagatatacctaactatgacctctctgggataaaatgtgaagctctatgttagaggatcttgagcaatttaaactaagagtgaagcaagtaggtcaatatttatactgtgcgtggcactttacaaatgctgtttaatcatgttaccaactctgggaattagggagcattgtttgtattttactggtaagagaactgaaggcttaagaaggttaagtaagtggcctagtcagcaattatttgaatcagaattaagaacagtcttataattccaaagtctatgctctttctgctatatcaagttacctttgaagtaagattcattgttcaagttaaagaattaatatttatctactaactatcagagagaaacacaatatcattaatatgaatagagttgttggatttgcaaaatggaacaaggtaggatggtgtttgggaattggggtttacataactattttatttactgttgtgaacttgaggggagggcataggccaggtggactataatatctgtgtcttaggcaaatctttaaagcccctggagaaaagcctgctctccttgagtctgacctgaagagaaggttaataagtgagaggaagatacagtgagaagtagcagatgggggagctaaaaatctatcatttctggaaaactgggcttcacactatgtactatctaaaaaacgtgtggtttccaagaaatcagtcaagatcagagagcgtttcagaggggctggaaattaccactttcagttttgaaagcatggacttctatgaacaaacaacttatttgtataagtaaggaaaggagggaaaattccttctaaataggatcatttaattcagcatatggcaggaaattcaagaaattagccagagagaaatactagtcagaggaaggcagaggcaaatgaagatgaatcatacaaatgaataacttttaatcattattctgaacttcttttaggtatagagtttggcattatgtttttggaggggaacttactagatgattttttttttctgcttcaatctctatatacacaagtatgataatatccaccttgttaggttaaggtgactggaaagtaagtataaaaatttagtaaggttgactggaagggatcagtaaacatttccttaaatgaccaaatagaaaatatgtaaagctttgcagttagatgatttcagtcacaactattcaactctgctattgtagaggcagcagctatagataatacacaaacaaatgagcatggctgtgttccaataaaactttatttacaaaaataggctgccaccctatggtttgctaacctctgctggaatatagtagttattcaataaatgacagcttctattatgaaactaaatacagattgaattgaacaataaggaaactaacattttgttgagtgcctattatatacatttttatgccaaatcttacactaaatgctttttattcatgctatcatttatcttgtcatttgtcatgacaacctggtgagttaggtattattatgcttatttgaaaattaatttgagactcagggagtttccatgactggcttaagaggcagagccagcttttgaatcctgatttatttgtggttctaaaatgtctgctttcaactacattgagctacactgggctgactcctaaaggaattttcttagttcagataaggtaaaaacttaaatttttactgctccataaagaaagagatcagcattcaagtggatgaactcactttccatttcctagaccttcagcagctctttggtggctgtgcacatgtaagcaccaaaatatttgacctctgtttttctcccagaacctctggctggatctcaagttttatgtacttcctttttggagaatacttaagccaaggtgtactgtttgcaaacacttattagccttgggtagatattggcgagtttccgttggcatcaaatgggcttccagaatctgctgaggcctggctgtgctcattgattgtctttgccaaaaagagctgctaattaggatgacatcctgcttgtctctacctctagagctaggttttccttcctgggcatgcctattttgtcccaagcagtatgtttggatttttagtgcagatctagatgaacaagagcaaatttgcagtccctttaaaatctatgaagccttgtgctccagtgaagaatttcccagactacgttgcaagatgtttttaggtagatgtcctatggtcaggtatgtttggagatactgggctaacgaaagttgaacagattaattacagcaagatatctcagatgatgcactctacttccctgaaccatccattggcttctaaccacactcagaatgaaattcaaactcctagccattgcctacagagctccttctctcatttcattcagacatctgcacaatggcacattcacctctcaccccatctaaaagagcactcctctcaccaccagtcattgtttatgcccttaccttgttttgtctttcttcttagcaaatatcactacctgaaattgtgctataagtttatgtgattcctttttattgtctgccttccccctgctatggtctgaatgtttgtgttccctcaaaatccacacattggaacataatcaccagtgtgacaatattagttggcagagtctttgggaggtacttagatcatgagggcagaggcttcataaatagaatttgtgcccttattaaaagagaccccatagagctgccttatgtcttctgccatgtgaggacatataaggtgccatcttgatcttggacttcccagcctccagaactgtgagaaagtaatttctgttgtttgtaagtcactcagtttatggtattttgttgtagcagcttgtacaaactaagatatgccaccataatgtaaacaccatgaataaaaggatcttgactgtattgctttctattgtatcaccagccctaaaactatgtattgaatggacatatgagctgtgcatttccaagaacagaagagtaccaagtgtttcccaaactcatttggccacaaaacccttttttaggtgattcccatgagaatgcttttccacatgacacacttttgggaactgcttctctagtgggatcttatcatcaagaactatttgatcaacaggtaacaaaacaatgacaacaacaaaacatttatattgaatgccagtttctgtgctaagcagtgttcatgaactacatcatttaatcatcacaataaactttaaactaggtgctactactttgcttttaatatggataagaagaaattagcttaaagaagctaagtaacttggccaagatcacatagcaagcaaatacctctcaaacccagaggattcttatgccaaagtcatactcttaaccattattcatttcttcttgtgggctgtgagcttctccatgtcctaagatagagagctctttgtctccatcccacccttgagcctgttctttcctcctattagttgttgactaatctttgttataacctccagattttcagctatctcttgtgactcagcctcaaatccccagacaggactcctctgtccttggtactggtttttccaaatccaaagcaatttgtgtttttatcctgaaggccacctctgaaagcaaacacattccttgaggtctgtgtcctgagacagtttcctgtcctagggctgggatggtttcctcctatcacatgttgtgtcatcacactgcatacttgcaagccagtgggtgaagcgtgaaaacaacttcaagctctgggctttctgagcaaactgctaaggaagaggatgtccaaatctgggacacagcaaggactcctattaattgctaaagattaactttattccagttgtgctaggtttcagataaaccagatacaattttttcttttaggaactatattgtcaagaggggcagacaggccattccaggatgataaaggagatgatagatttaaaaaaagaaacataggtagaatgagatgacagtaaaagggcatctaatttacctggaggaagtggtgcctgaactgaattttgagagaaaaatatgaataggtgaaaaacataaaaaaggatattctaggcacgagggaatggcatttacaaggatataaaaagaataaaagggttgatgtgaacagtatgaatgacagctgaagtacaggatctgtttagagaccagaagcaagatcatggagaatcttgaatgtcagaatatctggacttttttgcaggcagaagaaaagcatttggaaatcttgaggcccaggaatgttaacctctatgtctcaggttgaagaaggggaaggctgggttgctgggggccagtgggaaagctgttgcagtggcccatctgtgagatgctaagatctgaactacaggggtaatggaggtggggcagggggtggtgatcaagaaagtggggaggcagtgaacagatttgcttgtcaaggcagtagagactacaacattttgtgtgtggggttagtaaagaaaaaagaattaatcgaagatgttactattcattatatctgctgagaggaatagattgagggaggaacaatggatgagttttagttttggtcacactgactgtcttgctttagaataaaatacatttggaatcattgccgtgaaaggcccctccctggggtgaaattcaagagaaattatggctaaccaatgagttaaaacaactaatcaaaacacttggctccactatatacatgggaggatgttaaataaaaactagtccactttagtggctgccagaatttttttttttttttttttgagacagagtctcactgtgttgcccaggctggagtgcagtggtgtgatctcggctaactgcaagctccgcctcccaggttcacgccagtctcctgcctcagcctcctgagtagctgggactacaggtgcccgccaccacacccagctaattttttgtatttttagtagagacggggtttcaccatggtctcgatcaatttttttattactcatcagtgagggtactgaagggttgagtgaacttgtcattgataagaggttgccagaaattggtgacactggagtgctggaggctgtggcaggcagactctaaggtggccccattgatactgcctcccggcattctcatacgtgtgcaattacctccccttgagtgtgggatggcccagtgactttcttctaacaaacagaatatgactaaggtgatggaatatcccttccatgattaggttacacaggattgtgatgtgcctcttgcttatagactttctctctctctctcttttttttttttttttttttttttttgagatggaatctcgctcttgttgcacaggctggagtggaatggctcgatcttggctcactgcaacctacgactcccaagttcaagtgattctcctgcttcagcttcctgagtagctgggattacaggtgcccaccaccatgccaggctaatttttttgtatttttagtagatacggggtttcagcatattggccaggctggtctcgaactcctaacctcaagtgatccacccgcctcgggctcccaaagtgctgggattaagaggtgtgagcgaccatgcccggtaactctctttctcattggctttgttaatgtaaatggccttgttggagaagcccatgtggcaaggaactgagggtagccttggaccaacagctttgaaggaactgaggccctcagttcaatatctctcaagaaatggagtccagccaacaaccacatcaacaagcttggaagctaatcatcccccaattcagcctttagatgagacatcaaccctgtccaacacagacaataacctcatgagagaccatgaggcagaaaatccaactaagctgtgcttagacctctagaaaccatgagataataaatgagtgttgatttaaagtaatttggtatgcagtaatagataatgaatacggagatactagtcatccttggctcggtccgtgtgagttaaggctgttgagagaataagactctgctcatttttcttttctaaaagaatgtcttaattctgaaacttttaagattgtccctggcttccaagagcaagagtcagaagacctaggattccaacctgaccctgttgccaactggcggaagatcttagaaagatctttcccttctctatgtctcagtttcaccctctttaaaatgaggtatgctaacctaggccagcaatttacaaaaacattctgttttttctgcacagagccctttcatcaaataaaatttcatgaggaggctcagtgtacaaaatagataagtggaggggctttcattgaaataaggttgaggggaatcccctgcttggcctccctgtctctccacagcagcccccaaatctttttaaattctttttaaaatccagtctgcaagattctggcttagaggctgcccgtaagcccttttagtttgaaaattctgtattccctaaggagatttaagaaaatagtaacctacctagaagttaaagcattcctctgcaatatctgtgcatcgaccttcacaagaccatcccacagtcctgggcatctcctttggggactgtgctaatggtgcgtctgcccatggtgggtccgtttttggggaaaatgaactccagcagacaaagctcccgcctccctaacattcttgacctcagtggtgtacagtccagtgtggcagggaaggcaatcataggggtaattatgacacagacagtgggggacgtgcagagctcagttggaacctggagcagggggattccaggcagcctgcagggcactcatggcttcccttgggcagcacttgcttatgtgtgtctatgcttcaggtctcaggctggttgcagggatgtgatgtggatcgggctttgccctcatgtagcttaaagtctagtagagaaaacgtattacattatgggtcacatgctaatcatttaattacagtttttttcaagaggtgaagcctgaaggagcaagctggagatagcaaaattaaccagtctgtcaaagaacaccagggccaaaaagacaagcttttgtgtctttcttagctttgctgtgtctagccctctctcttgtcagaagatgaatagaattagggagctgagcatgacttccttactgaaatggttataactagcctctcaggactgggaactgggtttgatttttaactccaccaagtactttctgcatggtattgggtaagctacttaaacgttttcagccttacattgtgcatatttgaatagggtgggtgataagacttactagaagctatggttgactaaatggcatgatgcctatagagtcctcagtaaatattagctattacgattatcccctaggattctcctaggagaacatttcagacacattcttgtcgaagttagcagcagccagctttagggttagaggtgaacaacggtcaattctgaagcaaagctatctatgttcagaactcatgatatatctctggctcttggtatagggtatttgaggagggttaaaggaccaaacaaagctatttaagttaccatggctatatcatgaaggacctatgaacttcaggaaacttcaaaattctgagacgacgtggcatgaaatacatatttttaaaatctccattcacagatagactaaaaatgcacatggaagggattttccgttcgcgatctgcttttgacttgggcattttgcttttattccatgatgaagggccaaagagagtaatgatagtgacagggttgtttctaaagtggaagagaagctggaaatgtgagacaaggtggagggaaaggagtttaggcttaagggcataactgaaaaatgtctggccaccaggattagaatcaggttggtttgcagacttttctcctttacagagaagtcacaaagcatgtatagcccccgaaggtaggtaagttcaccatctctgtcttttacattgaatggaattatggcctggggtttgcaggaggctggtcatgtcacactttgaggggggttttcctccttggaagggagccttcatctaatgtttcccacatgttgaaggtgttcaaactggcccgggataagattcaaggggattccctacaatcttctcagagtgagaggtatttgaatcataatcttcctctctgaggcttccgctgaatttgtggctcaatttgtggctcggagcctacaaccatttccaagctgtcctgggattcatggccccaaggccgatttcactttacctaccaatcagcccttttaaaaccagatgtttggctcacctgtgtgcctacttttctgagatgaaaatcagcaggagtgacctgactgctacctctagtttcattcttctctcttccagggctgaaatttgaactttcctgtttccaggcagagagttgcaccattgagagctgacctttgctgagaaccatgaaaaatgatacatgcagggctattctgtaaaatcaataggcaccaatgccagctgggggcttctccaccatcttgatcattcactgaaagacaccatttaaggttctaaacttggtcagcacagcctgacttcagaaggcaatatagcacagcagaaagaacagtggggtattagttagaaagcttgggtcaaagccagctctgcccctcaattacggaaagacctcagatgagtcacctaacttccttgagtgtcgatttctttaaaattgagctagtaatttataatttgtagtgtctgagtgagaatgagatgagaaaccattggcaaaccctcctattacatatgtgacactattaactttgtgtttgtgtgttttaccatcacaaaaggacatatatttcgagccaactaaatgtttgcaacctactttttacgtttcaaactgaagtggcttcagcatgaagggggctgcgctttggtccagtggatatgttttcttgtaagaaagcacagctaggtgtctatagaaatctagagagagaggagagaatatgtgctcttaatttattgttagcattagaaagggtaggattaagggggatatgtttttcattctgtcagcttgaattctctttccaaattccattctggttatatgatcaggctactgctgtatttatgggtggccacagtctgcctggaggggcatatttagtcagaaaggaagtgttttccttctaaaggcaggcaagaagcagagaagcattcagaaggaacacggcagaatgtacctctgacttggtgatcacggggacctgggtgtgaaacctggctgtatcactctgagttctaggaccttggtaaagttattcagtctccctgttcttgaagccatctctttgtccaacaaatatagtccatacctcagagacatgctgtggatgatcccacaaaagcctacagtttagagagtaggctcatcatatattttggctatcattgtcattagaattaattaaaatagcctttgttaagtcttttatttctcattcatattcctgtctattacactatttgtggacttgctcttacttctgctacagatggtgactcagaggggcaaaaatccttgttgaagggcagaatggcaaccagaatgcacacagcctggtttcatgatttgtaaatgtgctttttgtcattgaagattctgtggcaatgtcccagaggctaagagcaaaggtgtaagttttagaccttgtgaccccacttcaaccaaagcagccctgcatttacctgtcatatactgggggtttgccctaaattcatgtaatgaatattttcatcattaaaaataagtttaaaaatcatgatcttagaatattaatcttggacaagtccttgtaaaatgataaacagagaaactaagaaaagtttccatttattgaacccttaatatgtggaaggtactatgccaagtgtttgccatatattacctcatttgaatgttgcaagagccctgtgagacatagtttgtcatctccattatatgaatgacaaagttgagggctgaaacgttagtcacttcttagagtggggaaggaggaggttagtgtgggataaaatagagaagctaggtttttaaaacaaagcatagaggaaaaaaatatttaatgactgtagagcttggcaacatccctttcaatccttgtccaatttaccctgtttgagcaaaccagagaatactcatattgtgcacctttttcttccccacaaagcagtcaccttcctgaaatgcaagggccaaagcacgctgacttacatctcctgcaaatgacttgtatgcgcacaaagccagaaactcttcacttggttgtctaggactgaataaatcttcttcagtcctgaattgggcttgcctggctgggatggatagtagttttcctttctaaaacacatatgggaaagctctgtaaaaatgggggaaaaagtctacaaaaacatgaaaaagaggcattcattcttcaagtggtgctccctgtcctgccctccctccggacagaaagcttttccaaagagtttccaacagcatcgtacttcatagctgtcagctttagaatctgcagatgcctaaactcaaaacctcctgacattctggaatcaaaatttgacattaacttccagccccgggctactaccttttctccaacctgtgccaacacaacctcctgcttgtaaaatacagccaagtctcagacctgccagcctagtgagacaccctcagattgggtgagataaaaagcgggggctgggggcgggctgaggaacaacacacaagaaacaatccaagactggctcaatgcctcttttaacttccagagtgatggcagtttttggcaatgacaatgattatccaaacttccagttattaagcagtcattgctgatctttctatacctcattttctcctcaaaacgacagcagacgctattgtccccattttagagatgtgaaaactgaggattaaggaagtgatgtatctttctcagggtcatatgtatggtggtggggagaataccaaacacctctggcttcaaacctaagctcttattcctcttacaacactgatgggtgagaagaacccctgtgttctttccaaagtacaccaggggcagcagggttcccatacctgggggatgttgttgctcagatctttctgtgatgagaggtgaggaggaggaggtgattctagagacatgtgggacgctgctggctctaggcaccccagtaaagctgttctccaccactctctagctgcctgtcagttattcatctggcccaggagccacctcctctcttctgtcccccagctctcatttccagggtgaatattttgaggaccaaatgagggaatgggtacaaaactctttgtaaactttatgtaagtgctgtttagatataaacttttatattctccctgcactcctctatcaaactccctctaacccatcccaggggcaggctatgagcaaagtctgccttaaaactctactgccctaaccctcaaaataaaagatatatacaggtgaatcagccagactagaagtaggagagcagttgaagagaaaatttttacttttcctctgcagaacagcagaagataacaactttacgaaaagttccttccaagtctgactattcataaagttaaaacaaacaaaattacaagaccagaaaagtcaaggtgcatctgatataaccaatacacactccttttttttccagcggtggaaaaaaaaaccccatatgttttgtaattataatataaaatcacaactcatttggtaccaggaatgcaatccttacatcataaggatctctagtgatgagggcaaaacagacttacctttccgatgggcgagagacctaggtccttggaagaagtacctggagtgtggagctgcggcggttcccacgtgcgcgttcccccgagttccccagcagcgctgcctttgtgcccacggaggcgggggcgtgtatctgcgcgcgggagaggcgggtgacagtaggcaggctgtggccggtgcagccaactttggctggcttatatagcgagctccttcctctgtaatgggacgcctcgcctccagacatcctttcccactttttcagttggcgaattaaaggaacagccctcccagcggaacagggttagctcatgaaagacgcactcactcctggctctcggccagggaaggaacccatttgcatacaatttatggcgaaagtaggaattcccgcctgcccgcccccgaccccgagtagctgttagtgaaatgtgatttttgctttgctccccacacgggttttctaattgtgagacggatgcctggggagcaagagggagtaggatccgcagccctggctcccctcttgtacttggtcaagctggaaatgggaccagggctcgcctgggctctgggcagcagctgctcagtggcacctcggagcgagtacagggactgagcccagttcctggaaagaggagataaagcccttcaaaagcctggggggtttcaggtttctctgggccagcggagagataacccaggattaggtctcagcaggtggggatcgtgcgggacgctcacatcagccctgcttttcttgtgtgggagccagccttgcccagctgctgggaggcatctttgttccagccccagtgtcctgcagggcagtagctttttgacattgttcatgccctgtgcctggtgtggtcttctcagctgggtctccagggggaaggatttctgaggttttctcttagtgctgaaaggcgtcccccacagccctttctttaaagaaaagcaataatttaaaaaggtaacaacctaatccttgagccataagctgcgcctttgctttccagcctgccgtggatttcctccaagctctgagtcatccgttcgtttggtggttagcatgcattgagtatcctcagggcatacaggggcatttaagggagtggagaagtagcacttcacccgtgcctagagacttctgagcctgccgcagagcatagtagtttgtgacagtgaagtaaaatgaagcattaaatgtaattcaaaacgcaactaccattgagccctcccttattaagtctataatcaggtgctgtgcagggtactttatgaacactatttttgttcactatttttattatatccttgtaaccagtaagtaggatagacacaagtgtctcttttttacacaagaaaactgacgtttagagaagtaatgaaactttaccaagggaatacacctgggaagtgtttatattacaacactgggctccagagatctattacacgttactgtttaggaatagggtatgatgatatttaaacaatgttttatgctgtattagattgttaacaccatttgtgtagaaatcacagccatatttgaatatggaaaatatatttatttgctccataaagctaattaggagagatctttgatttttaaaaattaactactaataatggaggtctcaattatccacttattttcaatattaaatgatatcatccccacagttattattgttgctgtgggcctcagtttccccatctgaaaaaaaaagcaagacacgattaggtcatcctacggttgctttggctgtagtattttaggattctctgctaaagtgaccctcccagacagcaagaaagcccataaatagtcatgtcataaaaccgctcatttgaacttttgatccattttggctgattcaaatgttggttgtttgggaagttttaaattctgtgctttagccaaaggatatttcagtagcatgaagctgtgtctcaaccagcagtgagtggttcctactgagttaatctcttgggttagggattaaaatattagaatagtgtacaatatatgtcatatggtatataaactatatttgtatagaacatataatcaatatatttataattctatgtgagtttttaaataagacaagagcgcatgctagaaaactagatagatatggctttttcggggaatgtctcaaactcgaactcctctccccagttctttaggattctacaatcgttgattagtgtctaccacaagtggtatggtcaatcacagggaaactaagccaaatatgaccaggctggccctcaaagcaggaaaaggctagcagaggtgacaaacaagaatactattatgggttaagttaacaactatcatataagtgtattctgataacatagagaagagatgatttatgcatttttaggagaggctacttgtaaaaggcattttctccaaaaagctatgtggcatcttaagctttttggcatttgagtaaggagtgcccagacgaggacgtgttttccatccctgtactgttcgcagcctctgtttctggtagatgggtccatatgcaccaggtactctacaatacccaaactttgttcatgctaggatgatgccctaggctcctcacctccatgccctcacatctatttatcatccatttctgatctgacttcactatggagcttcctaaatggaagaaatccatctaggaagagatgtttctatgcactatggcatttgtaactctattaggacatccattgcatctacatggtataattacacatgtgcatgtctagattttcctcctagatgctaggcttcctgaggctggtgatcacacttgctttttctgtacctggcatagagccttgggtatcatagaagctcagtaaatgtttatagaatgaatgaagtaatggaggaacaaataaatgtttgacatgttgtgctttataattaaattcttccttttacaaccatagaacctgaaaaggaaactggattattgtgtccaatgcttccatcgcacagatcagaaagtggggtgctgagaggaagaatgacttgtctgaagccactatgcctgctttccaggaagaaaactgtcacaatcagaactgagcaaccaagccacactagacattacagcagaggaagtttatggaaatgaagaaccatttttcctcctgtttggcagaggccatacctcttggcatctaatccctcatggttgcatccttctgagaagcataagcacttttttccacttgagagggtagaatgaatgcatgtaaacaccacccctgcacagagcttcctgccaaagactgattttgttgttgcttgtttgcagttcttattcaggagttgctggtggaggctgtggtttagagaccagaggaatgtcatggtttgcctcaggtgagatcattctcatttctttaaaggtctgttaaatgtaatactttttcttccagacagaacagacaatgagtggaattttggccaggactagtgctgaggaagctgagtgtccacttccccatggaatcccctgcttcctactctgattacatactccttcactgttcccaaccttcctcctcctcttcccgggattcatctcatctggtgtgctaactccagtccaaaagtctcatgtgactccataattaccagaaatcttttccaaagccgggatggatctctgatcccacacagtgggccagtcatttaattaaatgcattttgttagagtcaaggtttcccaacttgcttgcagatcattgttgagtggtcttttccaactcttcttgcttttccttcgacaacaaaggacaaaatcaagttcaaagaccatatggagtgtgtggcaagacatatgagagcttctctgatggatggactatggcaatttagctgcgccatcaaccaagaagtcatgcctggtcagcacagcagagtggagagcattggttgagtgtctaagtcttgatgctgcatcaactcgctgtgtgactttgggaaaatcgctttccccgctgacacacagggtcctggttagcaagtggggaattcccagggattatagcaactcaaaactctcaagtaaaatctttaaagaaataatttagaagtctccaagcctttgcacattcacttccctaggaagaaccctgtcttattgccatgacaaattcctttattatttttttcaagagttccttcatagtgcttcttctaacaaagttttatgaccctcacatccagagagaagggcctctccttcatgctcatctacaccaccattttttaacttttagtatgttgcacattttatttctcttgcctgtttaccctgctagatcatggacacctgagggtagacactgtgcctttccatctgtttgtcagcagttctctttgttgccagcatctgttgatggctgctgcctatgtcatgttatttgttaattattttgaatatcattcctacatatcatagtgtttagaatagcatacgacctgtcacagattttggaggtaagcaataaaggcattcttgaagtgacttttatgaaatgattagagaccttaattgttatcatcaatttactcattcatttgcccagctggtctgtgaggactccttgaggccaaggactgtgcttttcacctgtacagacccaaagcacttggaggttgattaatgttcctatgaaatgattgactgatcaactaattggctgcataatggaaaatatatgatattagcacacagtcttgggttctatttggcccaactgcttacaatgtgaattaccttgagaaaagcatgtcccctctctgaagctcctcctcttcttcttgggattcatctggtttcctgttttataaaactgagataaaaatctgtaccttgagtacctttcaaaattggtatgaagaccaagtaagagggtgtaagacaaagtgcttagtaagctgggatgccctatgtagagttttttgatgctaaatgatgtagttcccttccccgccccccaccccccaaatcccaacaaaaagctcaatctctgcatagctatattgtgtttatgaaagcacggaacccagcttctatctgaagcacttctgggctttgcaggggctggcagcagggagaggggagttgaagccacctggtgctgtcttgttaaaatattcaaaaggctgcctcttcggaggttgaagggaaagaggaaaagtttaaaaaactagcattgcccaagctaaattagaagatgtggagttgtatatttccaacagagggctcggaggcagttttgatcatgtttaccggtctgagctcaggctgaggtgatgaatacaaatggctcaaaccatcttgggcttaatacaggtcacagagggaatatatagctttgaaatcaatgcaaattgaatttctttctttgattttccacagctgggttggatacttgtgaggaagtataatttgcttgttttccttctctcttaggtttcttaagatttcttttgtggaccacaaagaataacagtggctaacactgattgagtattttctgtgatctaggcactcttgaagcagtttggatgtattaaattatttaatctttacaatgagcctttgggttagtcctatcattgttcccattttgcagatggggggtgtgagacatggagaggttagggaaatgtccagggtgcatgggtaataaatagtagcaagaggattcaaacccaccaagaggactccagctcccagttgtctattattatgggtgctttcttatgtatttaatgtaacaattgcccaaaggcaaagatggcattctttgattcatgaactagattgagtgatttggagcttgcacataaagatctgaggaggcaaggttgtctttggttattttcctttgtccctgtctatttgtgccaatcctggagttttgggattacctagcatgcacttggtttcaaaccttaatttaaccaataatagctacaaaaaggagtaggaccttgggtaaattacttaacacctttcttataagttctccatctgtaaaacgggtacaatgataactgatactccttggagctagtctcaggattaaaagaacaatacttagtcaaatgcttatgccgttgcttgccacattctaagtaatctcaaaatagtggcctttggctattgtagataagtcacttattctactgtgagcctttactttctcatctgtaaaatgatggaaaagataatgtcagaggtatgtttcagaaatgtgctcactaaaataagaagggttaataaaacaaatgtacatgcaaataaaaatatacagctcttttcatcatgggacataagattttcagattgaccgaactgtactagtcaccctgtgtgctctaatattcttcataaatttcccctccatcctgctatacacatgcagtacacatgcacgcacgcacacacacacacacacacacacacagagagagagagctcattgaaatgagtattttactgaagggatgtttagtattgctctgagagagaaatagtttgaacttcctttgaaaagtagaactacatttgcccatccagtcaatagcaggcattattatttttaatcgtctttcaagccttgtacattctgtttctcaggtggaaaaatttaccctatccagagtcagctgggtggtttcacttgcctcagagccagaagctccctcggcagggcctagaggttgatggattggcatcacataggtatttgagtcactctcctccttgggaagtactctgggctggccctttgtcccttacccttcctaaggaggagagtaaattgaccctccttattttagtgagcacatactaggcagtcctaaccttgactacttccttgccccacagccttccaatggtaggggtggtgacaaatatacccacttgtatttgctaataacatgacaaggcattggcattatctcagtcctcacgccaggccattcccctaatacaagtgagaaagctgaggtgaggagggatcaagagacttgctgaaagtcacacagcttgtatgtggtctcacagaaggtccgcatatgaaaattactgagctactgggctcttcaggtttccattacagaaccatctataaagagtattattttatcagttttatggggtacagtggtataaagaagaagctcatgatctgatactagacagatgggatcaatcttagctctaccatttattagtgtttgaccttttttcaatttccttcacttatgtgaccccatcttgtatctgagtctgtaaaagaggagtgagaatacttattttacagggataaaggaagggccatgggaaactgagtaaggattcccaagatgtgtgtttgaatccatggaatctgtgaatattatcttgtatggcaaagaagactttggagttgtgactaagttaaggatcttgaggtggggagactattttgcatatacttaaaagtgtctttataagaggaaggcagagagagatttgactacagaggaggagaaggcagtgtgaccaaggaacagagattggagtgatgtggccacaagccaaggaatgccagcagacaccagaaactgaaagaggcaaagaatggattctcccttggagcccccagaaagaccaggcctgttgacaactggattttagcttactaaaactcacttcagacctctggtctccatagttgtaagagaatacatttctgtgttattaagtcattaagtttgtggtaacttgttagagtagcaatataaaactaatacaagaaataaatgggaaagtatctttgtgttgtgcataacagggccttaaaaacaggaatgcttaacttgaactcatggagatagagagcagaaggatggttaccagagtctgggaaggttctgggaggagggctggggggtggggatggttaataagtacaaaaaataattaggaagagtaaataagatgtagtattttgatagcacaacagggtgactatagtcagtaataatttaaatgtacatttaaaaataactaaaagagtgtaatcggattatttgtaacacaaaggataaatgcttaaggggatgaataccgcattttacatgacatgattattaaacaaaacctctcatgtaccctgtaaatatatacacctactatgtacctacaaaaagtaatgaatttttaaaaatggtaatggttagtattggtccaagagattattttctgggagaaatggcattaacttaccttgaaactggaatgcttttccatagagatgtagttctatgatgtaaatgcacattgctagattttcaagtagttttttttgtcacagctcctttaacatgacattttagttgtaggctgaaagacagagaaggaaagggaagttggagggagttgcaacctccatcattagcccgacagttttgaagtggcctgttgacatgggagctttgcagtgtcgagtggtttagcccacagtgaggagtaaatctggacttatacatgacattcctatcattccagggtcagtctgaacccagcaagtggcaggcttatctgggtccctgctcatccataattcagaggattcacccacagcacactttgacaagtgtgaaaagagctatgagacaatcctgctcaagttagagataagaaaatggggcccaaagcagttgcttgtcttgcccactctgagctaaaatccaggtctgctcatttgtgaaactatgttccacatggaggaagaagcttgcctagattggtgtagaaccagccaaaatcaaaggaatttattgcttaaaaaaaatcctttacacggattgggcttcttcacttagaaaggacataaaaaggggaccgagaggagtaggtgaacacacaccaggctctctactccctctgagcttccgtgagcagtataatgttgcttctctctctctcctgcttttctccggttttggatgtgtgcagtgctctcatcgatgtggctgtggtatcagaggaccaaagaagccccctagtgagatgccaggcaagtttttcagacactgtatcagaaagcagcctctgtaggagaacttcaaagactttctaaatgctttggaacacctgcccaggcccacattgggctcaacttgcagatgaatggtatatggggagtgctcttgggtgaatatagatagatgactcatcgtttgagacagatgatggatttcccttgtggaaatactatataaggaaattatggtgaaagtttgataatccccatggacaggagtgggcaggggccaggatgaatcagtgagacagctgcattgtggaagaccaatccagggaagcttactttgaagtatattttgccagtggctcctttaaactagtaaagtattgccaaggagagatcttccgagagtctggcttaatgagcagaaatcagtcataagtggttgcttttgaaggaagtggaagtactttggcttttagcaagttgcaatcttgtttgctcagttaatctaagaagtaattcatatgaaattgctcctgttcagccatatttgacctacaaaaatgatactttaatatgattaaacttaatacagtataagccctatcaccaaatctgtgacaaagacaaattccagaccagaccttggctaaatttaaaaaggttttgcccaccgtcactcttgcgatggaaagacaggccaggttggtatggggcagggtatttgtgaaggacagtgagttaaccccatgcttgcagttctgacagccatggttggcagatgaatttttttctcccatctgtggatactgtactgatatcaacaccatggtagaacctaggtagagcaggaagacacccaataaaagagatgtcacaagctgatattgtgtatcagagttcaggtttaggcccttagagagccatggagatgaccagatagcaggggtaaaaggcatggtgttcttgagactacacctgggcaaacatgtgaatggatagttgctatctaatgagccccatggaagggaatggagttttacgctatcacttctatgacacaggggatcttctgtaaatagtgattgttaatttttattgagcatttattatgtgctggataccatttttagaactttacatacattaacttcatttaatcttcataacatttctatggatagatactattattagtcccaaatgaaggcatgcgcaagaggaagttacttgatcaataataaatagctggtgtcagatatgggattaggacccaaaactctttacatgttgcacaggatcctcttcactatgttttcctgcagaggatgtttgtattaatccattctatgctgctaataaagacataccagagactggataatttataaaggaaagaggtttaattgactcacagtttcacatggctggggaggcctcacaatcatgatgggaggcgaaggaggagcaaaatagtctcatcttacatggtggcagacaagagagagcatgtgcaggagaactcccccccatccttttttttttttctttttttgagagggagttttgctctgtctcccaggctggagtgcagtggcatgatctcggctcactgcaacctctgtctcccaggttcaagtgattctcctgcctcagcctcccaagtagctgggactacaggcgcatgccaccatacccagctaattttttgtatttttagtagagatggtgtttcaccgtgttagccaggatagtctccatcttctgaccttgtgatctgcccatcttggcctcccaaagtgctgagattacaggcattagccaccgcgcctggcctgggaactcccctttttaaaaccatcagctctcatgagacttattcactatcacgagaacagcatgggaaagacccacccccatgattcaattacctcaccagtctctcccatgacacatgggaattatgggagctacaatttaagatgagatttaggtgcggacatagtcaaaccatatcaatgttttactgctttactttccttgttgaaggaaagaaaaagaagggaaagaaaaagaagaggaagaaaggaaagggcatgataatatttatttgtatttattttgttgactaattcttccaaccatttcttcattgcacttagattgatgggatacacaggccctgtgctaatagctattggcgatatagccacaaacacaacagatgtaatcactttccttttgagcttaccttctagggcaatgtttctcaaccagggatggtttactctctagaggatatttgctaatgtctgcaggcattttggctgtcggagtttggaggtttgctatgggcatcaagtgggcagaggccagagattctactaaaagtctgcaatgcagaggatggtctcccacaacaaataattctttgtcccaaaatgtcaatagtgctgtttgaataatgctgatctagtgaggatgtaggatgttgaatcgtgacaaatatccaacatagagattgaaaagacctgaacttggaccccagaatcactctaacatttatgaccttgggcagaactaacccaacagacatgcaatgggatagtgtgtagagacacaggtttcatgagatgggataaacactctcttctaatgcagtgtcttaggaagtaaggagacttgaactggtcatgccacagagtgcattcagaggggctgtgtcctgagtgagtcaccaggatcccaatatcatatttggagatggaagaagcagagctactcacttctaggggtgcagacccaaaactgaggatatctgccatggccagagaggaatggggcatgcaactggttcctaaatgttctaggccatgtaagacttctagattattgaataaactagtggacaagagaagcaacactcaacacagctgagactgaattttctaccgtcacaaaggagtatggcatggttgaaagaaataaagaagtgagatatatcttaccctcaagtattgtaatgtacccattatgaggagatatatatatctcccagcttctctggccagccacagaaattggtagttttctttctttcaaaagaaaacaattgcagttgaagtaatagctttccctgtttttatgaaagttgcatgatgaggagatgagacccatgggtatgataaactttccaatgcctaagcattctgttttggatgctaacctctagttaggaagtatatacggcttggcttataaactgtttccttcgtatattagatgttcccttctccaaggaccaggatgctgagaccagaggtttaagaatttgtctccaagactcctgagccccttattgctgtctgcctcaagcaatccaatagaaacagctggtttcctttgggtaactgagaagaatgctcaatgtcaaaatcattctccaagccttaaaatatccaacaagatttaaccggtaccttgaacagtggctggctcatactaagcactctataaatatttgttataagaatttatggcagaatctaatcacctttgaggtgctagcttggatatggaaaatttggctcacaactttccttgtaaaagcagccaattaaattcaatacagagttattaattatctacacttttctggaacaataaaaataacagccccaaccttttgttcttggtgattagatgttgtatgagcagggttggcagtagttagggttgccaaagcctggaactataatttttttggaactccaattcagtgggccaatgccccctaaggcatcaatatctttattttacaaatacttgttagattcagacatgtatcacaccttggctgcaagtaatgggaccatgtcatagggattgaaagtgatccatccatggtggcgggcgcctgtaatcccagctactgaggaggctgaggcaggagaatggcatgaacccgggaggcggagcttgcagtgagctgagattgcaccactgcactccagcctgggtgacagagcaagactccatctcaaaaaataaaaataaaaaaataaaaaataaagtgatccatccagccctgaaggagtttataaccaaagaaacagtaattgtaaaacaatgtcataagtgctgcagtacagtcaccataagaggctatgattgggacacaaagagatagagaatcttatatttccattgcttgagtatttttaatgtccgaaaactcattgtcatagaaggaactacagagaaagaaagtgcactaatgtttactatgcattgagcatattttaaataagtacttactatatgccaagtactatgggaggttctgaagaggcagagaataaaagagacaaccattaaacacacaaatacacaaataaacatgtaattccaaagagctatgagtgcaatgaaagaaaagtcaattgcctatgagacactctatattagtttccacttcctggttttagttaatcccatcaatcctgaaataagtattttaatctgtattttgctaaggagtttactgaggcttccagctgtaaagtgttttgccaaaagccacccggctggtaagttttggagctgggattagaagccagaattgtccaacgccaagcccatgcacttcactccaagtcctcataagggagcctcatgagatatgagccaccacattcagagacagtttcactaatttattagaagcatgcttattaaaacgcattctttctattcagcctgttatttactttatactcctttaacatctaccacccatataggggttaattatatactatctcatgttgatttataaatgtggattagtcttgtttaagtaaggacatggaaagtctgattctcccactcaaatccacccaccttctgtctaggctgatgctggatgtagaagttcctattaaatactccctggtttaaagcacagatcttgaaatttttatggtattggatacagactccagagtaatggactaagagaaccaaatggctctgagttcccttaaaatcatgcagagctgtgttcaaatcccatctcagtccttactagctatatgcttctaggcaagactttcacacctctgggcctcagagtccttacctatgacagggagatcagacgcctaccttcagtgttcttttgaggggtcaatgagttaaagcgcttagcaccatgcctaggacacagaaagcactaagtagatggtacttattatcacttctaggttttcctctttattggaaggctctcacctgaaccatcaaagctagctgctcaacttttaattcatttctaaaactacataaggagttggaaacttactgtattctatttttttctggatttttttcccttgcttttaatagaaagggagtctgatttgttccactttttcggtgccagtggttctcgttctcgacggggggcaattttgtcccccattgtttggaaatgactggagacattttgggctgtcacaactaggctgggtggagatgctattgacaactagtgaatggaggtcagggatgctgctgtacctcctacaatgcacagggcagttccccccacacttctcaacaaagaattatccagctgaaaaatgtcaatagtgctgagattgagaaaccctggtttatagcggctagcagaccggagcccgggtgagctccaagatgatgtcatgctgggggagacccacgctggcctgcggtgagacacattacacatgggggatcgcaccatttccttgcagacccctcacctcaccaccgccgccgcctcatatcctgctcaggtccctcctgggaacccagggaaacctcgcagcagatggggtttcgtttagtcacattctctgcagccagattggattacatcgccagcagctctggctctgagagaccaaagttgcttgatgagctctgggctggcctttcaccttccaggacccaagctcaccccaacacacaggaggagaggggcttgtttgtggttctatctctcaaaaggacaaaagctgagaaacagaaaaagccaaaaggatattggtatcttctgttgaaaatggtgcctggatatttctgtctttatttcttgtgtttattatgacaggtgataaatattccgtagtctttttgaagaaatatataaattatagagatctccagggcgtctgtatttcatacgtgtctttgttataggctgttagaacaccacagactgggtggcttataaacaatataaatgttatttcttatagttctggaggctgggaagttcaggatcaaggtaccagcaaattcagtgtttggtgaggacctgcttcctggttcatagacagccatattcttgctgtgtcctcacttgacagaagggacaagaaagctctctgagccctttttcatgagggcattaattccttcatgagggcactgccctcaccaccttcctgccggtggttccacctctaactaccatcacattggggattatatttcaacataattttagggggatacaaatattcagcctatagcaatgtaaaagagtcaaaatggctattaatttttgagcagttataataacataagtactgtgttatgtgtttaacaagtattgcctcatgtaattctaaaacgatgatgtgtagattagcttctccacttgaaagcagatgtaatggaagatcagcaaagctggctcacttcagggccacagctactaagtggaaaagccaggattcctactcctctctcacttcctgcaagacctaagtcttaaccactaagccagatgcttcttactaaatggtttagtttggttcgagtgagaagatagctaatgttttgcagaaagcatgactaatccaagatcttccagcaactgaggagtgatggaagcatttctgattcctcttgttgttgctctttagcaaatgggtgaaacaggtaaaatgagttaccaaagcctctcatctctcacctgggcatgaattctatgcctttccaatatacacatgctgcctcctgcctcaaattccaggtgttcccttttactagatactacgctaggaaccagggacctaaacattcagtacctgctcttcaagaagcttacagtcaagtgtgaaaacaagacaaggaacaatgttattacaatgcagcagaataaatcctgtgactgaggtaggtacatgctagatgtaggttgtctaacccaggctatagggaggattagctgatttatctctgagttttgaaacatcctcaaagcaaagtagtttgggaaggataatctggtagaatatacagcatatgcaaaagcaaagaggcatagaagagacttcaggagcagtgagtagtttgggagagatgggcacatgatccataggggagagatcatgatgagtactgtgtgctaagcagtgtgcatttattcggtttttctgacctcccaaaaataacaatgtccacttaggaatagagattttcacaatatacaagggaactgcccacagctaacccttatgagaacttgctggtcttccatagggatttcggcaccaccagccaccccagtgtgcttggcactaggttagggacttctagtcaagtgatccttgaggccgtagtccacatacaacatctgctacacattctagtctctcatggctatgatgcatgccggagtgggcactgattctctacctacttaggtacgattctgttttgccaaggattctcctatacaatgatgtccttcctccctccatgctcagggaactagatagctgtttcctttcttcagagaggaagatagactcactgtatagttactatgaagagatttagcaccttcccgccaccagcatctatggaagatacaggggatgaggattctttgggaactagaatctaaacttctcgtttgtaagctatttttggataggaagcagagccacatggaaaagatttgataatgttaacaaatgacacaataatgactagcgaagccaggaagtgtttctttttatgctcaaatgatgcacttcagttacatagacttctgagaagatagccttcccattctatctaaaatgccattacatcttctaatatgcaacaaaatgccacctgatccataaatcattcctccatatttagcccagaataccgctttatattttagttttatctctattccttgattaccctactttgccaggatcctaagtaattgctttcttatgttcccctctcatgagattataaaataaggagagcaacatttattatgaacctctatgtggcaggcactgggataattgttttataaattcttgttcatggaatcttcccaaattgactatgggcagatgttaccagccccatattaaaaataaaactgggtgtgatggcatgttcctgtactcctgtgactcagaaggctgaggtgggaggatcgcatgagcccaggagttcaagtctagcctgggcaacatagcaagaccctgtctctgaaaaaaaaaataacaaaaatgagtaaaatggaggttctgagattttaaactcctggagggcttaaaatttatgcctttatttagctctgtatgctccaccaacgtgacataacagttctctgaatatggtaagaacaaagtgagttttattgaaattcttggactatttcttttccctactgaagtaaggcaatctccatccaaggttcatcttatattaaaaaaaaatatgctaggaaatctcaacagtgttgtatcaaaggagtcagagcattaaatattttgggctcctgccacaggcatttactgtgaagtaaaggacatgtattgttctgtgcttcatcgtgatagaaagaacgccagcgacgtcatgaaatattttaggatcagatttgcaacactgtgcttccaaacagctgtgtgtcacaatgaggggcagggcctgggcatctgggccaccggtgttcggctccttctcttcttctctcttgacctttagcagactccgtgtctctttcctttgatggaacagctaatgaaacacatcctttccttgagtcaatccctgatttcagaaaaatttttagacatctgtgtgtgtgtgtgtgtgtgtgtgtgtatgtgtgtgtgtgtgtgtgtgtgtatgttggggggatggagggaagagtgaggaaatagtttccattcagtagtctggagcctgatctattggaaaatccccaccccccaaaaggaaatgctacaagagctcttctttcacagagtttggagtggattcttttctgttgtgaagtgcagatgtgaaaaattcacctgttctcacctatggtcagacagactgttcagacttttaaaactgtggcaggagcatttgctagccctagttgccaatgagctggatatgtgggtttcccccactaaacggaacttggtcttatggcaattataaagccacattgaccatacttgaaagagagaggctgggggtggccctaatgagttaatggcaatgttcaagttcacttaacttttgtaatcatccagtttgcaaatgcatagcatctactaggagaatgtataatattcattaggagttaaagatgataatgagaatatttattcatttgtttaacacctatttgcctgtctcttgctatgcattgagtattgtgctgggaagtgaggaatttagatgaaccagggggtttgtccttaaggggctcatagcttagaacaggagacagacaagcaaagtgacaatggtaacccattgtgatcaatgtcattaaagggaaagtacaggatttaggaactaatagtggctcagggtgtggggaaggaaggcttgctagagaggattacacttgaacagaatcttgaatatgatttagagcttgggaggaaaagggaagaaaggaggcagtgggagagaggcagagatgtctatccataccagagtgtgaagaggagaaacagcatgctgcatttggggaaagtccatggagtgagggtcaggaatggagggagggtttggatgagacagatgaaattggcagaatctcatgtaggaccttgagagccctgggaaggattttgaactcttcttttctagaaaagttataggaggccatttttggatgtcaacaaggaggaataaagatagatttgtgcttgaaaaatatcatcttggctataattgtgaagcagaattgcaagcagattggagttggagagaccagcaaggggctgctgtagtcatttaagcaagaaaggatggtggctcaaaccagggtgggagttgcagggatggagggaattgggcagagtctagtgatattaaagacaaacttgcaagggtttggtgattgatgggatatgggtaaagagtagagagaagtaatatcctgaaatggaattggcaggtagggagaagagggagaagtgactgttgtttgggcctggtagttccagcttaggaatagaggcaatcgaaacaaaaaaattctgttgtagacctggcctcagcaggaaaccgtgcctgtgctctccttatctccagacttggcctgccagcacatacatatatcaccctctcacttaagatggagctaacagcaggcaaagttcatctcttagaggcccttaccctattggtttggcatgtctttattctcacagtccacagcagtaaaataataatattgcttacagagggatggcaccatggttaagtgcatgtaagtcagactgctggatttgtaaataggctcattcttaattagctatgtgagcttggacaagttactgaagccatctgtgattcagtgtccactttgataaagtaggggccatagctcttatttgacaaatttgtttaagagaaaaaaaaaagcagaattatatgtacatgagtaggcacctgataaatactgataaaacaaatgaatagttcttaccttattcttggttcattttctcttctcagtatataatactggatgcactttgtcttggggattcagagccctgctttctttaagggagaaagggaagttgaaaggtcaattaaagttttttggagaatctgtatcctgtgctgcattaggcatttttctcatgtcctctaacctcggattatcattctaaagtctttatctcatcatgttccttcctgttgcccaaaggatcaagttcaattttcaaatgttgagtaaggctttctagagtctgaatgtttgtgtcctctccaagttcatgttgaaaccaaatcctcaatgtgatggtatttggaggtggggcctttgaaaggtgattaagtcatgaggtggagtcctcatgaatgggactaatgccttcataaaagagaccccagatagccgcctttcttcttccactatataagggcacagcaagaagacaccaggaaggggccctcactagacactgaatctactgctgccttaatcttggacttcccagcctctagaactgtgagcaatacatttctgttgtttataagccacccactgtatggtattccgttacagccacctgaaaagactaagacaactttcatggccctttgtgacctatccccaacttgcttctttagccttatctcctgcctccacctgctaggtgctgactctaccctctgctttagatatgatatattttctatttatcaaaatgtcatgaccacatatggccccatgctaaaatgtgtgctgtaccttctgctgggactgtcctcagttcttactccttaattaaggctttgctcaaatattaccacctcttatagaattgatcattctatcctctgatccctggaaccttgagttttttctaatatagagcttattgcagagcatctcaattatttgttgagttcatctttcccttagtaaactgtgactcttcaagggaaaaacctgtaccttcttggccttggtagcccccaatcctaacccagaacgtggcgcagagtaagtgtttaggaaaactttactgaatgaatcagtggataagcagattcaagttaaaactgaaacaacagtaggtagatgacataccttttttcctcccaccaccttcttgctttgccttgccttcaccccagctcagcaatctgctcagaaaagagagcatcagaactgaccaaaaaaggaaggaatatcctaagaaatgatgcagctacatattgcttggcttgtgtttcctagataaggcattgattcctaggcactagaattatatactataattaaagagatttttttttaaatctatcaacaaagacctagagtttgaaaatctttcagttttctaatccaaattagggaaccagttacacagggtagcataggtcaaagggtagggctataagacctggattggctggctgaggataaataaggaagtgtagacttagtccaattgcagcccaaacttgacgtgtaacatttatacttagaaaatgtgtcattctcacgtcctttatacagatttgtccatcagtacattggattttcttaaacaactaccatttgattcccctattataattattgaagtgaattcactctgataaaatacagtccttagtagttcgctttaatgctctctaaaatattcttggaaaaatatgaacgtttttaagttgacaagtgcttttattataaaagtttaaatagttgtgagggatataatgtaaagtatattgaatatatagtcatttaaaataaaactaactattataaatagatttaatggattgaaattccactttaatttgataccaccattcatccatttaaaaatatacaagtagaatcttccctaacagttgaaaacttacatagttcttttgttttccttaaatgtttatttccatttcatttgctctatagaaatgtttcctaatgtagtatatttttttatactggaaattctttcactgatcatgttgttatattattctgaaacaaaacatgtatataaattcatattaaaatttctttaatgttctgtaaatataagatgctaacaaaacccaatttcttctggattaaattatcataacaattattagatgtatacaactgatcaatctaccatacacttattaaaattttgctaaatgtgatgtgaaacataaggttttattagaaatgcttctctgaatgaggtgaactttttaaaaaattaggccatatgtctgctgaggaatattcattattgctaacgtgagatggtatttcataaattttatttacttttcattttttggttgtaagcactgagaaacctattcacaaaaataagtagatgggaaaagaaaaacttttcttatagcagtgttataacttcttaccaggttgtatgccaaaaatcacataaagatcaatcatcaaataggatttttaatactttctcaggtgacattttaattaggttccccttcagttttgttgtaactaaagcattgaaagtcatctgacttgcagaatgatttgctgcaaggtcattagtcattcactttctcaacactttttctcgaaagaattttgagttgtacctttgtttggtcccccagaaatttttataccccaaagcaactcgagatgagtgagaggtatgaattccatttgtaaagtgagagaaaagcatttacgaaaaagggactctcttcagattcctgagaaagagtgcaaatgaaagctgagaatctgaaaatttccttatctctgccaactagagcccatggaaaatctttgagtaactctgggggtactatgcatcacagtctgaaaattattatatgggatgtactttctatacttaaattaaatttccccatggaggcagcattgttatacaggtgacaatgagataacaatgcaaagaaaccagaagtcaagttcatatcgacttatatagctctgtctccataagtcagaaacaggaaaaattaacttgttcttcagcaatctaggttgacttcatgaacgagctggcgttcaaatgaatccttgaattgtggaaacagaatgttaaatctggaatgaacttcagatatcatctagtatggagaggacaattaaatgttgacttttacatcaatttggattaaatatttgtgattgcttacaattctgtgtcaagaagtagtcagaggaatcatctgagatctgtaggaaagcatgttgtgattgattagctatgcctgtcagaggaagcagggagagaggggcacaggtgatctgctcttgcccccctaggtacatagtccttatcacatgaaccacagggaaaactgaggctgactgagagcaggaagcttgaccaaaactccacagtgaattattgccaggatgggtagaattacatatgttttattcaacatttggtggtcattgtaaatttggtaacatttgcaactggaaaatttggggatgttttagagctggaagggagcaaattcttaattgagcaatacacgctgtcctttctttcaggctccttcacatttgatctctgtgcaatttgataagaggagggaatgggccgtcaattatgaagagactgaaaacctgaaaatactgagtatggtcttagttccctctccaaagggagctcaggaaaaatgccaagccatacaagccactgattactcatctagctattgtttctacctcaccctggcccaggaagacagatctactgaggaaaggtaatagaggctggcaaggttcctacttttacatctatctgtaatatccactcattcttagcatcttgcacatccacagggccgtacaggagtcttcttgccttgtattattgaatcttgggataggggtaggaacagacagaggtattagcagagatccaacaggatgtaaaacatacatgttgatgcaggggttaactttatgtataataaatagatttttaccatgcataccaaactgaatattccttcctcctttttctctcagacctctttctatgtgtggctcattcttttactctacaacataatgttcagttgattctggactttttctgtgacaaacaatgctgtaataaacatcctccttgtgcattcatctgggtgcacttctgagaatttatctgaaggataaattcctagaagtagactgtctgtaacatagggtctatgcactttcaatttccatagattctgccaaatggttttcttaagaggttataccaatttacactctcagctatggtatatggtaacccctgctttcccacaacctgccaacactgggtatttacaaacataaataaatggagggtttgaataattgtagttttgaattagacttggggcgtccctctcatctgccccaacttgtgtctccccaaagcaacctaactaggggatggctaatgccatagactctgaggcttactcagagcagaggctgaatgctcctgcttcagtgggaacagggggtgtttcttcagtctgtgccctacttggcatctgtccctgacagacccagccagtgtggggagccagcctctctaaccataagaaagaatggattggaaacaaattgatcttttcacagctggctgttcccctctttcccctcaacttggactcagctcagaacaaggttgccgatgttctgctgcaacaaagatggcattattgaggactgcctctttggggggaaatgtccttctccaagaatcgcctctgtagtttcaactatgacaagcctggagaccgagcatagctgtgcatctccaagggtctccaaagcgacacccaactctatccgtcctgttgatgaccatgtactcttctattggtgtccacaactttatttaaatgatgtcagatgactcaattcaacagaatctaaccctttattcatcctccctggagacctgtggtcagtgggcaggagagtttgggattcaaaaagaggagaactgtgtgaacacagggaaaaaggatctagtgtttatttctagcaacaccattactattgctgtccatcctattattctgcattcttttgcttcatagcatttttttaactgaaagaaatggctccacgaaggcagaaatattgtttagtttaaaactgcatcatcagttcctagaatacctccttatacattggaggtgcttgatacctatttattgaatggatgaatgaatttcatgagcacctgtgttggacaatttaatgtacatgatgatatttaatattttaactctgtggggtatatatattatctttatttatagctaacgaaattgggtctcagagattaagtaatgcttccagaaccacacaactggtaattggtaaaactgagatttcatttagacctgactgatcccaaacctatcttttagaacactgggattccagtttatctaagcttaagctcaaaagtattaaaatattttgcaatcaatgagggaagttgtcatcaaggacatttccaggtgagcatggtgtgttcaacaggaagagaaactcctccatactcccaccaaagtgagcaagtaccaaaatgttaagtgttaattaaatcttattcatctggggacaagcagtagggtgaatttatatgcatgtagcaccgattttgagctaagtaacaaggggattctgaaagacccttatgcggacaatgagtgaatgtaggcaagggcactaatatttaacaaagttatgctgtgtgctaggaaccatgctttaaatttatgattccacttaatcattataataatttcctttctttcctcttttattgtcttgcccttcccttcccttcccccttctctccccttcccttcctctttccctcccctttcattccctttgtccttcccttcccccttcccttctcttcccttcctgtcccccttctcttctcttctcttccctctttctccttctcaccctcccctcccctcccctccctttccctctccttccctccctttccctccctttcccttccctcccctcccctccccttcccttttctacccttcccctctcttctcttcccttcccttcccttcctctcccttcccccttcccttcccttcccttccaccttctcctctctcctctcctctcctcccctccccttcccttctccccttcccttcccttctcccctccactcccctccccttctcctttcccttcccttttcccctcccttctcccctcccctccccttctccttttcctccccttccctccccttctcttcccttccctttcctctacccccttccccctttcccttcacttacccttatttcttttctttctttttctttgtttctccctccctctctcctcttttttcttttctcctttctttccttcctttctcctttttttcccttctttctttttaaattcccagacaagaattttgaagttcagctaaggtaagccacgcatagtgacggaaccagcattcagatttacatctcttgctacccatcatgtcacatagtgttaggcagagactggggtctcagttgcctaagtaaagtcataggcatgaagggtgctgcaggaatgactgagtggcaggctcctgacagcctggttgatagaccccaaggactacttgggttttggcgccatgcctagtatgactttatcctttaactgtttctcttgtcagtcagccccctgagggagccctgtctcctccttgaaactgtactataatgagaggtctccacaagggttccagaaagccacacagtgtgctgtggttttcccgagaactggctccaaggtagtgctctgagatcagtccttccagctcccatctcaaagatcttcaaactccaggctctcaagggttttgagctgccagttatgatgaaatattagcacagaagaaaataatttttttttctattctgtgtttcttaccaggacaccatggtttcagaatgatttatatactttgaatattttcaaaaaatttctttcaatgttgttccttctttaggtatttctcttatcacttgggctcagcttgatgcttctctggaatttttcttttttttttcctcccatttataaaataccaaacatgtgtccccagtctggatccatgtaactgaaaatcatggggaaattctttatgtaaaaagccctatagattgtttcggacaaaatcaaccccaaagagtttgtccccacaatatttgtgaataaaatcatccctctgaaataaaaacaccaccttaaataaaggagttcctctcaagcattttactctatatttattgtttgttcattcatgccatcatttgaaaaatactaattaagtatttaccctgtgttggtaattgtgctgggcacaaagaacataatagtaaatcacataaaattccatcctcaaggatcccatgttctatcatactagagaactgagtacagctgctcctcgacttatggtgggattacatcccaataaacccatcataagttaaacctatcataagtcaaaaatgcatttaatacacctaacccactgaacatcacagcacagacaatgtcaggcactttattacatgtagtaaagttgacatgactcttaatcctactaacaaccctaggagatagattctgttattattaccatttcatgatttaggaagctgagaatcagagaggttagtggctggggttgaaattcaagtagtacagtgtaagagcctttgcttctcctagaggctctgtaaaggtctgttgaataactgagtagacgatagattgattgcaatatagttcctctgttgcctttttgaagtgttagtttagtaagcaaccacagagaaattattatctactagagatgggaataggaacggtttcctaaatcagggttggccaatagtctttagttcaaactaaaagccatcacttctgcaacattatgtgtcaagcatgagctatatgacatgaaagataaagtgatgtagcaaatgtattcataattcagcaatatgagattatgagaaggagcatattcctgtgcactcactctgaggtcaaaggagacacccattttcctcttgagggaaatagtgagaggtgtttacctgaaggcccctggtttgtgctcccccatagctggggagagggagctgctgccgccctttccagtaggagttgtatattctataatgtccttatcacaattcctttaagggcctccagcactttggaagcatagaaaaaagaaacaacattcctgcatcgcggggccattgatgaataagaatgtttataagaaggcaagcatctttgcactctatacatttccaaatcttttagaaacatatctaagaacttcttagttcccctccatggttactggatctacaaacttggaatttccccattggccctctgattgtatttggagtctgttcttcatcttgtggatcctctgggctctgtcttgaactgttggaacattttgctcccacagctgttggaagtgacccattaaggtagccagagtcagtcactcagcatcttaatggcaagaccaaaaggggtgaaagaaatagaagtcacggttagtaagcgactgacctcattctgcaggaattctttctggaaagagagcagtagaatgttgtgacaggcagtaagtcatctgtaagaatgtttaccgtggaattctagcaaaagaaatggctcaagaaacttcctgggtaacacaaatagagtctgctcagaggccccaaaagagagtgactggaaaactttagccttgtgagggaggctgtctactccagtgttggagtcagctggaggtgcagcagcgcttgagctatccaaactgctaggatgttgttaataaaagaaccttctcgttctcgagtcaacatggctaaaacagccagccatgagatgtatgggaaagaagtgcagagcaagttgttatttattgaatgtgtagttaggaattactatttccatttcatggaggcttaagtagattgagaaatttgtctgagttcacaaagtttgttaagtttcagactctgggtttagacccatgtgtttctgactccaaatcctgcatggttggcttttgtgagagcaaggttacacactgtacacattttttttcctccattgcaccattcactgtcctaggtatatagaatcctggaacacaggattggaaggacctttaggcatcccatggtctaatcttctcatggtacagatgagaatgggctcagagaagggaagggccttgctcagactcacacaaaggctagggccagaatagatggtgcctgactctcagttcaggatgcttattctgacaaggcccgtcacttcacatggatatttaatgtattttgctagttggttaaaaataatgtaatgtatggcagaaccatctctctttcttcaaggtaagccattgctaagtctcgagtccttttttgtcccacagctccttttttcattgattattatcatttggtctataaagcctttcaccttcatttcagtgaacaatactgctgtgggagacactggagatgcaaagataaatcagtcctggttcatgagcttcaggaacttaggagcagtttggagagtcagatatgagaacagcttgttttcatacattattacacaatcatatgtaatatatagctggggggatatagaagtgaatatgagaagacctaccccaacctgggaaattagaggagtcttcctgtcttcctggaggattaattgattaaagtgactcattatttcattcctacaacaaatatttagcagacacctcttctgtgtcagatactcttccagttattaagggatgcagcactaagaaagcaaaaatattcctcaccttcatgggagaaatgcaacaagtgtaactaaacaaaatattactcaagtttgcagcagtgacaggcccataacaaggcaaaggtctacagactaatattgggttgaagatttatttttacaagggtggccagggaaggcctcttcaaggggaagtcttttgatcaaagaactaaagcaagtgacagggaagaaccttgcaaatatctgcttcccaggcagagtaaaaaccaggaccaatgtcttaagtcaggaaccagcttgatgtatttgaaaaagagcaaaagccaggcgtctgtagtcccagctacttgggaggctgtggcagaatggtgtgaaccccggaggcagagcttgcagtgagccgagatagcgccactgcactccagtccagcctgggtgacagagcgagactccatcaaaaaaagaaagaaacaaagaaagaaagaaagaaaaaaagaaacaaagaaagaaaaagagcaaaagccagtagggatggaggagagttattgaggttactgcaggaggagatggagatacagacatagacaatgaccagattgcagatgttgtgcaagtcacaggtgagtaggtcttgtcaataatttccctcctggtcagcattgctggcaatactatggcatcatgcatagagaaagaaaaagctaatagcaaatgaatcactctgatcatgcatcttgagatgttgccatggattacaattaatgcgttcctatccacaaggccagattccctcaaagcatctttttgggaaatgcagcgagctctcctggccccagcactcccacccaccccatcacacaccctacattcatcatctctttctctgtttctttgtcatgttgctaacatcccttgatggagatggtgcaactccaagtaaaactgtctccataaatatttagactgaatagaaaatgtgccaaagatgcaaataatctgtccagagggagaagagacctttctctttgttgttttcttcaggcttgtaatttaattcgtggatacatgtctttgaataatacataactatcaatttacctaaaagagtcccatagaaaccttagcctcttcatccttctgccatgcccctcatggcattttcttcttacgctggagtatacatttctctgcttttcttttatccctttctttcttctttattcccatgtttttgatcacatactgtgtgtcagcctctgttaagctcatctgtgcagagtctatactcactgcctgtcctcctctcatagtcacttgtcaattcattttcattagccttctccctccaccctcctttcctgagtctgttcccactgaggtcaacccagtgttcatattactgaacccagtggccatctttctgtttcttcttttaccagacctcttcactgaactagataatgttaattagtcctggctggagcgcaagtctcctttgacatctatttgcactgttcctctgcttgaaccactctgtctattccttctctgtcccttaaatttttggcttcttgtgggttgggtttttggtattcttctttgtctagcaccacccttgcttgccatcgtgccctcattcaggcctgggctttgacttgaatagcttctgaatctctatgctctgcctgtattggatagctggcaggctatgggcatgggctgctaggtcccagacaactcacactctcatctgataagtgggttttaatgtgacccttgttgtacctccttatttctatttcagtctcacttactgcttcctctttatctgttttcaagtcttcctactagatatttccttaagaaggcagagaaaccgtgctctcttagtaattgcacaattgaaattattcctcttgaatatttgatgatgacatattttgacttgatatagctttttcaatcttacaggaattctaaagctggaggaatgtttaaactccttccagctgccagtttcacgtaaagaactcttttctaaacctggggatatgagggactcttacattctcctttaatcaaatcaatttaggctgaaaagaaggccaagttgacagccagcatttcactgctggctgtgtatccatatacgtatgtatggatgcttagaaaagtggaatgctagtgatatatatatatatgcatatatatatacatatatctatatatatagacatatttctgctttactaggtgagaagagttgcttgattttaagggctctcaatcaacaggcaccaaatgaacttacagcttgcaaaaatataaagcgctcaaggccgtacagacaaaggtaagggggcacagacctttcagttgtctacaggtattatcatctgaaattgacatacgaagaaagaaggtcagagaagaaatgtgacatgcccaaggcaatccaactgaaaaaatagccaatgtggacaataatcccagtttatagcttctagtgcaatgacttttgccagcacccagcatatcagaagataaacccactgactttctttagtgaagattgcgaattgtttaaatcagagcatgtgtgcaaagtccagggtactatctaattcaacacttctgtaatttgaaagctaataattataagaattattgtccttgtccaactgttccttatactatttcattgttggttaatacattgaaaattacgaaaccttatttttgattggaagagtggtataacttctcttaggaattatactactagtatcctagtgaattatgaattcctacacttaaggaagcacaattataatagcattgtttttctttacttttgccaataaatcagtaagtactgcatgactacattctgctaaaacttaatagttgatgtggaagggaacttactccttattccatatagagacactgtagagtccctggaaatgctggctctcctccctcttctcatctgcccccagcaggggagaaatgagtttatgtattcaattgatgagttttggagctgctgaatatacttagctcaatgttcttattgtggtctccggactagcagcattaatagcgtgaagcaacgtgttagaaatgcagattctcaggccccactccaggctcctgaaccagaaactctggagatgggcccagccatctgtgtgttaacaagcccaccatatggtcctgatgaccatttgagtttgagaaccactagttagctggttccttcatcctctgtggacctgcctgctcacagagaggctgtgtctgttttctgccttgtggttaaaaaaagggtctgcctgttggagttggggaaggacatgcagctatgcagtgctgtccttgaataggtgttcctgtatgctaatttcaggtgcactgttggaaagcccatgatttcagatacctaaaccatgttctccaaccaaaccttatctaatgaagatgacattttaattcccttgtttaaatatgactctaatttcaaagtaggaagttggttctgactttgtgggtgagaagaggatatggtgtctaaacatgtgccccttaaaaccaccataatagccaattacttattctttatggccatatgtcaggtatattttaaagttggaaggagctttggagtggtctagctgactttatagctgctggcaactgaagtccagaaatgggaaggcattttctcaaagtcactcagaaagtaactggagatagcaggctcccagtcctgggctcagacccacacatccagccaacataaccatggtgcactttaaccaattccaagttgaaacagaggaaatgcatatttggagcaatttatctcatcacattaaagatttcctaatttacatttctgcccggtaatcatggatgcctctgtatctaccccatggtcccctggtgaatatggcctctctcaatgtcaggtccttgtattcctgccctagcttcttgcatccaccttccttgacaggaactgaaaatgaattgcagctgttcatcatctctatggaggggaccaatttcttactcctaaactgagctcatcccagggaaaacacatagggcaatgaggaattcctcttaactatgacactaaactaccccttgtttttttttagtcgtttatattttcagtctacagtctaattatttctccaaattgggttacttgatcacctgccaaagacagtttctattcattaacaaatcttggccttcagaattatattttcaccaatctaattttcattggcattatgcttttctgttttctgactcctcttatcggttgtctacttgtatgcatttttcatgttcaaaagtttcatagcagctcctcctcactttgatgctagggaccaaccaatttatctctacttttatggcttgatattgccagctaatctttattgtgtaattactatagccagaaaaaatgttaagtgttttatatgttagcttaactgattctcactgcaatctatgaagcaggtactgttataatttctattttttagatgaacaactgagacacagtgaagctatgtaacctttctaagattacccaactagtaagtggtggagtcaacatctgagctttggttatctgagcccataaattgcccgttagccctgcgttatactatgatcatgcacaggggtctggaaaatgccttgatgttatactttccttcttcttttttttttttttttttttttttttttttgacagagtctcgcactgtcacctgggctggagtgcagtgacgcgatcttggctcactataacctccgcctcctgggttcacgtgattttcctgcctcagcctcccaagtagctgggattacaggcacctgccaccaaacctggctgattttttttttatttttagtagagacagggtttcactatgttggccagactggtctcgaactcctgacctcgtgatccgcccacctcagcctcccaaagtgctgggattacaggcatgagccaccgtgcccggtctatactttccctcttgaaacaccattcctttctttgttcaggatctactgtggcaagcatttgagctcaggtcatgggtctccaaagccattttacacaatgatacgtgtgatggttttctgggatggcccagctagcaggtgggggagggatcactgaggtaggggacagtgtaattgacaggcttcatagaagctaagcaagggacacatttagttcaagttcagtggcaaggggaaaaaaactaatgattgggagatgcttaggtgttttctagtagtgtacaacaactaaaacttatccccatagacaactcttgggtctgaagatacccagcaatacagagtatgtggtagaccctggagatcctgctgctcaccctgtgttccagattggccccaggtcataggaaggtccctggaagtccacagaaaggattctcaagttctggtagggggaaatttcaaatgtatgcaacccatagaaaatggattctttggggacacctacagaaatcaaagatctaggcagaatttgttcctaggatctaagaattgtagggttaataaaactagctgtttatagaaaatttatgtaacttgttttactgatccaggcagaatggatccagagtttgtgttctggcatacagactaaactttaggagggatataatgactgagttgaatcttgaaatgttagtaggaggtagacaatgcaggaagatggtaaaggttgatgttccaaaaatgaacaacttatttcctggtatcagttaggatgtgtttggttgccactgacagaaaaatctgactagcaatgggtaaaacaactctgagtttattttttcacttattaagaaatctggccctaacaatatcaactaatatcaaagttggtatctgtatttgatttgatttttcatgagcatctcatttggcagtcacagttttggacatttcactcaaatcaggaggaagggggatgagtggcattacctacacgcaatcctctttatcagaaaaggaaaagtttttttcaaaatacccagaaaatttccacttgttcaggctcaaataatgtagccatttctggttgcttttccagattctaaggactgtgtgttaagttaggttagccaactgacagtcttccatcacccctgccatcccggaagatttatgaattcagagttggtgtttgctctttgtttatttcttcttagtagagagcacagtgtcatgcccaaagaagggataacacaaaacattcattgcaagaataaataaattcagttaatctcaaaaggcatttattatgcagtgtgacctgcatgccaggaactgtataggtacagatcaaggaacatagagcccagggactggtgaacagatactcaacatatacatgttccaatatgccatggtacatgttaggacatagaaacacataggggcttttcaagggaacccagagtgggaacacacggcccatgttagagggctgaagaaggaggacaaaaagggagtcagtcaggatagtttcaattatgcttaggtaacaaatgatccctaaaccttaatgtgcagctacaactttcaactccctactgtgctatgtggccatgttgcttagctgtggctctgttccacttcagtctctgcctagggcccaagctgactgagcagcctctatctggaactctgtcagatggaccagagaatatagcaaccacacattggctcttagaagcatcttcctagaagtgacacacatcacttctgcttatgcttccttggccaaaacaagtcttgtgaatctaccagaattgaacaggatgaaggtatataatcctccatgtgaggggcacaggatagaggcacaggataggtgagcagtaatatcatctcctacaaacagcaaggacagggcctaactggcggtgctctctgctccttctggtttacctccccgtctttctcctttcactagtgaccagctgtcaacctcacttagtgtgggagagctgtgagctgggctgagtcgccggggatgagttggaggagccaggagactgacttcatctccacctggtccaggaagggagactgagggaaggggcctggatccagagctggaaagatcttggcaggatgtggctttttaggaggtagaaagatggatttcaccatctgtctctttcctaatgtttggaggggtgttctcccgggatatagaggctggtggcccagatttctgagacatctttgtcagccagcactggctcagcacatatcaattgtgaagatcaactcctggcaagtgtggagtttggcatctacaggggccagtaggggagtgaaccagggatagggacaatgaccagaatccttacttgttgtcagtggaaataaacacgcataaatttgtctttagcacacgaagacccaggataagacccgttcgacctgcctatatggagccttgggtgagagatcatcttagatttttctgccaccttaaggtatttcaaactcccttatcttaaccctgcctgccagctgtgtttgtggaccctgcattcaaatcctcctttaaaatgctatttggaaaataagctttaagatcaactgtttttaagatacaaactcaggcttctgtctgtaggcaccaaaaatcatgccctggacttctagcatcaaggtagttagaatacctgttaagaatacatggaattggccaggcacagtggctcatgcctgtaatcccaccactttgggaggccaaggcgggcagatcacaaggtcaggagtttgagaccagcctggccagtatggtgaaaccccgtctctactaaatacacaaaaattagccgggtgtgatgttgggcacctgtagtcccagctacttgggaggctgaggcaggagaattgcttcaacccgggaagcagaggttgcaatgagctgagattgcgccactgtgctccagcctagaggacagggtgagattccttctcaaaaaaaaaaaaaaaaaaaaaacatgaaatttagttttatttctggctctgaagctttcttggaccatcaggcactcattaacttctctgagtctcatttttcccatctgttgaatggagatgctgatcatagctctcctgcttaccttaaaggactactgggggaattcagtgagagcctttacttactgaacatctactgtaaagtagacattggctttaagacaagtgggaacacattgtcatttataagatttatgtaaagtaaataaaagaaatttttattgttgtagttattctattggagaaaattaaagttgggtatacaatcacggactgtacctgattaattcttgcatctgattcttatgcctctgtcttcagaatatttgtaataatctacaattgtccattttggactgtgaatcttttgaagttgaaattaccttttcttaggttggcagtgtttctcacctggattatggcagtatcctcttatcttgcctctctgccctcagtctcagctgctccaatccattctatgcatagcagacaactataaagatatttcacttctgctgaaaatccttccattgctttatgctcttctgagacatctacttttttagactctctttagagaatctttaaatcctagcctctgatagtttctccaggcatatctctcaacacatctcttcctaccccactaatacagtcatgtgcattcccacagagaagcccaaaatcaatattggagtctctctgaaatacctgaatccttaatgaggtcccagcaccttggacctttgcatagttttggctagaacatctttgttcctgtgacttcccacttaggttcaactccaaaatatctctcagatttcaacttgaaagtcccttcacttcctctggggaatcttgcatgatattccttttttttctttttccttcctagctcattatcaaacctgacatctagtaattgtagttgctattaggcagtgtctgtttcatttttaggtggttactagactttgagctctttgaagacagggattgagtctcactcatattctcttttcttgaattctttcctttcttccataaatagtacgtgattttccactttgggccaggcacagtattcttaacgtgctcatatcttcatgcctaatatggtgcctggtacaaagcaagcaataaacatgaatgatggaatgagtcaaccagtgaatcaaaggtttagttcaaacaagttaagccctccctatggtctaggagcttcgagaggatcaacaccttttctaacttttgctttttaccatattctagttccttttttgtttcaccctctgacagagagaagctgagtgggaacaggctgccacatttttgtaggatatatcatccaactggtgaatcacccaggcccttgatttggcttactatttaacttttttttttttcttttttttttttagatgggctgtcactctgtcaacctaggctagagtgcagtggtgcaactttggcctgctgcagcttcaacctcatgtgctcaagcaatcctgctacctcagcctccagagtatgggactacaggtacagtccagcatggcaggataatttttatatattttgtagagacggggtctgtctttgttttccaggctggtctcgaattactgggttcaagcaatcctccggcctcagcctccaaaagtgctgggattataggcatgaaccaccatgctcggcctatttgaccattttaatgttcttattaacttgctctcctgggtggtaggaagatcatggcatggagtccaaggttctctcacttgcaagtgtcctttgtgcacttcgctgagtgtccttgtcctcatctgtaaaaaggagatggtgatatttagtcttgtgagaaactacttgagagaagtattataagtacctggttacttgatgtagtccttggcaaagggtggattctccaaaattatatcttcctatttctttcattcaacacccactcagccaggataagaccataccagagcaaggagggggactataaataacagcaaaaggacaatatctgcagagaaagtagggagctggaacactgactaaaggaaagttttcatattaccctgtgaattgttggacaaatcattcattgttttttgtttgtctgtttgttttttgagacagagcctcactctgtcatccaggctggagtgtgcagtggcacaacttcggctcactgcaacctctgcctcccaggttcaagtgattctcctgcctcagcctcccaagtagctgggattacaggcatgcgccaccacgctcggctaatttttttttaattttttttttttgagacggagtcttgctctgtcgcccagcctggagtgcagtggtgtgatctcagctcattgcaacctctgcctccctggttgaagcgattttcctgcctcagcctcctgagtaaactgggattacaggcatgttccaccacacccagctaatttttgtatttttagtggagacggggtttcaccatgttggccaggctggtcttgaactcctgacctcaaatgatccacccacctcagctgcccaaagtgctgggattataggcgtgagccactgcgcctggcctggctcattgtttttatatataaaacttacatattttctttcctatgggagtgttgtgattactaaatgagagaatgaatgcgtagtcattcttcaagggattgtcacacagggaagcttcaatatgtttgggtaacagtaatattatatgatccattttcatttctatcaatttggtcagctaaactgtactttaattctgagattctttaactccgacagctggtccagactggcataggtcctgggggcaatgacagagtccagatgtccccatgggcatgacttgcaaattatgtactttgacagaatatggtgaggacaagaaccagaccatgcagcactattttcacgccagctgcagagtctaaatgtgtttcctgacacctcagaaccttcttgggggagggcattctgggctgggtgatgggacatgctgggattttgttgctctccttcccttgtgggtcttaatggaaaagctaagtcaccagcaacagagaaatagcggtgtcaggcattgttgaaactttccatgtattctcatgacacatcatttccagttataaaaaagagtggaggtgttgggctctgttgcctaatcgtggtaagaagtcccttttactagaatgcattttttcatcacagcatcatggtcaatgatcaaccatgtgaacttgtgtaagttgcataaacttttcagtatcttgacgtctctgtgggaaaagatggaggccatatgtgggagaacaaaatcatgattagagacatgggagagaatagggcttcagagtgcagctccacttcagaccagtgcatggcatagtacacattgcctgaactctctgagactcagttttctctcctgctaaatggaagtgatagttggtccattttatggagccgatgtaaggactaaaagttataatgcatataatgtcctttgtctggcacacattaaaggatcaacccacttctgctaccattattattaggaacaaatacttactaagaacctaccatattcaatatcacctgagtgcattttcatattcaattctcacaatgacacaaggagatattatcctaatgttgactgtgaaaaaaattagacctggagggttcaagtcacttgcccagattcacatgggtgtgagtggcagagttggaacttaaaccaagaatttttgataccaaaacctattgatgatctttccactgaaagatactgactagatgtcaccttgctttccctgtcaaatgctaatcagagatcaatgactaatcaaatggaactaattaattctgagtcaacaaatatttatagagcccctggtatttgccgagtgccatggagatgagagctaccatggacaaaaggatggtcacccaatcctcggtggtacaggacttctgtaaatgccccaggaggtcttccctttttcccaggttgatgccttctgaatcacttctgtccattcactgctttgtcagcagcagtttacttgactgttaccttgggtaattccttgagcttatttatttactatttttgagatggagtctgactctgttgcccaggctggggtgcaatggtgcaatcttggttcactgcaacctccacctcccgggttcaagcgattcttctgcctcagcctcctgagtatctgggattacaggcatttgccaccatgcccagctaatttttgtatttttagtagagatgaggtttcaccatgttggccaggctggtctcaaattcctgacctcaagtgatccacccacctcagccttccaaagtggtggcattacagatgtgaaccaccatgcctggcctccttgagcttcttgagagcaggcactggatctttcttctttgctactttctctgcaacacactgcctggtacatactaaatgccaaaatcttattgacaggcttgcagcgaggaatgagcatctaccttgctggttagattgcttttatccagagtggtgatccctggggagatgttttgcacttggcctcgtggcagatgggtaacaagtgctggatcccagaggaatgatgcattcaacaagtcctgagttttatctatagtgccatgcagtgagttcctcctgctcctactgccatgggccttgggatgcaccttgagcactgaccccaccttgtcatgcttcctatgtgataagtttccttctgcagccagatagctctttgactcaatattacatcagtattataaactgagtaattgtgttttccttcctccaatcaacatgttgaagtcctccttcccaatgtgatggtattaggaggtggggcctttgaaaggtaattaggattaaatgaggtaatcagggtgaaacccttatgaatagaattagtgtccttataagagtcatgagaaagcttgttttcacttctgccatgtgaggacacagagagaagatgatcctctgtgaaccaggaagagagggccttcatgaaattctagatcttggagtttttgatcttagacttctctgaccccagactataagaaataagtattttttgtttaagccaccagtttatggtatttttgttatagcagcccaaatggactaagacactcagaaaccttcctgtggcctcctggaagacctttactatcctgcaatttctccagggctgtcagaaatttagacttcagtgtggttccagaactagtgtgcagaaatataaggcaaagctcataaccatcctccagtgttcaggctcagcataagccctctaggaaacctttgtacctttctttgggcctcccccaccatagccctcatcatgctatgattaattgctcaattatctttctctctacattgtcggttatttttagctttaattagtttgccagataaatgtatcagctacaagcccttagaggacttagaagtctggaaactttggagaaactgtttataggactggcagtttctgatggagaacataggaagtagaaagaaaatatctgggtagtctttggatattccccagtgagggtctctgagactgatatgattgagcagctttatgaataagacccaagaggaaaggctggagaaaatgagtaaaacaaagggaaattttacgtacgtttttttgcccatgagctagtcatgaaagggagaatcaaatgtgatctcatcaaagatgttcccccttgagatcataactatatatatatatatatatattttttgagacagcctctctgtcacccaggttggagtgcagtggcatgatgtcggctccctgcaacctttgcctcctgggttcaagcgattcttgtgctttagcactgagtagctgggattacaggtatgagccaccacacccagcccataatcatatattcttaagtgggtgtgtgtgcataggtatgtgtgcatgtgttttgcttttcaacctaaaagcgatcatacaatatgtcaacagccttgtgtgttaagcacaacagagttcctctcattcgtaaatgaagagtctgaggcttgagacttggtttgcccaagtccagtagcattaatacaggcagccaggtcttcagatagctgcccaattcccttttcgcatctcaaatatgtgaggtcttcagacaccttggagataatatttgctctcacctctttcctcaaagaattaaatgtgacttgccatcttgagttttgttacaaaagattgtaatgctattcaatagtggtatcatatgttatttaccatggaaaaagatggcaaaaactccccctgaggaactgcactaaaagtaaaagatcaagaccaagggaagagaaaatacaaatattcgaaccctatgtatctaacatgattaatatatccgagatacatatgcggctctggttaccagaagccaaagaagaaaagggaagaagattcatttatttgtccttaggaaaatagcagttccccagtcaaagaaatattttgcaagcacttagatctcagagaggtcatttaaaaggcctttagcatttattcaacaaatacttatttactagctactatgtaccaggcaccatgctaagatatgaatatacataatgaagaaacaatgtccttgtttctgtgaagccaagtctagtgagggagaaagatgttaaaattatactcttctatatattatgatatggtcagtgatatcttttggctctgcgtccccacccaaatcccaccttgaattgaaataatccccacatgtcaagggcaaggccagctggaagcaattggatcttggggcagtttcccttatgctgttcttgtgataatgagtgagtgtcacaagatctgatggtttcataagtgtctggcatttcccctgcttgcactcattttctttcctgctggcctgtgaagcagtgccttccaccataattgtaagtttcctgagacctccccagacatgtggaactgtgagtcaattaaacctcttttctttataaattacccagtctccagtatttcttcatagcactgtgagaacagactaatacagtcagtaatggaaaagagtaagatgatgggagagaatttgaaaggatttggtttagctagaagatagctcttgttaaagtgatactatagctgagattgaaagctaactaggttttaaaaatttggagcattaagaagaatagtgttcagcaagaacagcagatgtgaaggtcccaagtcaagtacaagactgatgtattccagaaacttttaaggacagtgtgttagtgtgaatttcagaggccaaggaggagaatagtctgggatgagccctgagagtagcaggagcccagtccccttccctgcagagctttgctaatgttggtgagatgtggtctggagagagacattaaaactactgaaggatttcaagagagaaagtggctgtcagatttgcatttaagactattgctctggctattggaaatgatagcaagaaaagtgggtgaaaacaagagtgcaagtctggaaactagaaggaggttatggaagaggcacctttgccagagattagggtgatctggaaatacgatagaaaatagacattctaggacgggcacagtggctcacgcctgtaatcccagcactttgggagaccgaggtgggtggatcacgaggtcaggagatcgagatcatcctggctaacacggtgaaaccccgtctctactaaaaataccaaaattagccgggcgtggtggcgggcgcctgtagtcccagccacttgggaggctgaggcaggagaatggcaggtgaacccaggaggcagagcttgcagtgagccgagatcgcaccactgcattccagcctgggtgcagagcaagactccatctctaaaaaaaaaaaaaaagaaaaaagaaaagaaaatagacattctagagttaaaaactcaacaagcttgatgcaaccatcttgtttcaggggaaggcaattactgcacagagaataatcatggacaatgcccctcaaacctccacatccccaaaatcaggacatatagaaggttggagcaaaaatataaccttggctaaaataattaatagtgttcttcttgattcaatttgcaggagacattcagagaaaatatccacactcaaaactgaaatatgagtgccacacagtcattgcagctcacatctgggaattttcaccaagcaactgaaaaaaaggctattttcagttctttcatatgctctttttgtcataagttgggttcggggggtggggttcagaaccacagttgctgtggtgagagaagcaaatttgacagcttctggcagagcaaagcacaagtatttcctgcagagtttttcaaagtaaatgggtctccctccctgggcagatactggcaatccttgatgactcacttctgaggggcttagcccatcaaggattcaaagagagggagaggcctggcaccaggcccagtgctggtgacaaagtggcttcttgcctgcttttttgtagttgctccagtgggcacatctgtgcccggaatttgtcatgagacaatgagggtttgttccctgtatccgaaatgatgacttcatgattcttttatggcagagtaagagttggagcagaggagatagaggattaatggagttaaaggagcatattacaaagattgagtttcatattggttaagatctggaatgctttctatctggcaaactgtaaaatccaaagcattaattacattgacaataaggacccaagtgtcctcccatttagctgttttcaaaaggtattatgagtatccaagctgtcagggtgatgtgtgtagactttttttcctttcctgtgtcaaaagcatgatgttgagcagtggcttttaacatttttgacaataacccatagtcagaagtaccttttttttttattgtgactctcaacacacacatgtagtggaaaaagtttaataaaaaataccactgcaataagtaacacacacagtttctatgatattttacttattaaattatttcctgtgtaaaaatgtgcctgtgacccagtagattgttttcatgactctctaacaggttgtgacctgcaattggaagacatagatattgaggaaagaacacaggtcttggctgttgaggctcatgacctacctccccagctgtaggagatttttctgtgctttagtatatgagtaagcatgagagaggtgatgcttcagtaatacacactcccaacatttcagtggcttaaaacaacaaaagtttatttcacactcatgctataatggaggcttgactccatatgatgcagagatccaggctgcaggagccttcacatcaaccctactttctcctcatctgctgcaagagcaattttacttctagctctgactcttttttttttttttgctgtatggagctgggcaagtcatagaaccagggctgactttatgtgcatgtgacttaggcagttgtatagggcctggtgctcagaagggccttgtggcttggcttactactctgctgtcactgccttgaaagtcttaataattttttaacaagaaggctctttttgcaccaggccacacaaattatgtaggtcatttgcatacaatcttttctaagtctccatttcctcatctgtaaaatgggttaatagagaagaactcatagcattcttaagaggactaaaagaaagagcatagtacatacacatgtagttttcaacttgctgcctttatcttcagtagtaccgctacagaaaacttttacttaatcaagttagacttctcaccttgaaaagctgtacttccttatgttgccctccctactcccttctgtttatctaaattttgttcattattcagggctctactctaacacctcctcagggtcctcttccatgactgtccaagctgttttcagaacccctaccccattaattgtggatcccttctttatgactcacttacttttgtttcctcttctcctttggacccttccttggttaggatccctcctacctcgcctggaacattaaacagcctccccattagtaacccttttagtagcccctctccagtttgccctccagttccactctccatcataccagggtcatcttcctgttaccccgaaatgtcttttctatcatgccatttcagttttcagagacttcagtggctcttctcacctaaagggcactgcccttagtcttgcatttaggatctggctctcaggccacattttgggtctcattttcctccactccactcacacactgctcctgcattcctgctctacaccatctctggaatagagcttattctcctgcctttggttctttgtacattctcttccttctactaagatggcctgccaccataggcgtggtggctcatgtctgtaatccaatcactttgggaggctgaggcaggtggatcacctgaggtcaggagttcgagaccagcctggccaatatggcgaaaccctgtctctactaaaaacacaaaaattagctcggtgtggtggctcgcgcctatagttccagctactcaggaggctgaggcaggagaatcacttggacctgggaggtggaggttgccgtgagccgagattatgccactgcactccagcccgggcaacagagggagactccatctcaaatataaataaataaataaaatggcctgccccaagatttaccccacacccctgaaataatccaatctaccttttactgcttggctgaaatcctatctcctcaaagacctcctgtgccagctcaggatgaaaagtctcccttattccttggaatccctatggcatttcttagaatctgacatatatcctgtatgtgtggggcaattcccccaacatcttggttgccttttctgctgggtctgtgttccagggaataaggacaaaaacaaaatatggctagagtttcagtcacacttcgtaggaactccctggaatgaagggttcctgcagagattgcctggggcccttcccgatcccctcagctgttctgaatcatcatcctcctctgggttctccaggaattttgtacattcttctaacatagcactgactactttccatttgagttatttcttgacatgactggatcccccacgaggcatatcttattcattattgcagttctaacagggactggtgtcaacagtgaatggatggattgattgaaggatagagactagagaggaaggaaagttgctggggaggagattccctgtatatgtaagtgtgagacaaggtgggctgtaataacaacctcttactggcacaaagcaacaaatatgtatttctcattcatattcatgtccactgtgagttggccaaaattctactccactgcctttttttttttttttttttggagacagggtttgttcttttttatagcctggagcatagtgacatgatcacagctcactgcagccttgagctcccatactcaaacaatccacctcagcctcccaagtagttgggaccacaggcctgtaccaccatgcctggctacattttaagattgttttgtggagacagggtctctcactatgttgcttaggctggtctagaactcctgggctcaagtgatcctctcgcctcagcctcccaaagtattgggattacaggtgtgagccactgcgcctgtattccctcttcatcctacaaccaagcctgatggagaatccctaatctggggcatgccattcagtggcagaaggaaaggaaagatggcagagacacacaatggctctcagagcatctgtgaagaaatggctcatgtcatttcaactgacatcttgttgaccaaagcaagtcttgtggccacaggaaggataacactctcaaagggatgagcacaggagaaagaggcagtgagtattttgacaaggacacaatcttctacagtgggggcagagcttcatgtggaattccactcacataatgctctttgtctgtctgcatacccacactcgttctgaccagggaagaaggagggggccatctacttggtgattccaggagctggatgtgcagggcgttgcatctgtctctcctcttgctattgagcataagctgcctctagcgggcatgctttctaccttgccctctcagggattgagggatagactctctggatatatggttgtctacaacttggtaggtaggtctgtctaatcctggagctccatttattcatccgcagagccatatcctccaatttgagatctacaagtaacaacggtggttttgattcccgccattgcctttactcctctgccttaattttcaattggtttcaagcttggaaaagaaagagagttcaattttttgatctctctctcatatctccataacagactttgcagaaatatcaggtcaggtcctgttactgatgtgttcattctcatgggcaggaagagacacttcagtgttgctgctgccaggattgtttcacttaaaggaactctctagctgtcagagaaagagtgatactctgaaaatagtctctaacatgctgcttcctgctctaggatcatcttatagaaaagacactatgttcatcctgagccaacctggtccctttatagtcagatactagagaacaatgagaaatggacatgggggatatctttagcgaacatccttagtgaggatctgtctcttcttttcctgttgggcatgagctgcttctagagagcatgctttctacattgccacccaccccaccccaccctgagggatccaggaatagactctccaaatccagggatgtgtacaacttggtaggtaggttgggtagggagagtgttttgcacaagctagagctggggttcatatgtgtctggcaagtggagttaatggtactgttttctatcaagtgtccagttgcataagttgttatacaaagacggtgctttagcttttaactggaggaagagggggacatactgacatgtgggacagagggtagagaaggaagaggtaaaattgagagggaataacgtgattaatttccactcagcctggcccgatgagagactgtgagggtgctatctaaagcttaaggaatcatgtttatgaaaaaactgtaagattttgggaagcagcagcgctctttggagattggcaacaaatatgacaatttactcaaaagatttttatttctggtggttctagactgagtgacagcattggacaaagatgtgtggagcaggatggtagctggaggagtgccagagagagacccgggatctcaccaaggttacagtgtctgtggctttgcgaagattcctcctaaaattctgctcatggaaggatttcaaagaaagactgagtgaacttgttcctgagaatgcttgaagggacggggaaacattaaaaaataaagactgggttattggaaattgatggtggtgttggtgggggttgttaagaactaccgttatttacacactgatgaacttgtgacctcatctatattcacaggctgctggtctctgagctattgagtccacctacttatagggatgttctttatattggggtgaatgttttgcttgtgatatatcactctgtattagtttcctattgctgatttaacaaattagcacaaacttagtgacctcaaacacacacacacatacacacaaactcacacacacatttattatcttacaattctggcagtcagaagtcctaagtcagcctcacgggctaaaattaaggtgtcagcaagctatgttccttttggaggctctagaggagagtttttttgcttgtttgtttgtttgtttgttttacgttttctagattctgtgactgcctgctgtccttggctcatggccttttcctcattatcaaagacgacagtacagtatctttcagcctttctcctaactctgatcctcttgactccatttcataaaagccatttatctcaatatcttcatctcaatatccttaacttaatcacatctgcaaaggtttttttttttttttttttttttttttttttttaacatataaggtaacgtctcccggggagcattattcagcctgctatattctccaaatagttttcattggctttggtttcatcttatcaagaggagatcaattcaacctttactttgtacccattgagtgccttttgtctgctagaaatttttcaggctttatttcaatcaacccccactgtgattctgcgaagtaggtatttatgtgcattctatgaatgaggaaacagggttgcatgcaaattgatctggcttaaaaactcactctttctttacaactttaaatatttcatctccagaactactatattgtcatgattgaaatgactggatgagaaatactcagaaatttcaagtccctgctcccctggtggctacagaagtacagttgagaggcctttcagtatttcttaatagacagccaccttccctctgcctggagtagatgagattcctgactcctgtctttcttctgagactctgcccaggataccctagttttgcggaactgacacacccaaatgtcctgaatgagtcataaactcttcccgaagctaacatgtgatgaggagggaaggctctttctgccacagcctgtgaaatggtttccattacagtgtttctgctgagagcagcaattctgtctttatcctctttcccatgactacagagcctccaacatctgactgagttgacagaagagtgagggggacactggaaaaagtcccaggctggaggccaggggacctggaggccgatattgtcattgcctctgactagtcctatgctcttgagcaagctgctccagtgtctgagtctctggtctcatttggactaaaagtcttggtccttctttgtgcttacaatttaaaggatccctgcatagccaaacggtaccattcttaatggcatgaacaatatcagaaagactttagataacattcatttggagataactttgccatgtgcttcactccctctcaaccggcaatatggcagagtggttaagagtgtagaatctgcattaaaattccagttctgccttttttgactggtttatcttgggcaagccgcttagcccctgtgtcttatattcttcatctatccaatggggataatgataaagatgatgttctcccccgagggttttgatgactgctagttagaccagcactgaccactgttcagtccaatgaaagtacttgtctcatgccctgctattcattcttcctcaatctcccgtagagaaagagacttcagctttaaactcagagtctttataataggccatcagctgtgtgaccttaggcaactcaattcaactctctgatcttcaggatttttcaactttaaaataaggataacaataagagcaacttcatggtgaagggggataaggattaataaaacaacacatgtaatatttctaggagaatgcctggcatatggaaaatgtttgctccctttagatgttatcctcgtcttgtgtgaatcttaaaatttctagcctgcttcagatttaattccattttctttctaagatgtgagaaaacataatttgatatttcaggccaagttaagcttttttattgagctcacacagttgtaaatatgtacattaaagtatgtcctcatgaagaacaaagggcatggatttttccagcaccctccatcccccaactcacagcctcaacatccgcaaataattaatgcatagaggaagtttacggttggccacccaaatgcatctcaaacattaaatttaaaaaactaaaaggatgaacccagaaaactgctataaacttcaaagaatctattaaggacttagacatatggtgttaaaagatatgtccaagatttatggcactgggcctacaaaaaagaattctggataggcttctgctatgtgaaatatcaggaaagggtcagcagaggtgagctctgtgtccccaactgcctggagtgacctcacgagcagaatcagatagcagtggacttagctcagttcttggctcctccagatgcaagccaaacttcaatgcttagggcagcgagaatgtactggacagagagccgctaaagataggagaagatagatcagatatgttttgcatttaggtcctttcttttttttttctacctggaacacaggcagtgataattatggccactaaccatattgagcaattgagcaattgcaatgtgttagatggttttacattgaatttaatttatacctcataacaaactgtaaagaatgtactaccgttttcttcttctagaggggaagaaactgaggctcaacaagtttaagaaagtttctgggagacatatagcacacaaacataaaaccagaatttgaatacacatctatttcatgatggactacttttgtggaactgttaaaggaaacaagtaatggccgaaatgaatggtttagtcattgatctgcttgaaggctgagcagcagatcaaatggcctcttggacacccaagattttgggagtctaagactctgcctttctgaattgcataccttatatgtctacatgagtccttccaaataagctgctcagcacccctggtccatagatcctttgtaattattgcctcctctcaaaagcacaacattgattttatccacctggaagttactgtctgcctgcttttagatagagagcaaatctcctctttgaacaaattcatacaaaactctcactatagtcgggacccaggatatgttttaaaattgattagaagtgttccttgagcttttatttcccttctgtttgtggaggaaggaacagaaatatttccaacttaccttatacaataatgactgttacaggtatgacctcagacccagagtttggggatggaattttctgcctttgatcttggtttgtactgtctctaagatgtgacatctcttctacactgttgccacccagcatccatctgtcatattccaaactgccaatgtgtgtcacccaaaacattagatgacctagttgttctccctgcctagagccttgcctcctctaattcacttcatttaaaaagaaagacatttatcttataaaagaatacaagcatacggaaaagtacctaataatatagtaaataactgtattgcctactgttagcaacttttaaattacatatagatgcatcaataaaggcaatatatagtattgttgtaaacacatttaaacctggtttaaattttatcacattacacaaaccattaagtgagtttctttttaaaaactcaacatcatgttttaagaattagctctgttaatatatgtagatagtttattcatttttaactgctctatggagtacctttgtgtgaatattccacaattgaattaatccactctcttactggtatgcattatttgttgttataaacaacactgcaataagcatccttgtacacatttctttgtgcatatttgcacaagtaactgtggagtacatacctagatatagaatttccagacacataatattgtcatatttatatttactaaagaatatcaaatttactttctcaacagcgttgaatgagtttccattgccctacattcttaccaataattggtattgtcagatatttgacaatcttatgggtttgacaaagggtttcgtttcctaactttgtgtttgttagtgaggaaaattaattcacatttatttattagattttaattcaaatttattagtgagaataattatcttttgtatgcatattggctactgggattttctctctcgtgatttgcctgtttgtgtcattgtgattttttttgtcttgaatttttaatatttaatctgttgatttgtagaaatttttatccctgcatggtatgtgtactaattttgacacaaaacttgcaaataacttcttcaagtctgtggtttattgtttacatctttttggagatatatttatcatttacaagatttttagctttaccatagtcaaatttataaaattttgaatgtttttatggtttgagctttgatgtctgactcaataaatccttgcttctgacagtcaagaagttatttttcatttatttatcatttatttcatctatttatcattttataagttttaaagttttactttttgtattgtgatcctcagtgtatctggaatttattttgatctaaggcagtcttctaattttgttttgtttccatatggaaacccaattgcctttgtaccaattattgaatagtctaacatttctctatttttttatagcagcatctctgataatgccaattttttcattcatgtccctgtgaagagaccaccaaacaggctttgtgtgagcaataaagctgtttatttcacctgggtgcaggtggcctgagtctgaaaagagagtcagtgaagggaaataagggtggggccgttttataggatttgggtagataaaggaaaattacagtcaaaggggggttgttctctggtgggcagagtgggggtcacaaggtgctcagtaggggagcttttgagccaggatgagccaggagaaggaatttcacaagacaatgtcatcagttaaggcaggaacaggccattttcacttcttttgtggtagaatgtcatcagttaaggcaggaaccagccatctggatgtgtacatgaaggtcacaggggatatgatggcttagcttgggctcagaggcctgacattcctgtcttcttatattaataagacaaataaaatgaaatagtggtaaagtgttgagatggtgaaaatttttgggggtggtatggagagataatgggcgatgtttctcagggctgcttcgagcgggattaggggcggcgcgggaacctagagtgggagagattcagctgaaggaagattttgtggtaaggggtgatattgtggggttgttagaagaaacatttgtcctgtagaattattggtgatggcctggatatggttttgtatgaattgaaaaactaaatggaataagagaaggagaaaaacaggtataaaaggtctaagaattgggaggacctaggacatctgattagagagtgcttaaggagattcagcatagtcctgccagcaaagattatttatttacttcaagagtttagagtggcagtttggggatagcactaggagatatcagctgtgatggcttggagaaacagtgtaaactggcagtgtaaacaagagcagggcatgtatgagtagttgagaacagtgaataggaatgactagacagaagatagtagggatgacaagttttttggggcacagtccaagttggtctggtgtctggaatgagactggggcctaataaaaatgagcgtctatacaggagcttaaatgggatgtaccttgtagcattctgaggacaggcctgaattctgagaagggaaagtggtaaaagtattatctagtcctttttaagttggtggctgagcttggtgaggtgtgttttaaaagactattagtccgttctacttttcctgaagactgaggactgtaagggatataaaggtttcactggatattaagagcctgaaaaaatgcttggctgatttgactaacaaaggccagtcttctatcggactgtgtagaagtgggaaggccaaactgaggaattatgtctgacagcagggaagaaatgaccgtggtggccttcttacaccttgtgggaaaggcctctacctatctagtgaaagtgtgtacctagaccaagaggtattttagtttcctgactcagggcatgttgagtaaagtcaatttgctagtcctgggcaggggcaaacccttgagtttgatgtgtagggaagggagggggcctgaataatccttgagaagtagtagaatagcagatggagcactgagaagttatttctttgaggatagatttccacgatggaaaggaaatcagaggttctaagaggcgggctagtggcttgtactatagcatagcctgcctttgctggtgtgtggtgattaggcctggtggaactgccatcaataaactaagtgtgatcagggtgaggcacaggaaagaaggaaatatggggaaatggggtgaatgtcaggtggatcagagggatacagtcatgggggtcaggtgtggtatcaggtataatgtgggaggccagattgaagtccgggccaggaacaatgataattgtgggacttaacaaagagtgagtacagctgaaggatccggggagcagaaagtatatgcatcagctatgaggaagaaaatagattttggaagttatgagaaatgtagagagtgagttgagcatagtttgtgattttgagggcctctaaaagtattagggcagcagcagccgctgcacggagacatgatggctaggctaaaacagtaaggtcaagttgtttggacagaaaggctacagggtgcggtcctggctcttgtgtaagaattctgaccgcactaaccatgcctaggaaggaaaggagttgttgttttataagggattgaggtttgggagattaattggcacaatcagcagggagagcacgtgtgtttttatgagaattatgccgagataggtaacagatgaggatgaaatttgggcttgactgaagtaatgggggctgtctgtgaagccttgtggcagtacagcccaggtaatttgctgagcctaatgggtgtcagggtcagcctaagtgaaagcaaagagaggctgggatgaagggtgcaaaggaatagtaaagaaagcatgtttgagatctagaacagaataatgggttgtagagggaggtattgaggataagagagtatatgggtttggcaccatggggtggataggcaaaacaatttggttgataaggcacagattctgaactaacctgtaagccttgtctggttttaggacaggtaaaatgggggaatggcaagaagagtttataggctttaaaaggccatgctgtaacaggtaagtgataacaggctttaatcttttcaaagcatgctgtgggatgggatattgggattgagcggggtaagagtgattaggttttaatgggatggtaaggggtgcatgatcggtcactaaggagggagtagaggtgtcttatacttgtgggttaaggtggggagatataaggggaggatgtgaaggaggctttgaactgggagaaaaggcagcaatgaggtgtggctgtagcctaggaatagtcagggaagcagataatttagttaaagtgtctcggcctaataagggaactgggcaggtggggataactaaaaaggagtgcttaaaagagtattgtctaagttggcactagatttggggagttttaagaggtttagaagcctggctgtcaatacgcacaacagttatggaagcaagggaaacaggcctttgaaaataaggtaatgtggagtgagtagcttccgtattgattaagaaggggacggacttaccttctactgtgagagttacttagagcatctgtgatggtcctgtaggcttctgaggcgatcaggcagtgtcagtcttcagctgctaagctgagaagatctgggaaggagtcagtcagagagccttgggccacagttccaggggctctggaagtggctgccaggtgagttgaacagtctaattttcagtggggtcctgcacagatgggacatggcttaggaggaatcttgggctgtgggccttccttggcctagtggctagatttccggcacttgtagcaagctcctgggggaggaggttctggaggaacccctggcagctgtggttcaggtatttggagttcttgttgtgctggagatgtggctggggtttgtctcaccgtggaggcaaataattgcaacttagaaatacgttgctacttggctgcctctactctattattgtacaccttgaaggtgaggttaattaagtcctgttgtggggtttgagggccagaatttaatttttggagttttatttaatgtcgggagcagattgggtaataaaatgtatattgagaataagacggccttttgaccttttagggtctagggctgtaaagcgtctcagggttgctgccgaataagccatgaactgggctgggtttttcatatttgatgaaacagcctaaatgctcactgatttgggagaggtctgataaagaaaaaggagcattaactttgactatgcctttagctttagccacctttttaagaggaaattgctgggcaggtaggggagggctactcacggaattaaactgtaaactggaccgggtgtgaggagaggaggtgataaaaagattacagggtggaggactggaggctggggaagaattgggacctagcttggcctggcgaggagcagcctggggaggaggggagaggtcagatgggtctgtagaaaaggaagattagaaagactcagcgacgcttggggttgggacagaggggacaggcgggagggaaagaaggaagatttgggatgagttgcactgggcacagagactaggaagggactgatgtgtaaaagaatgcctggacgtcaggcacctcagaccgtttgcctattttaccacaagaattctttagatcttgcaggatggaaaaattgaaagtgccgttttctggctatttggaactactgtgagtttgtattggggtcaagcagcattgcagaagaaaataagacgcttagattttaggtcaggtgagagctgaataggttttaagttcttaagaacacaggctaagggagaaggaggaggaatggagggtggaagtttgcctatagtgaaggaggcaagcctagaaaaaagagagagtagagacacagagggaaggggtttgggagttcttaccttccagaaaagcagaaaaggggtcaaggcacagaaataaggggttggggcacggagataagaggtcggggtgtggaaataagggatgggggcacagagataagaggtcggggtacttgcccctcctttagaaaagcgggacttgccgctaagggtgaaagagaaggggttgaggggttcttgcctctccttcagaaaagcagagaaggggtagagacacggagagaaggggttggggtacttgcccctccccaagaaaagcaggacttgctgctaagggtgaaggaccaaggcaggcatccttgcatggtatgacacctctgaaacatgagtgaataatcagaggtgtccctgcaatgattaaacaccaagggaaggctgccttcccagtctgtgacaggcgctggagttttgggtccacggataaaatgtctcctttgtctctaccagaaaatgaaaggaattgaaattaagagaagggagaggttgaagtgtggcgccaagattgaaaggagaacgaggttgagggatagtgagggaggttgaagaagagagtaaaaataggctgcttactggatttgaaattggtgagatgtttcttgggctggtcggtctgaggacctgaggtcataggtggacctttctcatggagcaaagagcaggaggacaggggattgatctcccaagggaggtaccctgatccgagtcatggcaccaaatttcacttgcatccatggaagagaccaccaaacaggctttgtgtgagcaataaagctgtttatttcacctgggtgcagctgggctgagtccgaaaagagggtcagccaagggagataagggtggggacgttttataggatttgggtaaataaaggaaaattacagtcaaagcggggttgttctctggtggccagagtgggggtcacaagatactcagtaggggagctttccagccaggatgagccaggagaaggaatttcacaagacaatgtcatcagttaaggcaggaacaggccattttcacttcttttgtggtggaatgtcatcatttaaggcaggaaccaaccatctggatgtgtacatgaaagtcacagtggatatgatggcttagcttgggctcagaggcctgacaaattttccatggatttgtttcaaggtgcttgactgtattgtattgatctgtttgtctcttctttatataaataacattgtgttacatacagtgttagaataacgcttgtatgtggtcttgtatgctttattcccttccttcaaagctttatttctttattctttcttatgaagagtataaatactggctggtccattttaatgaaaaccttattataattaactaaaattgcaacaaatatgtagattattttggtggcagaacaggaacctctttaataataagtcttctgttccataaatgtttattcaggctttcttctatgtctttaaagagattcttaaaattttcttctaaaagtttatttatttttttgctagaattattcataggagcctgaagtttttcttgctattgtaaaagtatcttcaatttccattacactttataattggtatggctgaattctagaatgaaaataaatttgcgttgatctaataacttgctgaattctgttatcttttgtaatattttatccgtatttttttaagagtttctaatcatattgtttgcaagtgaatgtcattgtatctctttttatctatttaaaaaatattgtgtttatttttcttattgcattggccagggcttatgtacaattttgaatggtaggagtgatagcgggcatttttggctttttccagattttcaagggaatgtttctaatgttccatcattatagaggccacatagcacactggttaaaaatgcaagatcaaggaggtttgaatttaggctctgtcagttaaaagttgtgtgatttgggccagataacttaacccctctgtgttcgtgtttttccattagtgaaatgaaaataaacaaaagcaacaacaacaataatatttatatcagaagaatgttgtgaggattaaacatatatgtgtgtatatatacacatacatatattaatatatgtatgtatgtatgcatatatatttgtgtacttagaacagtgcctagtacaaatttaatgctcaataagtatttaataatgataaaaagtgatatttactgaatactttttataaagattccttatatgtttgaggaaatttcttcatattcctacttttcctaaagttgtctttatagttgagagttaaattgtatcaaatgcttcttcttcacctaataagataaatgatatgcttttttgttagtgttctaaaatggtggttaattttaacagattttctgccactgaactatatttgcattcttgggctatcattcattgttactgttgatgttattggtacactatatatttgaaattattattttgctttccatttataagtgagattgggcttttttttatttttgtactgcctttttacattttgaacaagaaaaggattgtttgttctttggtgattagtaaaatgtgactgtatgaatttatctgggtattgtttctttttggtatgaaaactgcttatcaattaaaattatctgatatctaattttgtgtaggatttttgtttgtattgatgtcaatattgattgtttctatggtttccataaagtattttatttatgctacattttcaagtttgcatatttggaaaagctatgaaatctacaaattgaaaaatctacaaaaaatagcatgaaagttggtttaatttataatgatttaaaaaattctctactatagccctaattgtggtcccactttgttactatagtttaatttgtgatctctttttttttttgtttttgtttaataatctcttttgcttctttgttttcttgtacattaatatcagttgtttacctgtttctgtcagaggcatttgaaccagaacgactccatcttgagtaggggctggtaaaataaggctgagatctgctgagctgcattcccagtaaattaggcattcaaagtcacaggatgtgttaggaagtctgcacaagatactggtcataaagactttgctggtaaaacagtttgcagtaaagaagccggccaaaattaccaaaaccaagatggtgagagtgacctctggttgttgttatggctcattgtaagctaattgtaatgcactagcatggtagaaggcactctcaggagcagcatgacagttttcaaatgccatggcaatgtcaggaagctaccctataaggtctgaaaagggaaggagccctcagctcctagaattccccagctctttccaggaaaactcatgaataataacccttgttaagcatataatcaagaaataaccataaaaatgggcaaccagtggctgatgccactgctctgcctgtggagtaaccattcttttatttctttactttctcaatacatttgctttcactttatggacttaccttgaattctttcttgagcaagatccaggaaccctctttcggggtctggatcgggatccctttccagtaacatttcccattcttttaatttttattgttttattacctttactttcttgagttgaatgctgaacttattttcaatcttgcttttttttaaaaaaaaaactaataaatgttttttaaggaatacattttctcctgttgacaaaaagcatcaaactccgtaaaatatttgaagagatttattctgaaccaaatatgtgtgaccaatggccagtgatatagccctcaggagatcctgagaacatgtgcccaaaatgatgggctacagcttggttttatacattttagggtgacaggagacatcaattaatacatgtgaggtgtacgctggtttggtccagaaaggtccagacaaccggaagtggaggcttccaagtcctaggcagattcaaagatattctgattggcaattgactgaaagggttattatcaataggaaggaaagtctgtgttgtggtaataaggggttgtggagaccaaggttttatcagacagatgaagcctccaggtagcagccttcagagagaatagattgtaaatgttgcttgtcagacttaaagagtctgctctatcagtaattccaaaagggaggagggtataatgaggcgtgtctggctcccctttcccattatgaattgaaactagtttttcaggctaactttagaatgtccttggcccagaagggtccatttagatggttggggaggtggggtgggccttagaattgtaaaccaaaaataaaattctaaggcccctcccaaccaactaaatggacttcctttttagtcagggttcttaaaatttaacctgaaagactggtttaggccatgaaaggaagtgggggtcagacatgcctcattaatacctctctggcattaacaacaacacagacttcaagtctgataagaaacattttacagcctgttctctctgaagcctgctagctaaaagcttcatctgcatgataaaattttggtctccacaacctcttattgcaacccaaacatttctttctattaatcccaggtcttaagacaaactcaaccaattgtcaactgtcagccagaaaatgtttaaatttacctatagcttggaacctacccccctccccaacagccccctgctttgagttaaccaaaccaaatatttcttaaatgtgcttgattgatgtctcatgactccctaaaatgtataaaaccaagctgcaccccaaccaccttgggcacatgttgtcaggacttcctgaggctgtgtcacaggtgtgcattgcatccttaaccttggcaaaataaactttctaaataaactgggacctgtcttacatgttctgggtctagagatttttatttttggtttacactgggtctacagaattttatttttagtttacacttctaataaactttagaagtttttttggcaactcagaacttttgatatttaggagtttacttttacttttccaaatatatattttaaaatctatatcttttattgttgattttgcatttaactgtttgtagttcagaaggacgttggcataatttcctattgtaacgagtggcaataaaagcaacataaaggaattatgttctctaaatatatcatgtgatgtataataaatagtatattaaaaacccataattaaatccaatttctctggtcttctcatgtcacattagtcacgtttacaaaggcaaaatcttaaagtattagcatttgcttgccctttggtgttcttaaacagcagagcccccaaacaaaagcctatccagtgaagactcttattttgctaaacatccaagcacttcattttctgagtgagagatgatttatccgctccacaacatcagtcatttgaacctcagtgcacagtgtgtgaaccagtggcacttttaaagaataactttgaagaataacacacatgcaaaaaagtgcacagatatgtctatagctcaaagaattttctggaagtaagcacactatgtggcctgcttacaaatgaagaaacagaatataaacagccctctcatgcttcttccagtgataactccaccatcacctggggtaacctctaccttgagttatagcaacacatatgcactcttcctgttattgaactagatgctcttttgtgtctgtcttctttggctcatcattatgtttatggaattcaccaatattattgcattgttatgtagtattgccttgtaagaatataccacaatttatccattctccctttggtggacagtggaccaggtttccagttttgggttattatggataatgctactacaaatattgttgttatatttttggatgaatatgtgtatgcgtttttggggggttgtatacatctataagtggaattgctgggtcatgggatatgcatatgtatgtttaattttagtagatatgtgcaaaaagtattccaaagtggttaaattgatacaatttattgaaagttctggttgttctgtgtctttgtcaacactttgtattttctgtcttcagttttattctgtacttcagtaggtatgcagtgatattgcattggtatttgatattggaagttacctaatgactgatgaggttgagcattctttcctgtgctattgatcatttgtgactcagtgttttgaagaaatttttagtcttttcttcatttttctattgtgggtgtcactgactcaggccagtgtgttggatggtaaaagaatgtaccaagacacttgtggggaaagaaaggcagatttattaaagaaaatacaaagatatattgcaaggtgcaatgggcagcacagcagagaaggggctgtctgcaaagatgtaggcactgcggggaagttttatagggccatagtggaaggggctatgtgtggaacgagataattgggaagaggatgttgtgccaaggagttgtctgtgattagccatctctcagaaaaatgattctcccccaccctgggagccctttttcattgttgctgacttaccaggactccatattttctatgggtttatcatttcttcttgatgtgtataaatcttttacatatttttttgatacatatcttctgtcagatacaagtattgtaaatttttcatcctaaatctcgttttcagtttttaatttttttagtaaacagatgctcttaaacataatatagtctaatttatcatattattattattttatagctgttatttttaatgtcatctttaagatgtttttgcctactgcaggttactgaatatgttgtcttttgtcctacaaattttatcattttgcaggtacaaaatatgtttatcttaatctaactggaattgatacttgtgtatggtgtcttatggggtcaagatctattttttttctctgtattttattttacttttgccatgtggatatttagttgtcacagcaccatttattaataaggcattctttctttttctgcactatcatctcacctaattttaccaccaatctggtaaccactattctacttactattaggttggtgcaagtgtaattacttctaatggcaaaaacatacagtaggcaaaaatatcttaaagataacattaaaagtaacaactacaacaattataacattaaaagtaatgacaaaaactgcaattacatttgcaccaacctaatacctccatgagatcaattttttttagcttccatatgtgagtgagaacatgccatatttgtctttctgtgcctggcttacttattttacttaacataatatcctccagttccatccatgttgctgcaaatggcaggattttattctttttatggctgaataatattccattgcgcatatatatatatatatatatatatatatatatcacattttctttatcccttcattctgtttctgtatgtattttttattttttaatttttgtgggtaaatagtaggtatatatatttatggggtgcttgaaacattttgatataggcatgaaatgtgaaataagcacagcatggagaatgaggtatctgtctcctcaaggatttatcctttgaattacaaacaaaccaattatactctttaagttatttaaaaatatatggttaagttattattgactatagttatcctattgtgttattaaaaaatgtcttatacattcttctattttatttttgcacacattaaccatccccacctcccccactgtacttcttaatgcttctttttattttttttttaaattttgagacagagtttccctcttgtcactcaggctggagtgcaatggtgcgatctcagctcactgcagcttctgcttcctgggttcaagtgattcccctgcctccacctcctgagtggctgggattacaagtgcataccaccacgcccggctaatttttttttttaagtaaagatggggttttgccatgttggccaggctggtcttgaactccagacctcgggcaatccacctccttggcctcccacactgctgggattataggtgtgagccactgcgcctggccaatgtttcatttttaaaattatcttaattactatggctttagaatagattatgtaaatgctctttttcaaacagaaagtatccgtatgtatttcagaataagcggaagcattacatttgaatcacattttctttatgcaagtgagagaattattggaatgcttaggcagtgttataacctgggaacaagaaactagtttaaagtaatcaaattgtcagtgactaagaagtcaaaagtcagtgaaaaacatgcacatgcactaacgtgttagaagtgcccattttgaaaatcaaacgtgtgactgactattcgatcatcaatataagataatactcagttgacgttttaaatattttatctttgcttatggaattttttttactgaatttttaaaaactcagcctcatcgataactttcaataactatgtttgattcattacacttattgtgttttattgatgtatttggaaattctactttgggggctgtgtgtgtgttctccatcttacagattttagagagattgtcaaattttttcatatcccattgttccctaaaatgatttaaaagacctcaattgtagtttcatttgttttaggacacagtcttagattttaacatacatacttatctattatatttgttaataaagtcttaggttagtggatatttctatactctttctgaaaatgacatgcatcttacaaccagttggacttttaagatagtctaggccaggtgtcagttgtgatacagcagtcatatctcaaataatgcccagtttttgagtgcttctttttttttttttttttttttttgagatgaagtcttgttctgttgcccaggctggagtgcagtggcatgatctcggctcactgcaacctctgcctcccgggttcaagccgttcttttgcctcagcttcccaagtagctgggacttcaggcacctgccaccacgactggctaatttttttttttttttgtatttttagtggagacgggggtttcaccatgttggccaggctggtatcgaacacttgaccttgtgatctgccagcctcaacctcccaaagtgctgggattacaggcgtgagccactgcacctggccttgagtgctccttatctccataatcatgtttctgctggttagaattttagaaaagtagtctttttgtcttttcggttgagtgatttatctaccaatttttatcattttatgtgctcattattgtattctacatctcagtcactacttttttattcttcagaatttctgaactctgctatgtgtctaaaatatgttttatgttttgtgtccttcaaagtgcatgtgttggaaacttaatccccaatgcaatcatactgggaggtggggctgatggcaggtgtttaggtcgtgaaggcaccactctcatgaatggattaatgctgattgctaaagagcttgaggctacaagttcgatctcttgttctgtcttgcccttccacctttatcgtggaataatacagcaagaaggctcttgctaggtgctgacttttcaatcttggacttccaaacttccagaaccatgggccaataagtttatattcgttataaattactcaggctgtgggtgttctgttatagcagcacaaaatggacaaagacaatgtctaagtgtgggtttagttttcttttttctgatcactaattaatgttcattttctttttcttttttttttgttttgttcattcagagtcttgctctgttgcccaggctagagtgcagtggaaagctatctcagttcactgcaacctgcgcctcctggattcaagcgattcttgtatctcagactcccaagtatctgggattacaggtgtgtgccaccacacccagctaattttccctatttttagtagagacagagttttgccatgttgctcaggctggtcttgaactcctgagctcaggtgctccacctgcctcggcctcccaaaatactaggattacaggtgtgagccactgtacccagcccaatgttcattttcaatcaggtgaccgccattctactcactactttaatgagatcattttttttagctctcacatgtgagtgagaacatgtgatatttgtctttctgtgcctggattacttatttcacttaacataaagtcctccagttccatccatgttgctgcaaatggcaggattttattctttttatggctaaataatattccattgtgcatatataccacattttctttatccattcatccactgatggacacttaggttattttcatttcttggctattatggatagtgcttcaatgaacatgggagtacagatgtctctttgatatactgattttctttcttttcatatatacccagcagtggaattgttggattatgtggtagttctatttttaagtttttgaggaacctctaaactgtttttttttaccctaatttacatttccaccatcggcgtttgagcattcctatttctctacatccttgccagcatctgttattttctgtctttttgatagtagccattttaactgaggtaagatgatctcattgtggttttgatttgcatttccctgatgattagtgatgttgagcattttttcatatagaggttggccatttgtatgttttcttttgagaaataactacagatcttttgcttatttataattggattataaagggtttgtttttgctattcaattatttgagtttctatattctggctattaatccatcagagagatagtttgcaaatattttctcccattccataggttgtctctttactttgttgattgttttctttgctgtgcagaagctttcacttgctacaatcgcatttgttaattttttcttttcaaacccacagctaatacaatactaaattaaaaagaaaaattgaaggcttttctcataagatctagaacaagaaaaggatgattatttttatcacttttatgcaacatagtactagaagtcccatctggagcaattagataagagaaataaataaaagctatccaatttgaaaaggaaaaaaggcaaattgcccttgtttgcagatgacattatctaatattcagaaaaacttaagactccaccaaagaactgttgtaactcaaaagcaaatttagtaaagttgcaggatagaaaatcaacatacaaaaatcagtagcagtagcatttctatataccaacagcaaacaatctgaaaaaaaaaaaaaaaatcaaggaagcaattttatacctaagtataaaaataaaatacgtaggaaaaaatatagctaaagaagtgaagatttctacaatgaaaactataaaacatttacaaaataaattgaagaggacacaaagaaaatggaaaagtatttcatgtttatgaataagaagaattaatattgttaaaatgttcacacttttaaatgataaacagattcaatgcagcctctatcaaaatatcaatgacagaaatagaaaaaacaatcttaaatctcatttggagccagaagaccctggatagtcaatacaatcctgaatgacaagaacaaagctggaggcatcactgtacctgacttcaaaatatactgcaaaactatagtaatcaaaacagcatggtactggcataaaaacagataccaatggaacaaaatatagagatccctggaataaacccatgcatttacaggcaattcatttttgacaaaggagccacaaacatacactgggggaaaggacaacctcttcaataaagggtgataggaaaactgaatatccatatgcagacgaatgaaactagaattattgaaactctctcaccatataaaaatcaactcaaaaagaatgaaagacttaaatgtaagacctgaaactataaaatgactagaagaaaacactggagaaatactcgggacatttgtctgggcatagaattttttgagtaagacctcaaaagcacaggcaattattttactcattttggttcacaatttcctgttttttatgatctctgaaaattgcagccctacctactaaaaatcttttattagattagaaatttgtttttgtttgtagttgatttattgttgattattagttgattatagttgattattgtttttatcttgatttttatgattgtgatctattttttatgtttattgggttttggttttgctgtttggatgttgggctttcattttcaggatagctctatcacatatttcgtaattttgttttgtagaattatcttatattgaaggaatgttgttttgtgctaatacattttctctttctttagagcatatgtgatgttttcgtccaatggcccctggatctgctatccacagttgtgttttatgtcaactgtttgagattccttctccatggacataatgaggctgttttgataccattactcaagggagcatatagcttggttcagcttgacttttgactgcaaggctgggtttgcatatactgccttttttgtcaggtggctgtagccctagacagcctcttattaacgggggatttccagtctcgcttattaacaggggatctcaatctccctcttaatcctcagcagggagcctgactgcagtctacagcttcagcttcatgttggctgaactttttctctgttcttcccatagaagtagaaaacctggatgcctcttcctgtgtggactaggagcccagaagcctgtagcttcagcccattttaccttttacttattctatttctcatccacagagatgttgcatatttgaagccagctatgcatttgaatgttctctttggaactgttatccgttatcattgtgagtttggagcaatgccacttgcctggatttcttcctttgtttcctacctggcaaacctaatggtattccctaaactccaaatatctgcacatcatttccctgtttataacatttcattctatcccaattgaacttcgaacaagtgtaaatgcattaccagacctttgaagacctttaatcacagggcctttgctcctatttatatgaagctgctttcagtttcccgaatgcattgcacttccttcaaccacaaggccttcacatgggctctttctccatctgataaactctcacttctctgtcttgtttgtacttagtcttcctgatctttctcatctccatttaatgtcacttccttcccttttcttcactccacggactttccttcctccactcccacttcccatgtgataacacttgtcccatttccttgtaaccactttttaatcactctttcctcatagactgaagctttttgtgaatagagaacatgtcttgctcattcaattcttaatcactgcacctagcatatcatagacacccagtaaatattacagaataaataaattaatgaagaggcaatttactccttcatcttagttcttccttgctgtccagacatagtcctgacttgcatgtgacatgggggaacaaactgttctatctgtaccaccagttaactaaggagtccttcaggctcagctatgaattccatcaggaaaattctgagctttttggagtaatggagggagaggtgatgggattctgttgtggaactgagagggtccagtggaagtgagtcagaatgttcagtgttctgcaacaaagacttcccttcactaccccttcaagcatcacacagactctccaggtctggggtggcttgtggtcccatgtggttattacatgcacctctacgtactgaatttgttgatccttgcagactagcagtgcaagagctgatctgaactcaggggccctggagaagcaaagtcactcctccccattctgaagcagctgtggttccttacatttggacacaggcctgagaccttggctacagtgagctagtgctggggaatctacttattgatcaccggagcagctgctaagcctggctttcaagaacatccctcagagggtgctttcactgtgccaaaatctttcattcattttcctctaccattttaacatgcaatttagttaaaacactttcctttcatgtgtgtgccaagatggtgacttcataaaggtcaggaaatgaggaagcaagaacttccttgaaagatttaaaataaattatttttagtaataataaatgacaaattgggagatttaagacaaagattcctggtagttgaatgcgctgaaatctatgatgtttggggattgttaacaatcttcttccaggatttgatcggttttgtacttgtattttctcaatctactattctttacttgctctccttcctttagaatggacaaatttttgtaaacttttaagttttctctttccttgaggtagtaaattggagttgagctacacaggttcctctttcctgatatcccctttctgctatttgatgtgagatggctcttgaggctaaaagtgcagtgagggaaagagagtcacattagcagagctatccagaatatcctctggttattttggagcctatttgtaaaataagcagggaagtgtttggggaagagtgttggcttaggtaggaaagaaaccctccttggtctttgccctgctgtttaccagccacgcggccttgggtaagtcattcaagaaatgtaagcctactaactgtcaaagcctcagttccttttacttgtaaatgagagagttgaattaagtcaaagtagtcagttcaacggcttgcaaagaataagggaatttaagaaagcagagaagtttcagggaccatggagaacaaatcgtgtgtagctaatatgtaactccagaggatggttactgtacaaaaaaagcagatcaggcattgtcagcacatctgattatttcaagggaaccccagatctggatttttatgtgaaatattctaatttcacatataattagcaactcattaagaaaaaaactaaaaatgtcctgcttagggcaaaggagacatatctgtgggctcatcactgcctgtggacaatctgtttgcaaccttgggaatagatgacctctgacaccagattaatcatctgccttcaaaattgactaacttcactggacccagtcccaggtggagagtctgaaagcctagaaattgctgcagcagcatcaacttcctgttggaagctggggaggcaaagtcttaccctgagaaagggctggatttctcttaaaattttgaaaggccaaaggtggtgtcagcatttttgtgatatggcaggaataatactgtgcagtggatagggagctctgaattcttaccttgggtgtgctaaaaacctagcctggacttggttacatcccctcctttctccggtgttctcttggtgggtttataattttagattaaatcagtatttctcaaacttcaatgattggtgtattacagtgtggtagccagtctctgagatgattcttattccttgtttttgcttccttgtgaagttccctcccatatggaataggagtgatttatgcaactaattagagattgcagaagtgagtgtgtgacttctcaggatgtgtcataacagatattgccattttcaccttgatctctcagatcacttgctctggaagtacactagctgctatgtcatgaggacacttaagcaacactgtggagaggtccacatggtaaggaacagccagcaccaactcacaggtgaatgaaccaccttggaagcagatcctccagccccagtcaagccttcagatgactgctgttgcagctcacattttgactgcaacctcatgagggactttgagccagaatcatccccaattcctaacctacaaaaactgagagataaaaacatttatcactgcttaggcaaccaagttttgcattattttattatgcagcaatagataactaatacaaaatcatgattattgctatattggcctaccattgataatgttacacattaatgcatgtcaatgcatttaaatggtttattctttcaatttaaatagatttattttaagaggaaaagttttatgttgtaaataaaaaataagcatcactagccacaaaataaaaataactcagaatttaatttccttttcctgtgactcattttttatttttatgttttaaaataaattttattgcatgtatttaaggtatacaacatggtgttatggaatacatatagatagcaaaaaggttactacagtaaggtaaattaacacatccatcatcttacacagttatcttttttttgtttttgtttttgtgtcaagagcagctaaaatctactcatttagcatgaattcccaatatagtacaattttattacctataggcccacgttgtacgttaaatctctaaagttatttatcctacatatttgttactttctctcctttgacctacattttcctacttcttccttttctatctcctcctttgccccagtaaccactgttttgttctctaactctgtatatttgattgtttttaaaagattccacatataaatgagatcatgcaataattttctttatttttctgtctatgtctggcttatttcactaagcttaatgtcctccagacacattcatgttgtggtaaatggtaagatcttgttctttattgggctgaataatattcccttgtatacatataccacatttttgtatccattcattcatcaatggacacttaggttgtttccatatcttggctattgtgaataatgctgcaatgaacatggaagtgcggatatctttatgaggtgttgatttcatttcctttgggtatatgcccaggagaaagattgcattgctgggtcatatggtagttctatttttaatccctttagaaatatccatactgtttttcataatggctatcccaatcttctccaatctaaattccatttagataatgttgcctgcagaagactctgagcctaaggcatctcatgtctttggaacaaaactgggactttatccttgaattaaacaaagtgactgatacgcaattgagcagggaataactttctcacagtgaaatttgatgttaaaatgccccctctctctacacccccaaactgtcttacagtcttccaaaaaatgttggtgttttcttttcccccttttgggaaaattagctaaagtttatgtgtttcttcacattccaaaacattctaagatagcacataatctctgtgtcaagtaagattgcctataataaagtcctgtaaaatagctcaccccagtttttttgaagtattgctactaatataacgccttgtggttatttaaagatgcacagtttccaaaaccctgctctgttcactgggctttagtagcaacaaagagactaggtctgcctgaggattatcatccttaaatgtatagattaggaagttgaagcctggagaagtgaaattagataagataataagataattcatctagtaattagtagggctggggttagaacctgggtcctctgggtcctccatcactctgtgtggcctgcacagaatccagtccatggactcttcacatgtgaggactctagctgcacatgtggggactcccaagcaggtatagtatatcagagcttgaaggaaggctggcatggcagggtctggggtggtttgggggcctgatgcacggttatcagaggagaatctttaaggaatctgagaagctgagaagatagcaatgtcaagctcgccaagcagctgccatggcaaatgagattacagaagcagtcttccctgcatcccagaggctgccacagctgagagtttaaatttgcagcttcagaaaggaaagcagacacacaaatgtgcacacgaacacacacacacacacacacacacacacactcactctctctctctctctaatgcccatgtgatatcaaatgtagccttgacaatgctccagcccccacagagatgctagtctctcccacttctcagtcaactccctgaaccccatctccctacatggctgtaggatgtttttgaatttctactaaaaaatatttctgaatctttgtgcatcttgaatttgtccaggactaaagaaagaaaagtatattttgatgtacaggaatgcatggagctttgtggttctctactcaagtggagtagtatttttatgtatattgggtgacaaaacattcagattacatggaaaccaaacatgtcaaagcattttggagaaataatttggtagctatttccagatgcaaaaatacttctgtttctcagtcaagttctttgtcctatttaaacacaggccactagagctagtaattgtcttttcttaggatattttaaaggtcctggaacacaagactggaaccctggaaggatcagattgtctcattttaccagaagagagactgaggcacaagaggagaccaagcatggctccagggacgctagtgagtcacctgcagatgagattattcaactgtataaatgaaatcatgtttcacctgcaacgaaagaaagcacaaatcaccagtttttacttctttctcttcttttactagttttaaatggctaaatggatcacctcccttccattcccccactccatctcccttaaatttggaaaccaattacattccagggaggtagagatctggtgataaaggactcgtttcaggtttcacacttgaatacatttttacagcttgcttataaaattctgaaagctggtctcctagtagaagggaagatgctgtcaaatgctaaatggtgcagttagagggacattcagacctcctctctagcccttcctctttttctggcacccaaaggcacgggcctttcctgtcagctgtgcaggctcctcattactttctaggatcagcacatggatcggctctacggggtgtcagactcagtgagtcagcaaagcaaagcagctgggctgagacagtgagacagtggacagtcacccagaacagaggcagggctcatacaccagcagccggggaggagaagctgtgcagaatccacatcagagacatagacccaggggcatcattctaatagagggcttccacttttgatattcttctttgttgtctggtatgatgcttaataagtggaaggtttaaagggaaggtgtgggggtgagtctatttattccttgtaatatttttccgccaatttgaaatagacgaattagttcagactatgacattttggctgatgcaaccttattttattacttattttattatagatcagagtaaagggttaagtcatttaattcaggtcaaattctaaaagaaggatattactcaactcataaactatatagtctgcatcaagagaaatggcttttatcaacagcaatcaaactcccttatccaaaatagtaaaatcttgagacttccaattttaatgtaatattttccattttaaatatggataattatttgtgctaagtagctaaatataaccagagacattaatggacaaatgataacaacacaaataatatatttataacagttagcatttttaagtacatcatttaccatattatagccacactgcagagaaatttatttttaatggatgctacctttgtagctcccctaattctgaaaagattttgtttaatctttttagcaactctaattaattattatcatcttcatatacatttgttaattcaacagatattcaacagatatagctattatagtataagaaattaaaacaaagtgatgcgaaagaccaatctcaggggagtggagatctttggtcaggatatgaagggaagggctctctttctagatgatgggtttccaggtacaaagagatgtgaagatgtgaagattgttccagggcaagctccgaggtgggcaaagtgactggtgatggtggggagagggacaggagggaggttgatgaggttagcaggggctaggttatgtaaagccatgtgggttgctgtggggaattgagatgagaaaacagagacattgaaaggcattaagtctcgtttccaaggccacactgctaaccgggagtggtggcaggtgtctgtaatcccagttacttgggaggctgaggcaggagaattgcttgaacccaggaggtagaggttgcagtgagccgagatcgcgccactacactccagcctgggtgacaagagcagaactctatctcaaaacaaaacaaaacaaacagaaaagaactgaagcacagctaagccggataagaatttatctctatctctaagtgtatctctctgtcttatgtgtatttcctgtatctcagtttctacatctgtgtattatctatctatctatctatctatctatctatctatctatctatctatcatctgtctatctttctatctctctattatctatcagctactatgtgccaggaattgtaggctgaggagatgtgacaataaacacaattgccagagttcctactctcatggatttttaataagtgcaataaagcaaactaaaatagggaaaagggatgtaaagcaaactaaaatagggaaaagggatgtagagtaaaagggtgcttttgtggataagatgctttaaacagagaatatctttgagtggaggcaggaatcaagtgtggaggcagacatgcgctctgtgtctgcagctaagatagctttgtaattagcattttctaaatacaggaaaacatgattgtctttattgggtagcgtgaaacatgccatgactatcttgaggtgtgtgtgtggggtgtgtgtgtgtgtgttgatcaaatcctttcccagaccagaaagagcaagaaaaggtcagcctaagttgtataaacaaagaggatttggaggcttcaggttaataaagttttgtggggtttagagagccatggaggcggtgttcataaaaatagagaacccaaccagacagaagtttgtgtgtgtttgagacatgagtctttggtgtctacacaccaaaaatcagttatacctggagaaataattatgacattttcaacagaaaagtatttaggcatggttaagatctgacccccacaaaagattgaggaaaaattgatgagttcagcaacagccaataaaaagtcatgggaagactgaatgttggagtttagttacctttgggtctgagaaactgcattatattcccataaaagactgaagattaagccatattcctctctctgtgcattatattccttcttttttcttttttccctaacagaattttagttgcttgaaaagaattaacatagagcagaattttgaatatggctaggattagctattgtagcataaggtaagtggaaaagaaccccttgtcatgttgagtttttggaatgtctagacatgaataaaaattaaaaggtatcattgattgtttctgttttaatgagtataaagtgaattgggcaattcacaggctaactccaaccattttgggcttcctgatgactagggccaagatatttcaaagagtactaggtgatttattgggtcttatgcaattattattccaagaagagagatgtcgtgtccttggcttatgggtctggaacctactcatgcatctgtctatccaggcttctgtccatgcatccaagaggcttttatggagctctgtgaatgtcacaaagatgaatcaggcatgccctctgttcccaaaaagctcacagcacagccacagatgaggaaatagagaattatgttttttaaagtagggtaagtgtaggatggtggcaagggttagatgttttgggattgggggtaatgatcccaaattggattagagcacctggtaacagtttctcagaaacgctgatgattatgttcatcctagagaagaatgtgtggaggttgtgcaggcacagaaggaagaaagaggttttccaggaagagggaattgtacaagcctgggcagaggcacaaaggggtggaagagcaagattcactcagggaattgcagtaaattggcacgactggagtccagactacatgtttggtcaggcagtggggtaggtatagaaaaggaaagaatggccaagagtgagagactcagagtatttgggatagagttatgagaggcctgggggacactataatgaacttggatttgatgctagtagctctgaggaaccatgtatgtaatttaaattgaaggtgtctcactaagatgatggaagttccattgggctcctatggggtgagtagaattctatggcaattttttgcaataattatggcacaagagtgaggccaagagtaaatgatctggagtgtgagaagccacttaattctttgtatgttggtccttaaggtgtaagcatccctttcatggaccttttgtaggtccaatgaatgacctcaacatgaaaccttgcagataattttgaaagaaaaggaaaaaaaactcttcaatcatgaaaaggtctccattatatttccaagctatgtgaaaatttttattatatatcaattactttggaaacatggccattgcatgacactgtttctcattcatgaagggaacacttctgttttgaatccccagcggtgcctggtgtagtgcctgagacagagaagaagcttagtaaatgttcaaggtattggtttgctaatgatccaaaccaagctgtgtttgggcccatttgaacatttaccgaaccatgttgttaaatataaggaatgtcagtaataaccacaaaagtaagtcagtaaagacaatagagcaatgtcttagtagttatcatctactgaagatctgctcttagctaggcatggtcgcaggctctttatgcctcatttcactaaatccttaccatccccacactgtgtctgttttattatccccctttacagttgggaacactgaggttaactgtgtttactcaacaatctcagggtcacacagatgcagagtagaaaagcaggatgtgatcctaggactaaaggcagacaaagtctatgccttttctctcctattgcagtttccacatatcagcaggtacttcctgtgaaagaggaagcacatttgttctcctggctccagagaagagaaagcagactggcagctctcccatgagggaaagaggagaactttgacaggaatttacgaccaccagggagaacagaactaacttttctgtaaggctgtggccacctacccctgaagatgagatgctgatgtagaaaatggacagccatctcttagaggatctgcaaaataatttctattctggttagaaaaattaaatacattcactttatctttatgatcttgagatattccttggatagtaacaacagctcctgacatctggagactatttcattttagacaaaacatttgcatggagaatctaatatgatcccatgtgacattctttttgggacaaggtagctgttgctcagagaagcagcaggaattgtccaaggacacacagggtgaatgaaagacttggcagtgggacctgggtccaataatttcaagaccagtgctccttcacctatgcatgttgtctactggagtgaagcaaaaatatgggtctatagggcagtattatgcagaatgagtagtttctttccattattagcataagccatactctgaagctatttctgagacagtcatccttttctatgtgggtcaatgttcctgcagcatggacttccttctgggaacaaagcatcctttaggatcttccttaatcatcctcatcagtgtaatatgttgcttcctgtccaactgtgccccatttccataggcaatttatctgtatccatagagacaccagagatctgcttcttacttcaaatgtttcatatctaggttattcttcctgacatgtgagtccagggcacaagtctaaagctcccacttacacagcccagagggactgagccctgctttccacagtcaggtcaggagcacactgactcctgactgtggaaaatttgtctgtgtgctaagtgtaaacagatgtccccagctgccggatcctttggccatatgaaaccaatcaccaactctacacaaacatgcatcatcaggctaaaatctgaaggtgcaatgaactcaccctgcttcccataggacagtgggtgagtagaggctgtggggagtttggtcagagcagtccatctaagggcaaaatttgtgtggtttaatgagatgaaagtggtgaagcggggccaaaggaagtgcagctcagagttaggatagatactggttcaatatcatctggacactttcaaccctgtacacatgggggcactaaggtttgggggtagaagtgacttcctcatgatctcatagcactctagtgattccctcagggtttaatcacagatcagaatgcccaggccagtactcattccattatgtaaggctgcctatgacactggctttcccttgagcttcttcatgtggagtccttgcatctcttatgttttaaatcctggcagttttggattgacttttctaagccatgtgaactttcctaaaggataaaaatgatgatgccattgattgtgggttaatattaggttagcctagatgttctatgtacttaattgcattaatagccctaacgtaccatgaagtaggtcttctattttaaagaagaagaagctgatactcagaaatggaaagagggttgcctaaggacacagcttttagatggcacagcctgaattcacatcaagacaagttccaaagacatagtttaaagaatcaacgaagttatactgaggcatctgattgacaatataagatggctgcatgattaatattatttattcacttaaaagaatttattgagcatttattatgtgtctggcagtatatgtggtttcaaagttgagcatgacattattctattaagaaaacagtgtagtggtggagttggaaatacaaacaaacccctcatttatgttgaagcaattgttaaatggatgattgatcaggtataattggaatagagtaaaaggagtgcatcagtttgtctaaagggtaagagatggtttgtcagaagaggtgacacttttctatcaaataggtgaggatggaattcaaagcagaagttgacagtctgtttagagaagtgaaaacagaacaaattatggaattgtggaatacttagggaaatacaggtcattaggtattgttaatttgttaaaatataagcagggaagctaaaaagatgatattaaatatacaggttacaaggaccttataggttttactaagggagttagaattgttctctgagggcaattggaaaccatggattggttttaaacaaaaaacgcatgatggacgtattgtttaggattggatttgattgttagtaatgtgaaactctaaattaatactggcctaaaaacagtaggagtttgtttttcatctaaaagtctggcgttacatagtcgaggattaatatgatggctgtttaggaattcaatattttttcaaccatccccgtatgtgaccttcagactcacattctaaacctataatcagggcaacaaggtggaaacaatggtaaataagaagagagttacacagaggtaccagtgttcttttaaggaaggtcctcagaagcttgcacaagacacttctgcttttatcttatacatcagaacttagttacatgtctacactcagctgcattaaaggttgggaaatacagtctttgctctggatggtcaagagcccatataaaaaatcaggctttgtggttttctgctagaactgaaggatggatattgaggcaagttatcagtaagtattttcatattaaagagatcactttaataactctgtggaagatggacaaagatatagggaagacactgaagatatgagactgaggctggtgataaccatgaggctggggaatgctttccctttcaaatgacctaggctttgcccaattaaggaaattactgtcttagagttacttcttttctattgagtcagaggtagatatatgtctccttcagcaaatgagtcatacccaaggttgggtaaacttgtttagatatgcagagtgaaccacgatatgaacctggtttggactgtatccttcacagacttaaaactctgctcatcattcttgtgtcctcaaatagccagatcagattttttattctgattttctatagagctaagataggtaagaggaagtttctatccatttcattctggttagctgagttaacatgttttgtctgttaaatattcatggaattaggataagaacatgagttttagaaccaagaaaaatgggaatgaaaaactcagctctggtactaatcccaggttgtctggtttgtgagttagtcctgatcatcaccacaccatatggcatcctctggctcttggtttacttttccctcttccttaagctgttcattttcaagtaacatggggaaagtcacaccagtcttactgagtatccctaaaaaatggaggcagaagaatggacttgatgatagaaaaatttattcttgggcactaagcgtgctcagctggctatgtctacctccatacctcccctttaatatttttctcctggcccaacaagtatgtccagggccctataaaggaaataatccagcatatgtctaatgttggctcacccagtcctcatcagctttgagccatctcactttgcttctaatattcctaaagcccctcttcttcagagtccctactcctctattttactcagtttctcttgattctatatcatggcttcattcttctctacagtgtttctaggaatacgaaagagtagggatgttgtctgaaaactccaaggttgagatataacatactgtttaataacagagatgctgaaatcaaactggtatgaatttacatctttcccttactactattaattctggaccttaagtaagttgtgtacctttttcaagtttcctcatctgtaagaaggaggacaataataattcctatcttgtatgttattgtcagaatttaatgagttaacaaatatatgtaatatatatgttttatatatatatacacattttggtttagtgtttggcatatagttaagtacaaaataaatattagctattgatattaattttggggttggaggtcaagaaataaggctggaaagttgggaggctccattgtgaagagtgacttaatgattaagaagctggattttgggcaagaaaaaagaggggctttggacaggagagtgcattcattttctattgctgccgcacaacatgaaacttagtggtctgaaacaacacagactcacagttctggagatcagatgtgtaacatggtaggcagattgcattcctctggttttggggaagccgtacctttctcagcttctagaggttctccatattccctggctggtggccaagcatattccgaattctgcttccgttgccacatcttcgtgtctgcctgactctactgtgtctctctcacaagaacttttgtcccagatagtccaggactatctccccatctcaagatccttaatttaattacattggcaaagtcccttttgccatgtaaagtaacaaatttgcaagttctggggattagaatttgggctttgatggaggacatttcagcctaccacagaaagtaacatggctgtctggggattttccaggatagcttgtgagattagagttaggaaggccagttaagatgctgttgtgagaatgtgagaatgctgttgtgagaatgttgtggggaatgtgaatgtaagcattaggggcaatcaggacactggggaggaatggctgctgaagaactaaaatcaccaagacttggctaatgagattaggagaagggcttctttctagatttctagctgcagggactttcagctaggggatggtggtgtcagcaggagctggcaaataccaggggaggtgaccgacacattgactaaggctttctgagaaatcttgcttcctgtagcctgcagccattcgttataaaacacagagagcagtctggcccagaacagagtttcccacatttcactcattcttaacaactttttccaaacctgtctttttaatgtttcaatttctgaatatttttctttaaatagactccagtaaaagtagcttcatcctaaacaattagtttcacaaaaccacaactctgatatgcctggatatttggatgcacatactattcatacatactcattaaaatggaaatgtatttttccatgcaccagctaaaattatttctcaaaccatcagtgctaagcaaaccacatatatgcaaatgtcggggaaatgacaaaaacacagactgagagattcaaacctagacttgagtgtatcacttgagtccctggacttttatttcctcatatgtgaaataaagataatgtctaacttataataacttagttagataattagtgtatggaaaatgcaaggtgccatatcttataacaggaacccagcctattatatgcatttatattgttgaatcttgtgatgttttttccttatatattaaataagtcagtcttttcataagacctgtcagttaattttgataaacacactagggaattcatcgtctttgcagtctaggtggcaaagcaattttacttactgttttttattacctcatgagtcttctttacttccagggtacttctttacttccagaggaggtatggaggtatggaggtagacatagccagctgagcacacttagtgaccaagaataaattcttctatcgtcaagtccattctcctgcctccactttttagggatactcaataagactgatgtgactttccccatgttacttgaaaatgaacagtttaaggaagagggaaaagtaaaccaagagccagaggatcaagtgaccacgaggggcttagggaaggcattcattcctgttgactgtgctaggagaaccctgggtcaggagatgctggactcctggggtagaaaacctagttcttttcaaagatttaaagtaaagttttgaggtggaaagccctactgttttctggactatattagaatcattcctctcctcatggctgtggatcatattgcttataaaataccagcctcgtgacccatttgagaacatcactgaaggtccacaagataggaacaaatgggttttaaaaaacaccccagggtctctccctactgaatccctacccagtctaacagaattagactcaaagcagcatttgcagaagatagccctctttgcatgagctttccaatgatacatctggttttccttttgaaaaaggccctcaaacctcataaaactgaagtcctttgattcaaaccacaaattccttatagctaacctcagcaaaactccttacacactctgagtacttagtccctgtaacccttattcctcttttctcttccatcttcattaagttagtgggagccaagcttacaaggataaatctgattgttttgttcaattcacttcatattaataaaaattatgggtcatttttctgccttagacctttgctttagaatagctactatttattaaactctaactatggccaagtacattacatagcatcccacttaaacttacaacaggcttacaaagtaggtggtatttttccagtctttccaatgaggaaagagaaacaagcaaacaaacaaaagttattgtttcattgtcttcctgctgctagatgatagatctagtaattcaaatccagtcggtataactccaaagccctcacttctcaagtttgtctctctatataacagattcctaagagttaattttcaaatacgatttgatattttaacaattcctcatttgcctcaggcaattgttatcctgattattgacttcatggtgatgacaattattgctactatgaataacagctcttatcctctaagtgttatactgtgcattttatataccttgaatacaataacttcttgaggcaagtattattatctccttttataaatttgtaaactgagatgcaaaaggtttgttaacatttccatgatcacagagcactgaattaatgggaactgcaaatactaacaaaaaggaaaactttgtacatgccagcacttttgaaatatattttacatggttaactcatttaatccccacaacaaccctgtaaggtagatagcattatcatctgccttgcacaagtgaggaaactgaggcacagagaaataaaatgattattcaaggccacacaagataatcagtgaaagagctagagtgtgaatcagtatggccttgggtctgactcagagcttgttatcacagcaccatgctgcctaactatctgactgcaaagttcctctttgctctgggcaggtacctatgtgagtgaacttgaaactctatcactcattccaattcttttattcactggtgatctcactatgttgaaaggacaggatttgatgcatgccgtgtcagtggtgatcactgttattgagatagatttgcaccgatgtctgggagtttggactgaatgttaataacatacaaaggtgacctgcaataaatacacagctctgtcagaaagctagaggtctgcttggcagagagagtcatcatggattgtggcagattctccttctgtcaaggcttatctgaaggctaaataaatcatgctggaatcttctgggatgttggaagagaggaaaaagtgtgtattggatgggggtagggatgtggaggaggttcagatggaaatggaatattgattagaacaaaggtgaacttgatgtcagccagtgttctttttagaaatgaagggccaggaatggaagttaaaaaagagaaatattttctttaattgcaggcatagaaatagagaaatcaacatctgaagaaattctaagtgacacactgggctctagatagatgttactctatgtttgattctcaatttttttgatctaatgtttctgcaactatgaagatgtagctacactacagcataaagtgaactccttcacaatgaaaatttatttgacacatattaattgataactgacagctataaattcacatttagattgacttcaatataaaatattcacttaaattgctgtgtagtcacatttcttaactttcccaacttttcaagtataaatgatgcctgatgtttggcattagttttgaggattcccaagaacagctatctataccaacgtttaagaagcatcttcatagtgcagatttatagaaagatatcctccagcaatacagaggctatgtgaaaagcagtgtgaaggtgacagatatttgtcacctatgttatgtcaggcactgtgctaagtattatatatgtagcatctcatttaataataacaactgacatgcagagttgttattattaatccccattttatagacaaacatttccaggactctgagttatattgcacaaggctccttgatgttctcatcatgcagcagaatttgaaaaccagtctgtctgatttcaaaacttgtgttcttttaccagaacaccatacactgcctctcagagtaaaggagagataaatcagtgaggacagctaagttgggaggtcaggagactctctctcctggaagagaaacaccgaactaaaacaaaaccatgaagttcagtgttctaatttagaacaccaacctttgaagtcccatattctggcctttgctgggtatagaatacgagccatctcatgctctaagatggctggtaacctttatctctttcttccaggttagaaagttagctgtttctgaaggcattaatcttagtgagaaaatatatcatacattgtaattcattatgccacacagttcgttcattcattcaaaaatgttttctggtagattgactgaaaaaagtagctctggttttatttatttatttatttatttatttattttactcttcccatacccattgcaatgtgacattgcagattttatcaagaggtagtctatttcaccatgattttaatctgggctctccttgtatcttgttttgtccaaaagaaggtggcagaagtgacaatgtgccacttttgattgtagattatgagaggctttacatgcttctgtttctctcccctgctcttgcatccatcatgctatgggaacaaaatcaggccagaatacaggaggtgaagagagacacatgcacacagccacacacagaagcagagctgcctgattgaacacagctaacctcatgttcatgagggaacccagcagaaaccgaaagagccacctagctaagcctgctttaagttgctgacccaccgaattgtgagctaaataaatggttgtggcttcagccactaggttttgggctggtttgttctgcagcaccagataactgatatctattcactaaaatgcacttgggtgccaacattgtggcatgctgtggggacatagaggtgattaagttatgttccctgttctgaaagagccggcactccaaataggaagtcagacatgtaaacaaatgacaacatagcaagttatgggattaatcaaagtaactggtgaactccttttagtaggaatagttctatttcctctgtaaagaaaccactatgatagggagcacagtaccagttggttccaataattcttgtgatagtgtcatccaaacctcagactgcatcagtggtcactcagcaaggagccttgaagattacccaatgctatttatatctattatatgatcctcattaagtaacctcaaaggggaggcaggagcttggaaccagagctttttggaagaatttctttaaagggatagtattctgtgattaaattagaaatagcaagatacttgggagtactgattaaaaattttagtcttttggacttttaatgactgaaaaaattaatagagctctaggctccagaaatcaggaacttgctgagtatctcttttttttatttttcagagaggaaactatagcagctggcagatagattagtgtaaagaagctacacttgggtttgaatcccagctgagccactcagttacttgatcttttgctggtttctgaatctccatacattttgtggtgcttatgtctaaacagggataaagatatttactttataagtttatgatgaggactaaatgtaccaggcacataattaatgttaatactttccccattccttcatttttaattctcctttgctttctgttgccattttctacttttttcaaaagaatctgttggagccccaatacattaaccttcatgaaattgggtcctgaccatccgtgaaatggatgagtttgaacacttccccaatgtcggtctgtaaaagcacattttgaaagtggctttgaaggactgtttgaataataagatctattcatgatcacagagggccgagacaaaaggctgagacaagtctgtttggagaaaactctgtgtggaatgtcaatgcacatattagaacccagcctgtcaatttggtccacagagagaatggtggttttatgacattattggcaccacaatctaacaactctcaaccggctggggcattaaacatgacgaaggacacagatagactaccctagattttttttattcaaagggagcacatgtaatgttctcatgcaaaccagagaggaagtgagaattctttcatcttccttttctttgctattaacctcaatcacataactcttgggttaattttccttctataacgagaacaccaaacagaaaacacatgtgagaattaaataaacacagagtagaatgaaggctgaatctatggaatctatcaggacttgtttacagagaaggtaaattaacaatttcttggaggcacagttttcttacctgtatgataggaagaatcactgttggaataggcattagtgttagggatgcttctagaaagcctctctactagcatactttctagtctcaggacctttgcacatactggctctctatctagagatcccttccttgccgagatgtttttaggttaactcctcaaatttattctggcctttttccaaatgtcatcttctcacagggaacttccttaattatcttatccaaaattgtcatcctattaccgtctacctcctcattctggttgatttttacattggagcatctatctgatattgtatcatatatttacatgctgccttattaattgttcatctcctacaatcaagtgacagtctcacaaggtggggactttatctgctttgttcacttctgtgtccccaacacctataatagtacctgctacataggaaacactcaagcatttgctaaatgaatgaataagtaaataaacatgcaagattgttttggcaccaaaaattacagcatatagtaggcattctataactgttggcagaattaacgagtgtgcatatccatctgtgagcagaattagggaatcaccactctccagcaagccagtgtctctctcacttcacacccctgcagattgcataaggaatgtccagacactttctgtttccagaatgatgtaatgtggaaggagaagacctgcagaacatgttgctcacagacgagacagatgatctcatccccttcctgggcattcccaggctttgctattaaaaaaaaaaaaaaaagaaaagctgcaatgttcaattcacaggtggctgtttagtcctcagccgtttattggcaaaatactttaactcatctcttagctccctggtggctgggaggaggagaggaaagtcatgtcagatatcatctggcctatttcttcagccaaatggaatagatttaccctgagaaactaggacataaagggagagaagtgcactttagcatcagccacaggggacaagctgtgagcaaggggtgatgggggagtttaaaaaacaaagtaagccaagtgtttcattgacaccagagagctgagattgttcttgggattatttcaaaagtctagagcctgaagaaatgatgtacccaatatccctcacgtggctcatttttatttgaaaaatcctttagttttgatgtctgtgtatatattaaactgatcagaatttcaatttataggtatttattactctacggtttataacacatttcaatacacagatcttcacaaaagtcctgaaagtgaggggtatagaatgatccccctttatagttgaggaagctgagtttcagagaggggaggtaaattagccaagattgcacagctagagagcagcggagttgccattggaactcagatctagttatctttaagtgcaaatctccaaccaaatcttcaattcaagacttaaaaggtgacctgcttgtcagctacagtgtttgtatgcctcaaaggtttcccacatctcttttttccgtggttagctactagacaccttatttcagatctggggcagtttgggatggcaagtctgtgcacaaatcaagctgaagtccagttggatgtctcctgaacaattagtagttttgcaccgatttattaataagccaaatagtactgtcgactccaccctccaaactcgcccctcctctcttttctatccccttcccaccaagatgttttatttattttttttcagaagttggtgttagcagctggtcaagtcctaaatacaaaatcatcctttccacaaccatgtttcccatccaatccatgataaaattatccaattttcattgccaaaatgcaccttgactctgtccctttttctccatctttatggccaccaccttagttcaggccaccaatcctgagccttaggttattatatctgcctcacagctgctgactctccttccactcttgcttctctcattcatcatatgcaatgaacacaagagcaggtgtttttgcatacacccatttttttgtgtgcttaacctctcaaggcattttgatgcatttacaaaatcctgaagccttaacgggaccataggctcggcttgatctagcccttggcaaccttgacaaacttatttgtgcccatttcacacttgcttattttattctattccagaagctgctgtgtagagagaaagctgctgctgctgcttttttttttttttttttttttttgagatggagtctcattctgtcaccaaggctgcagtagtgcagtgacacagtcttggctcactgcaatctctgcctcctgggttaaagtgattctcctgcctcagtcttccaagtagctgggattacaggcacgtgccgccatgcccagctaatttttgtatttttagtagagatggggttttgccatgttggccaggctggtcttgagttcccgaccttaggtgatctgcctgccttggcctcccaaaatgctgggattacaggcatgagccaccacaggtagccaagagaggtagcttcttgagagtaaaacacaccaagaagaaagtagagcttggatgctatgagagcgtgaacactggcgatattgtttgaggccctgagtgcatttatgccttaagtgctgcattgagttattgagccaatatatcttttcctctgtgtttttttaaatcaaaatcaagttgatttgagtttattgtcacttgcaacaaaatattactggatttccacaaattcacaatcagttggggaaaagtcgatatgtgaacaggtaaacactgaaaatagatggtttgtatgatacaggtgaacacgagggcctttaaccagtgtgggtgttgaggtgggggaaagtgtccacttccctccaggagacaatatctggtctgaatcttgaaatatacttagcagttgtcatgatgtatctatcaaacagaggatggcagagagacattccagggagaagagaaggcatgagtcaaggcatggcgtgaaatgggatgatagtttctgggaactacaagtcactcatactagctttaatgcagcctggatggtgaaggcaaagggagagatgctacagagaaaggcacaggccatactgtgaagtgtccaatagtttgtcctaacaagataatgttatcctgggaattttgagagagcattgagaaattaatttttccactttaaaaatgaacattctaatccttccccagcctatgtaccataaaagatgatggtgaaggtctcttagtaaaatgtctgtgaaaatgctttgaaccaggtataaattggctaattatactatggaaaacagaaactggaatatgtttgatgtcttctagtttccaggccctggacaaggagagagaatctgatatggtttgactgtgtccccacccaaatctcttcttgaattgtagatcccacaattcccatgtgttatgggagggatctggtgagaagtaattgattcatgggggccggtctttcccatgctgttcctgtgttagtgaataagtcttatgaaatctgatggttttataaaggggagtttacctgcataacttcccttctcttgtctgctgccatgtgagacttgcttttcacctccttccatgattgtgaggcctccccagccacgtggaactgtgagtccattaaaactctttcttttgtaaattgcacagtctcggttatatctttatcagaagcgtgaaacggactaatacggactcaacacagaaaggagaagttgagaggatgtgtaggtgggttttgtgtcccatgagatttcagttcctggcagtgaagacctcaatggtggggcacccttggaagttgggccacatccttatagtgagaggagaaaacactgcttgtgtagttagcctatttcacaactgaccagagtagggcctgctccctacccttctgtgcctccccgttgcatcccaataacatgatcccaaagtagtgtttctgattcttaagttcaaacaacttcagtggtcaggaactttgttcccagaaactgtttccccacgtcccttcttatattacttcctgtatgtgttaacactctccccacccaaccctcggtcattatatagttgaacaaagccaagagtatgccacagtggcaggttcgcacatagtcagccccagcttcagtgtggggacatgattgaattctcggcggctttgaagcctggaaagcagggttgtaattgacaatgcaccaggacaagcatttgttctcatggggggtctcccatccgtgagatcaagaatcctaaagccacatttttggcatcagcctccctggaccattcagtatgaccactaagtgttagattgactctgggctgattgcttctgctatttagtgagttgagatgatgagcctgagctctgagatgttgcaatatgagtctgcccaaataaaaccacttaggattgtcacaggaaacaaaataatgtgcctcttcagtttaagggacaacttggctacatttggaatttaaagagtctctcttccttttctcagtcaagggtacaaagtgtgttaaagtaatatgagatgctttggctaagtattcaattatctcattcatttacttaacagttattgagaacctgttctgtgtcagaaatggtgctaggacttagataagctgaataagacactgccctgccctcccaaaacttgccatccaacagtggtgttgagcagtggtgctcactctcaactagaagatgaaggattccatttcctttccagctctgccacagtgctgggaatacttgactgtaaggggagagctttctgtttacaagcattctatttcagcaaacaggggagtatcttataatcaaggcattataagtcctgcagatttaaacttaatctctcaattgctttatttttaatgccacaaatattattcagaaaaaatatatgaacccattaaaaatcagtgcaaggtctggatatataaagaggccacctggctgggtgcagtggctcaggcctgtaatcccagcactttaggatgccgaggcgagtggatcatgaggtcaggagtttgaggccagcctggccaacatggtgaaaccccatctctactaaagacacaaaaaattagccgggcgtggtggtgggcacctgtaaagaatcatttgaacctgagaggcggaggttgcagtgagccgagattgcgccattgcactctagcctgggcaacagggtaagactctgtctcaaaaaaaaaaaaaaaaaaaaaaaaaagaggccacctgaccaaatgttaagggaggaggcaaaaatatttattaaattttgtaattattcctgatagactgcgttgcagaattcaagaatatatatgtctacaaaatgaattaagcacacacaatgttcagttgttaggcaaattggtatttgtggcttgccgattaacaaagaactagacctcaaacaaatcagatgcatccaaagtactggagctctgcaaagctgttagatgacttataatggctggaatctgatatcagaagtttgtataaaatagattcatgaaaactaagagttggaagaaaatgcaattatattgcattaattgaaaatgcaattaatatttctaattttatgacttttaatatgtggtaatttgataaatatcataagtggacattttattatttcatccacatttctaatgtttaactatataggttaaacaaagagacaaacaacttgttgtcttgtgctcgggcacccgtggtaggtggctgatatagctggttggttttcacaaatgtaattccatctctgaatcttggtgccttcatctaggaaatgaaagtgatgaagtgcctgcttcctctctcattttcaatcatggtgctgttcaaggcagtatgctatggaaaattgtacatctacacattggctttgagtttatttaatagcataaatattattcagagaaaatacatgaaaccattaaaaatcaaccttagggctggatatataaaaaggcatgtttccccattttattcctggctcattgagttggaaagcctccttaaacaaacagacctccagaactcagcaaggcctgcccctgctcccagattctaaatgcaaaaaatgaagaatattttctttctcccatttgttgtatagatttagaatttagaagacatctcagaaggaagaaaatgatgggtggcattctgataacattatctcctcactgatgttttgttcttgctgctgttcatatggaacacagtagtaagtgttgtgtgaggaatgcaattacgtttaaaaaaggaggtgtaagaagctattatagttttgaaacacataaaggtgtctaaactcacttttctctgagttgtgttgatctgccacattagccgtccccatggattggaccatcctatgtggtccatgaaatctcccaagatatttcctgtcaaatggcctctgccactgctatatttatttatcttattctacgagactaaaaacatagttcagctatttaggtgggctctgactagctattacagtctacatataacatgattagatacatctgtggaaaggaacgcatggtgagaaaatgttttattttctctaattaatgtatagtcttcagaacagaactttgggtgttctggatttgtgtttggcccatagctgctgcttttcactggagcaggaaaataatgtttaatagctttgtttaaaggttttcgcttgttccaaacttgttgctgtagagtctatctcaatctgtgtgtatttaagaaaaaaggggaaacaggctggaagcaaaattgtgttctggtctccacccaaaacaccccctattttttttctttttttttttttgcaaaccatgaaagccttttaaaagctgctttgattagcttccacatcactccccgcaacatagagtgagatgctggtttgtggcctaggatgagagaaaggggagccgggactctcacgggacagcttggccacttgagtcttccaaacccaataggctttacttaaatcagagatgcactggaaggagaccaggggccttttgagctctttacccatcactaattctggctccagctgtactccgactcgggtgatgaaagagactgaaagcagcaggactcagcaagcattctggactggatctattcaggctgcgtttactcactttgcattatggggtttccatggcaacaggcacatgtttcagcatgttacatgtaaaggggatgtacctgacagtcttcctggtcaggaaaatcggatcatgtgccgcttcttccctggttgtctaaatgggctctaccatgagtcagtctcccttccttccatatgatacccacagagaaagatgctggaagtcagcgtccaagatcctgaaacaaccatggatcccagtggagacatctgagaatagagtctgctccaaagacagctggcatggttgcaatacatcagaaactgaggctgagtctccttccctgctcttacttggctcctggccttggctgggctttgagggccatgaaatgaaaatattttctggatattggccattgtgattgtgttccaaggactgtgatccatgagggagctggtaccaaagaaaactccatgcgtgagcctgggatattcctcccctgcgatgtctgtctattgctcatatgaccaacctgagagctgagtgtttacagtttataggatcatggagtcatattcaaagtcaatctggtttagtatattagagtatgaaaaaacatccactctctttttcttccatttgcattgaccatagtccataaaataggaccccgcatcatctaagaagttttagaaagaaagtattggttctagctgggtgtggtggctcacgcctgtaatcccagcactttgggaggctgagatgggcagattgcctgagctcaggagttcgagaccagactgggcaacatggtgaaaccctgtctctactaaaatccaaaaaaaatcagccaggcatggtggtgcctgcctgtaataccagctacttgggaggctgaggcagaagaaccgcttgaacccaggaggtggaggttgcagtgagctgagattgtgccattgcattccagcttggaaaacaagagtgaaactccttctcagaaaaaaaaaaaaaaaaaaaaaagagaaagcattggttctttctagacttctcttttactcatccccacaggagaaagttagacttctctgatagtgacaagagtctgattttc

SEQ ID NO: 326 - DNA, 47112 bp, Homo sapiens
agattatgggtaatttttttctttatattcttcttgtatttgaaaagcttaaaaaataaacattttaaattcaaaaaaaatctttaagcaattctttaaaaatattttgaaattttagaatttcagcatctgcttattataaatcaaaaggtcacataaatggcagatataatgtttctggggcagaatttttagatgcacaacttgtgttttttccctatgtcaagtacaaactttcacctgtgtttttatgagaatctaaagagaaactacaagaaaagtgtactaagttaaagtttgaaaaggcactgggtttgccagcatcctgcctgcctaatcaaacatcatgcagctccagcacagaatgcatgactgagctgcgtcagaacatgtgaggttcatgtgattggaggagctgccagcatctttccactagtgctctggggagttgtcttcaagaactaacgtcctgaaggcagaaaactcaagggtggggaatgaaaggggtctttccaaaatataaaaacttttctgagtgttctcaaaatgaagacaaagaaagaacagcttctgtgtgtgagtatgttatagtggaatgtgacatttgaaagctgttagggaaaatgccagtctggcaggctacagctgtatcccctgagaagcacaatggaaagtttaagtccaggttgaccagagcctctactttcttacactcatcaatgagacagggtgattcactggactaccctgacacagtcccctccctttcaaggctgtgtggcataaaggcagctcatctagtccccagggtgtttcagactctgtcttaggactctgaaacccccagtcagcactgtgtacttgtgagaaatacaaagtatgtattagatatgctctaccttgagtttgaggaatgtatagtgagctggagaaatacaccacaaaaaccaaagctacatgcaatcaagtgactgataagtgggaccagaccataagacccaaaggaattcagggtgggtgggagctccccatggacaggagtagcccaagagagcagggagggaaagaaaaatgcaatttgggaggccgaggctggcagatcacttgaggtcaggagttagagaccagcctggccaacatggtgaaaccccgtctctactaaaaatacaaaaattagccgggcgtggtgatgagtgcccaccagttacttgggaggctgacgcaggggaattgcttgagcctgggaggaggaacttccagtgagctgagatcacgccactgcactccagcctgggcgacagagcaagactccatctcaaaaaaaaatttttttaagtttacaaagcattttcaaatgtcttgttatactagttgagcctcactaccacctggtaaagggagtagaacaaatattcacattttatggatgaggaaacttgggcttatagaagttaagtaacttgcctaatttatcccatttctttttcagtaaagttaccagtttgggctgggcatggtggcttacacttgtaatcctagcactttgggaggctgaggcaggcagatggcttgagctcaggagttcaagaccagcctgggcaacatggcaaaaccctatctctacaaaaaatacaaaaattacccaggtgtgatggtgcacgcctgcagtcccagctactggggaggctgaggtgggaggatcgactgagcccaggaggttgaggctgcagtaagttgtgaatacaccaccacactctagcctaggaaacagaatgagaccctgtctcaaaaagaaaaaaaaaaagttaccagtttggtagcttagggagttacaagtttggtagctcatggagttgccatagacatagaatatattgatttttaatcacagcacacaacaagatgtacatttatatccttgtgagtaagtgaatatggttgagagaagaggttaggttgacaaagcaactactaaaaaattgtctttttccctctgtcttatgggtaacttggatgaaaacatagaagatgagcttataatatatgatgattaataaagtagggagagagagtcagttggatagaagagtttctatttcaaaatcccaggttgccacagtggctcacacctgtaatctcagcattttaggaggccgaggcgggcagatcacttgaggtcaggagttcaataccagcctgggcaacatagcaaaactccatctctacaaaaaatacaaagattagccaggtgtggtagtgtgtgcctgtgatccctgctaattgggaggctgaggtgggaggatcgcttgagcccgggaggttgaggctgcagtgagccaagattgtaccactgcactccagcctgtacaacagcatgacgccctgcctcaaaaaataaaaataaaaaataaaaaaattaagtcccaggttgaatcacgaggtcaaaaccaaagaggtagaatgaaaggtcctgcttttgatccacacacctaagatggaagagcagtttattagcagttaatatgaaaaagttctggggatttaatagaaaagaatttaaacagtatcatactcataaactacaaatgtgccctaagtacaaatgcaggttgaattgaaatccaattgcttaaaaactaaggaggttgggcatggtggttcatgcctataatcccagcccattaagaggccaaggcaggtggatcacttgagcccaggagtttgagaccagcctgggcaacatggcgaaactgcgtctctataaaaaatacaaaaattagctgggcgtgatggcgcacacttgtagtcccgatactagggaggcttaggtaggaggatcacctgagcccaaggagatcaaagctgcaatgggccatgacctcaccactgcactccagcctaggcaacaaagtgagaccctgtctcaaaacaaaacaaaaacactaaggagaacttcagcagtgttgacaggacactgttcagaactgggaacaaatagtcctatggaacctactatgtctaggccagcctacctctagaatattttgttctattctgggcccgacttgttaattgggacatgaataaatgagagtagatctagagggaagcacccaagatggcaatcgggcttgaagccacccctagactaggaatattggaagaagctgggcgcatttctcctggagaagaattatcaagggaagacatgagagccaagatcaatgggtgcaagttacattgaagaagaatttggcccagaaatggaaagaattcactaacaactagagctgttcatcaaaggttaacctcctggttcctggatatatctacatagcctggagctaccatttttcaggatactctggaaagtattcttcccttaggtgatgaattacaaatcttcttactctaagatcccataattcttcaaactagacacttaactcctatgagcctcagtttcctgagaagactaaaatgaaatggcttgtaaatccccttccagctctaactttctatgaagtacttggtcctaaagggtaccctcgtttatgtttcacagagataccagaaacaggagtcttttatcttcaacttgactctcaagatgttatcctcaagtgaacttttttctaccagctgaaatatgtccttaaaatctttgagtcaatgaatcatgaaatgagccaggttttcaaatctcatttgtagggttccttaagaactatgtccacttgccacattcttttctgaatattattctttttttcttcaaccctgttttttaacccaaacatcctgttttcaaacatcctgttttcaaccctctttgtatctaaggatggaacaaggctgatgacacagacaagaaacttgtaaaacatagcaagtatctgccttttatttggtgaataatgtcaggactagagaagggctgatgtgaaattctgggctgggctttaaggctttaaggcatagttttgcctcaaagaattgcctccacacaggacaagtcactgtaagcaaagtatgtggctgcatctggacatgacaggaggtgagctgggaagtccctgccctttccctgcacatgcacttaccccatttctccatctttctacctcaacacttcaccttcagagataatttctttcaggcctcaaagcatttttagactttaagttcttttgttgctgtttattagctcaaccagggccatgtaccagaacctgggggaaagggccatttctatggaaatggagatagggtccaggcctatcctgagaaagtgcaatcatgaggagaccatcctgttctttctcatgtattttatcattcatttggtactaagcactgtactaggcaccaagatagatagtaaaacatcagccttgtcttcaaagggtttgcagatcacagaagccctctctctctctcatcttttacatagatgatatcctatataacaagaagagatgtcacaggatgactaaaacaggcaaagcagctggaatatgtgtgtggctggggcagcccatgacagggccttaaccctagtaatgacgctgacagctttagtcactgaggggagtggccagaacctgctggtttggtcaatgggggacaacaatcaagtaagggaaaagtgatcttataaggactggagggaagtcaacagaaaatctcagccaagtgccatacatttttttctatagagttctatattttctggaactcatatacagaattaagtaagagtcaccctgggctatattggtaagggcaaagagctggaatttcttacaactttattttgaagcctcaagcagcggaaggcagatggaagaagtaacatgtggtggtggttctcagaatttttaccacccccaaaacatggaagataattcctcactctccggtcagtaacaaccactgacttctgcaaagattcacagccatttggggtacatatcagaatatcatggagaagcaggaagtggggagcaatttcataaagcttcctacttgagtctaatataaccctttcctacctgccctgagatctataggtagcttgcctgagttgaatccagctctgccattaaccagctgcatgactacagacaagtcgttctctttgaaccttagtttcctcatacataaaataacgaaccttacctggcagtgttattgagaggaactacagaacctatcacagttagtatatagcaatatagccagatctttttttttttgtttttgagacagagtctcactgtgttgcccaggctggagtgtagtggcacgctcttggctcactgcaacctctaccttgcaggctcaagcgattttcttgcctcagcctcccaagtagctgggataaagacacccaccaccaagcccagctaatttttgtatttttagtagatatggggtttcacagtgttggccaggctggtctcaaactcttgacctcaagtgatccgcctgtctcgtcctcccaaagtgctcggattataggcatgagccactgcgcctagcccataaagctagatcttaatgagcaattagctactagtacaataatttgttttaaaagctatattataggataacagagtctactcagtcagcctttatgcaaaagtgaaaatcttgggattctcagaaatatgctctcaacagtaaatgccctatgtaacaaggtgcaccagcttaggctggggccattgggcccataaaatcttcattgttaaagttaagaagttgggtacaaggacagagaaaagctactattcccaagttgccaaattaaaaaaattacctatctggaaggtaaattttttttaccccttaacagatctttaagtgtataatagaagggagattcaaaatttacatttgaaactgattgtttgaggggaaaaaatctaaataaaaattttaacaatcatataaatataaagccaagatcttaatctggaatgggaaggttaagaccattcattaattcaacaaatatttactgagcagccctgagactgttttccttggggtctgggaaggggagccatggtcaatggactcttgttatctgtaggaatattgatccctaccacaaggtacagggacagggaataaaggggagatagtcctcctatgagataaaggtaggggatgttctacagggcccagttttatatttttcttttctgccttgttatttcttctcatgattttctttcagtaaaatctctttcccacatctctttcagtaaaattttgttaaatgatagtcttgttctctgttttggggaattacaagatggactcttaatggggctctattagtagatggtaagaattcctgggaatttccagaaattctttgggaaaagtcagagactaatcttctcacagttacataaggggatgaagctgaaagttatttgggcattaattagaagtgtggcccactgaaggctggtgaaatctggacacctctgctatacatggtccttgtggatggtttgaatgatattcccaaattggctgggcacattcccatgatatcaggccgatgggcattaaaaatgcaaattagttcacatgctggggtacaatgccctgaaccagctgactttaatggactgcagattgccaatccaaggctatgttctttcattcctttccttgccttacttacttatcattcatccttcccctaagttctcttgggcctattgcccaaataaaagtgaagaagaaattaacacatatgaaagcgtgctatgctaagtaccatgtggggtgtgttttgcatgaattattttacttaaccccttacaacaccttggcaagataggcaggattatccccattttattgatgagaaatgaaagctgagagtcctatctcccaagtaacacagccaggtattataacagtcctggggtccacatacaggcttacataactccaaagttctttacatcataccaccaagaaaaatgtattttaagattcacctaattaaaacataattaagaagaacaatgtattgggagagatgcttactgtttctaagcaaacatacgtgattgcctatcaatgaacaatgacctcaagctgtaactcaaaccggagctgcagggggctcagattcaaacacttcctctccacttacaaaactgccacaaaggaaaatgaaatggtaaaaggcagtttctgccaaatcttggcaaaaccagctaaactttcttggtcagtgggagtagaaggggtgatatctctctgtcctgaggaatcaaaaagttgcctaccaggttaatacataatacaaatctgacatttcaaacacaagttgttttacatatctgggctcaacagtttaagtttacaaaatatccccacccatccaaaatcatgtgtccatataaaggcacatctgtggtctacagttggataattcacagccctcttatctagcactggtcattagaaattagggcggctgtgttacacaaccatgcagatggtgccccctagtgttgcacaatgacaaagccctgaaagcaaccacctgaaagcacaatctagacgggtgcttctcaaacggactgtggtaaaaaattgttgttactttgtttttttcaacctccaatccttcacagaccaatacttttaaaagctataataaaaataatttagcagaaaaattaaataagtaaaggtattacaaatagaagacttaatctttttaaccattagattcaatagacttaaaattattctgtgaaattgctctaaagtttctacactcagttcctttgcagaccaggaacaacagtttgtggatgggcacgaatgcacagatcacgctttgacaaacactatactgcttcactttttttctttcttttttttttttttgagacaaagtctcactctgtcgcccaggctggagtgcagtggcgcgatcttggctcattgcaacctccgcctcccgggttcaagccattctcctgcctcagcctcccaagtagctggaattacaggtttgtgccaccactcccagctaaatttgtatatttagtagagacggggtttcaccatgttagtcaggctgatctcaaactcctgacttcaggtgatccgcccgcctcggcctcccaaagtgctgggattacaagcatgagccaccacacctggcccattgcttcactttcagttacaaagacttaccatgggttccttctaaggtacattgaaccacttgaccctcaatgtggtgtccacctatcaattaactacaaattctttctttcctctttttttttttttttttttaactcaagcaacccacaggccggtttaaagtggtctttaattactgaagactttcccttatttaaagaaataggggaaacttggaggtctagattagatttctttccaacggttgctatgtaactttgtgacatttgaaagattaaagttgcttctgacggcactacagtagaacctcaatatttgcatgtttcttccttaaatttcccctttccctgacactgtacatacactttctaaaatttgttttttaatttttacttttcacttttcaatttttaaggaaatagagatggggtttcaccatgttgcccaggctggtctcaaactcctgggctcaagcgatccactcgccccagcctcccaaagtgcctggcccctgtaggtacactgttaacagaatcagataccagtaggaaaatggtaaaaagagaatatgtaagcagagataccaatttgtggtaagcattcaaattggttcttatgtagtcctattgtggaatttgatttaaaagccaaaacagacatcactatatgtcccctttatatctttccttcatcatccttgttttgtggtaatatgcttctctatcatccattgataatagaattacaacattatggattttctatgctgatttatcagaaatagattggggtaatggtgttatttctcttctgttttccctcccacaaagtttccctctgtgcacctcaaacttactctttaacctaatcttcttttgagggaaattactcaatggtttttagggaatcaactgagctctgacctcagggatccaccaaaatcagccagcccttcactcagtcaagttcaataattattttccacaggtgctaaaaccccagttgaacctggatattttcccccttaatatcccctttagagaaaaagaatcagagaatcccacatgtagaggagtgagcagataacagaaaccctgaagccttccagatttaactgttcctgctgttccaatgagccacctgaggccacagcgggagaagatttaacacaggaaagacagtggcttttacgggctttggagaagggccagggtctcaagggagatcagaaagtgtgtagaaagccctgtcgttactaggaaaatgcaggtatcagtgcctgacagacagtaggtgctcaatatatacattatataaccgaatggtacagtgaattggcaaaagaaaaaaagcagaaaagatgaaagtgaagctaggacaggtagagatgggattacctttctttcctcctagcatcttttttaagggttatttctttttattttccagctgccccagggtgattttcagtcactatctccaggctgaagccttcttgatcattcctttttccaaccttagtgatagctagcctaggaatgctacaactcccaggtggagattcaggttaagcgagactgggtcgtaagaaaaaaagatggagagaaaaggaaagggaagcagaggagtctgcattctgcattctcttccttccgttttaattttgccagttgttatgggcaagttaaattcttctcatgtctctgtttttcataactgggaattatagttaatataactgaggcacaactgatagtagatctgtgaaagcataaagggaaatatagtgttcagcaatatctaaggaatatgcttcaaagcaaacctttgcttcttaccaggtgtcacctaaaccagcgctactcacactttgatgtgcaacataatacacctagagatctcattaacatgcaggtactgattcagtaggtcttggatggggcccaatattctgcaattctaacagttgcctggtgatatggtttggatgtttgtcccctccaaatctcgttgagatgtaatcccccgtgtttgaggtggggcctgggtgggaggtgtttggatcataggagtagaaccctcatgaatgtcttagtgccatcctctcggtggtgagttcttactctgagttcttgctcacccataaaaatccctaaactatgtacgaggcttggagaacttctgggttggtgaacacattcacatgccaggagggtgatgcaccccaactctaaggggagtggcggcccttccggaccttgctctgtgtacttgttcatctggttgttcatctgtatcctttacaataaaccagtaaatgttaagttaaagcatctgagttctatgagccattatagcaaattattgaatgtaaggaaggggtcttgggaatgcccaacttgtagccaagtttgacagaagcgtgagtaacctgggactcaccatttgtgactgacatctgaagtgggagaagtcttgtggaacagagcccttaacctgtggggtctgatgctgatcccaggtagacagggtcagaagtgagtgaattgaattgaaggacatccagctggtgtctggagagctggagaactggttgttggtgtggaaaaacaaaatacgtttggtatcagcagtattgtgggtagagtgatacagtttttgttttaggctgaatttggaaacccaaatggataggcaatcttgatacaatcttttcaatggggctgatttgattgcttttctttttttctttttttgagacaaggtctcactatattgcccaggctggcctcgaactcctggactcaagcaatccttctgcctcagccttccaaagtgctgggactataggcatgagccacagtgcccagccctgatctgcttttcaagaattcctcagttgttgccatgtaactgtctctctgacaagactgtaagcttccaggagttgggatcaagacttagccacttgcacctctctgggactgtgggatgctgtgtgaaatgtagtaggtactggatttgcagggagttttcagctgtcaagggccttggtaaaataaggaagtgcaaggggccaataattcttggctaaaatatccagaatttcactctgggactgtaaaagagattcctctgagaaacttgctaatatcttgcaaaacctcaatccaggttttgtcttcttacatcaccttgttctcatttaggtcagtttctgaagatgcaactgtggttttgcagtaaggggaactgagaatcttgaatactgcatgttatcacgtgacttcaggatgaaatatcattcaaaacaaaacataaattaaacgtattcacacagagagaaaaagcaaagcctaaattaaatacattcacacatagagaaaacagagtatggtaagatatccaaatttccaaatttccatttttctctttgaagaatttaatcctagatctccatagcctcaggtccagtatagcaaacagctgggaagctgtttgacagcactttgggcctagtatcttggatcttttcatctaagagattgtctacttatctaggaccagacttgctcagagtgatgtggaatcattttcgaaaagaatagagataaggtctttctgacacatcatgaaatttaacactgatgaccacccaaggacctatgctagagtcaagatttggggccaggcatggtgactcacgcttgtaatcccagaactttgggaggccgaggcaggaggatcacttgagcccaagggttcaagactaccctggacaacacaaaccctcatctctgaaaagataaaaattagccggcatggtggtcacacctatagtccctgctactcaggaggctgaggcgggaagattgcttgagcctgggtggttgaggctgcagtgagccatgatcacactactatactccagcctggggaacagagtgaaaccctgtgttggggggacaaaaaaactgaattgggtaattgcaaaatttttctttttaaggcaataaaaaaatactgacttcatgtatttattccctgggttatttctggaaggcagtcaagctagttaatttattttcctttttaaagaaaataagccaaaataaaccaaaagaaaaagaaaaagaatataagccaaatagcaaacattaatttttttcagatttcaattgtttaaaatgcatgttcatttttgaaaaatttagaaagcataaaagagttcaaaaaagaaggatccctccaaatgtcaccaactaggcacaatcttacagataatcttgctatagtttttcaaatcttagagaaaatcaacacatgaaaaactgtgttcatatattcaccaggtgaaccaaatgcaagctatactcttatactctgtggaccaggggaacaagacaagtaaaaaaatccagaaatcttacatgtcaaaataaaaattaaggatatatgtaaaaattggtaattactttaaatgaatgagagttcacacttcataatctcacatgactagatttttaaaaatagattgaaaagttttgatgcacttgtttgatgtttctacatcttggaggaaagctgaaagcacttgatactggtggtgtatagacacacacctactccaatccacctggagaagttagagaaaccccagaacatgatttatcaagtaattcagtatcatttttttgaaaaagtttggctggaaaatttcttacttacaataccagttataagacatttcttctggctgtccacaacattttccttcttacatagctcctctttcttaacctctttacctggttctcagaagaaatctgcagtgatctaactaactctgataaccacataacgggcagatgaatttattaccatatggtatggaactgctttaaagctgagttctgaagtttgatttaaatatctaagtttgagtcaatatgtgtgccttggcatgtaaaaataacagcaacaacaacaaacactttttgtaaagttcttaccatgtgtcaggcactattctatgtgctttataaatactaacttatttaatctttataacataatcctcctatgagctagataccattattgtccccagtttacatataaggcacagagagtaatttgcccgaagtcacagagcttgtaagtagcaaagccaggctaagagcacagcagtctgtctccagagtccatacctctaatacacatgactgtctcatccagcaatctatttctccagttgaaaaattacattgattcctcctactcaccctcctccctcaaaatacctacttctgtaattaaatgccacatcaataaagcatattctctaacaacccccttaggtccatggaagaagctggctatttgccaatgaagccttgttcactccccatctggaaaggcctggtggcaagtaagattcatgttactcaagggaggaaggggagttttcctgttcatttagcataaagagtctcttaagtcaaaaaatttccttcctcctctttccagtgtcaccagtcacacgtgagaaagtcatctcggtatcaacttcacatgatctgcctcaaacaaagacagttcatgtgctcttgatatagcatttcttgcttcaacttcactgctaactgcatgtttcatctacagggagagtttacagaaattagcatgaattatataaactctgatacttggtgatgtagatagatctcatcagctttcattttctttgctgggagtgtaatcaacatgattaaagcaaagaaagaaactctcaagtcattgtattaactattctgttctctggatgagacaacataaaaccttgggatagtagagctggaacagaaatccaacatcatcccccacatttcacagataaggaaacagagtcccagagggaatttgtgatgtacatgataacacaactaatttgtgactttaaaaaaactcctttttggtttatttttaagaaaaagaatagaaattaactaaccatatagaaatagcttatggaataaggttcatgtggagccaccattttttattgtcttacacagaggtaactgcaattattacaccccaccacactcacccagtggcaggccaactagggccctagggcttacacagccccatgaaaagggaggagggcctggtctttggtccctcaggtcattgggctggtcctttggaatttggtaggccctactgcccttggcagactgcagagatgctcccacaaagttctctcttttgaccacaggtcctccacaaggaattcttgccactgctttgggggccagagcactcaggccaggccaccacagacatctacctatgcctctcccactgcaagtgtcatagtctttggaaaactatgcaaaagtgtgataacatcccaaagccttatagaacctactgcaaacctgttcccccaagtccctatccaggacagtctcaggcattctcctttccgttagggtcaggccacttcctttcgtcttctcctccaaactccagttcttaccatcacagagactttctaaagcaaaggttgtaatgcatttctgagactaggaagccctcaccacccagacataaagcctgagctaataatctctctgtttcagggagagactatagcagaaaacagagattcctgttatcctgaaccaattatttgtataactgtatgtttaatacctgattctctttggagtaaaaatttcatgaattgagtattaggattacgttaaggttgcagttggctttaggatccctctgtcttattcacttttgcatccctgtgccagttcaaggcctgataaataacagccactcaatacatatttgcagagcaaagagagaaagagagggaggggagggagagagagtgggaaagactaaccaaagttctgcaatggcccacagaaatatgagtatgagttaaggcaatctcaaaggagatagagaaaaagggatgggaatgaagatgaaaactattaagaattaataatctacagggcttgataagaaatttgatgtggatgatgtggaagagaccagtcaaggataattctgagatgtgttaattgatccacctgaatgtgatgtgggcttgtgagaggaagatggggtttggttttgttggtaaaggatggtgaatggtggaggggttatggacaatgaatccagttcaggaaatatttgtgggtctcactgttttaagtatatgtgaacaggaatatcagaatgaaactgtgaagtgggtgaagttatcttcagaaactccctttcatttaggccccatttcacatatcaagggatatcacatatccctaattatctgccctaatttcctatcaagaagtgatctgatgatctcacttacataaaaggtaaactactgatgaaataggagatagctctcaggctgtgttttaatgttaataatggagcacagccacaagccaaaagaatgataagagcactactaataagagtcagtgcttatatggcccttaacatgtggcaggcacttaatgcccttagcaacaccatgaggaactattttatatatgaggaaagtgaggcactgaaaggttgtgacttgtccaatgtcaacagctaataagtaatggagtggaaaatacaacctagcattgtggctatacaatccatgcttttaaccatgatgctaggaaataaatgtgtaagggtgaaaattttaagaagagtggaaatgtgcagtaaattttgtgggggtccctcagcaagattcagatcactccagtctcataatgaagactatacaggtcactcaagtctcactctactaactgagtgttagtagtgttactaatgacatagactctgccaatgactgactttagacaacttaatctctttctgtttcattttcctcatacataaaataaggagaaataacctacatacaaggttattccttaaagcaacatttgtaaaagtaagtgactggaaacaacctaaatgtctgttgatagaaggctggctaaaaattgtgcacctataaaatggaatataatgcagccataaaaagtaataagattaaattatttcaaacaaaagaacagcctgaaaaaatcaagttgcaggcatagataagggaagttgctcaagagataagggggcttgactaagacatcccctcagctgcatagataagaaagactatacaggagacttgcccagacatacctgcaatggaaaattctgtcccctgacacatgtgcagtaagggaaacgaagcaacatggagtaattcaagctaagagcccacatccacactaggaagatggggtggaattaccagaaatgcacaccttatgcaaatgatatgaccagccccctatccgtttcttataaaagcctccgtatccaaactgtgaattggcaacctatctttccaggatccctctctgtagcagagagctattctcattctttcacctattaaatttctgctctaaacccgaaaaaaaaaaggtaataagaaagacccctacatactgctatagaatgatctctaggatatactattatgtgggataaaaaacaactacagtgcagaacaggacatataatatactacaatttgcacaagaaaggataaatggactagatatattcctttatgctcatattgcataaatacaggaaacttctaaaattggttgcttcaagaggagaactgaattggcgtgggacagagaagtgaggaaggagaacgtaccagttaggatctcagcaggaaatatatggcatattcaaaaggcgtcatcgaggagttgagtgacagaattatttacaaagttgtggacagggctaaggcacccaacaaaggatgctgacactttccaatgggcaacctacagaggggaatcattatcatacctaagtcctaaggatgaagaaggggagtaagtggttacttgaatccagagagagagagctataggtataaaaggggctacgggacagaagccatagctctttcctagatgaagtcagccactgttcatccatagcccagcagggaaggcactgggggaataaatagcctcaccacattctccttctgcacttggatctctggacatccttagggatgagcctcttggggctcaaggcagagtggagagtagatctgaaggcatacagagagaatatccactgcacagactgtacagcatttttactttgtaaacttagaactatataaatatgtaacttatttgaaaagtagaaaatggcggggcccagtggctcaaagtgctagcttgtaatcctagcacattgggaagccgaggcgggctgatcatctgaggtcaggagtacaagacaaacacggtgaaacctcatctctactaaagatacaaaatagccagggcgggtggcaggcgcctgtaattccagttactcgggaggctgaggcagaagaatcgcgtgaacctgggaggcggaggttgcagggagccgagatggcgccattgcactccagcccgagcaacaaaagctaaactccggaaaaaaaaaaaagaaagaaaggaaaagaaaagacaagaaaagagaagagaagaagaaaattttgcacacacaaaagataaattaaaaagtaaaacggaaatgagggaccagagcgtatgctttccaagtctcctccctcttcaaattctacctctgtttcgttggagctgcagtttttcacctaatcacagtccatggctccccctagtgtcaaggcgacgcttcaccaagctctaagaaccatctaattctaggggaattctggggcagtcgggcggcctctgcctcaaatcactgatgtgtaagcagttttcactgtgaattacacccacctggtaaatgatcgtatcccctgaaagaaaaaaatacattattatgattattattattattattattattatttgagatggcgtctcgctctgtcgcccaggctgaagtggtgcaatctcagctcactgcaacctccacctccctggttcaagcgattctcctgcctcagccttccgcgtagctgggattacaggtgcctgccaccatgcgcaggtaatttttgtatttttagtagagacggggtttcaccatgttgggcaggctggtctcgaactcctgacctcaagtgatccacccaccttggcctcccagggtgctgggatttacaggagtgagccaccacgcccagccaaaattaattattctgagacatagactagttatcattttaagctatagcggaaatttatctaaattaaatttggaactaagtaattatctttttcccatatttcaaattattaaataaatttagaggtaaacagcatgtgatctacaactctaaatctgcaagcccacttttgagctttttactccctagtccatttgtccttaatgcagtgattctcagccctggctacaaaataatgtcccctggggagaaagctcctactggagactctaatataatctgtctggggagggacttaatatcaatatatattttctaacctcccagttgttgtaatgggcaatcaaggctagaagcccctacttaagtgattccttgctgcctactaggtagattttgattcctagtacatttcttgtcactactcaggatgtgctcactctgctttagacaaactgggttacttgtaaaacaatttcccaccctctgtgcccttacataccacactctccgccttgaacactctgtcacctgcctccatctcaactgtcatagttctacatattattacagggcctgcttgaaggctacctcctctgagaatttccctgcccctcattcccaaacagatgtttctacctcctttgaacccctgaagatttttaaaataacttttatgatcaatcttcttttcttaatagaaaataaacacagtgattgactattctttttaacttatcaaatgaacaataacaacaaagtatgatatttctgtgagagaaatgagcactccctgtattaacaagggaataaattggtgttatggcttttaaaaacttaatctggcactaaatgtcaaaatatattctgtttggcccagcgttttcactcctaggaatttatcctatggatataatcacatgagtgggcaaaaatacccataatggaatgctcattgcagcattgttcataaaagcaaaagatgggaaacaactgaaatgtctcattaatagaagacaagttaaataaattatggcacataatatagatggaatgctgcatagtcattttagaaatgaggtatatctgtatttgtgaccatagaacaattctaagacatagcattaagtagaaaaaaaaagatccaatacaatgtcatagaatgcttctactgtgttttgtataaaagcacaaatatacatttgtctgtgcttccaaagcactaggtatctttggatggatatacaagcaactgtcaacaacaactgactctagggaagcaaactagtaggtttgaggtaacaacattacagaataaaaaccatgaccccatcaccaaatataagaattagaatattaccaatacctttacatatacccagagtcataggtagcccatccagagcctctgtgcaaattagaaaaaaagctcctcttctttgggttggacacaactctaaaccaaggtgccttgcttgccaaacagaacacaggctatattaattacatgacccacttctgccctggtgtgctttcagacttatgtaaatggaattctactgtatatattatcctacaaattatcttttttacttaacattatgtttgtaagatatatcaatattgttacatgtagtactccattttcactgctgtgtaatatttctttgcatgtttacgtgctaaaagaattaactctatatcccactatttcagttacagggtatctattgaagggtgaatgtgactaaactaaaagagaaatgtagatcacataaagatggataaaggaactctggatcttattttgggtcagggaaagccagtgtgctttcatttgatgagaaataattgcattatattaggcaagagtgagctggtaaaggagtgagcacaacagtaaatgtctggtgtccatgcagtgaatattttacattcacttattttctctatggcattttctgtcctttaataagctttttcactttaataatgtggaaaatacagtaatagtgacaatccatgcctatttaagtaatgggagcacaatatgtgagcttactagagaacggctatgactgaaatggactctacatcttttcatttggacttacatgcaatttcaatgtcttttgctagcagatgaatgtgaattcattgcagtggattttttattcagatacagaatattcggtgcaatttttctaagtcactatagtcaattttcagataacaaaaagtccaataacttctaaaatagaagagagaaaaatggaaaaagaaaacaaacttacaaacaaaagcccaaccccaatcaactgagtagagagcaataaaggaaaagggggaaagccaaataaaagttggacaaataaaaattaaaagtgtggtggtagaaaatgtctagatatattaataattataataaatataaatctaaactttatagtaaaagacagattggggaacaaacaaacaaaaaacctctaactacatgctctttcaaaagaaaaacctaaaacttaagacacaaaatggttgaaagatgtagcaggaaaacagtaaccaaaaaaacagaagtgtatattaaaaatcacacaaaatagactgatgaaaataggtatcgttagagttagagagggaccactacttgatttttataaacgttccaattgtcagtgatataataacttcaaagttttacacctagaaaaattgtttcaaatatataaagcaaatatttactgaactacaaagagaaattgccaatgagagctttcaatatatctctctcaattaccaacagaccacccaaagcaaagatattaaaaatatggaagatctgaacaacacaattaataacaatcaaatagataaaaattctgcatccaacagttggcaaatgcacttatttttcttaaatatcatagtgcaattacaaaaattgtccatttattagaccatatggcaagtctcacaaaattataacacagtcctcattctctgtgcgcaaagtaattaagttagaggcaataacaaaagataaatctataaaagttcttatatattgaaaaatgtggaaacacacttgtaggtaattcatgtgtcaaagaaaaaattatggaagaaatgtaaaaatcctaaaagccgaatgataatgaaaatatcacctaccatgttctgtaaaacagtcaaagtcattctctaaggacaatttattaatttgaaagcttgtttcagacaagaagaaaggttaaaaattaatgagctttgtgttcaactcaagaaattaggaggaaaaatagaaaaacaatcaaagtaggaggaaatagataacagagataaaaacagaggttcagaaaaaagtaaacaaagctacaaaaaaagaatccacaaaattaaaagttttattttataaacagaacaatctctgctgagattgagcgaggaaaaaaaaagaaggcacaaataagcaatattagaataaaaagggacctaatcacagacaaggcaaagatttttttagatgagctactctgaatcaatttaggccacatattcaaaaacttaggtgaaatgggcaaattcctagaaaactataatttaccaaaacttactcaaaaacagagaacctgaattgttttgtatctaccaaagaaatgcaatcaatatttttaaatcttcccacaaagaaaatatttagttcagatatgtttacaaattacttacacctaggtttcaagaacgagatcattccaatctttaaaaatgtcctataaaacagaaaaagagggactatgacacaattcactcaatgatattaacgtaaccttgatagcaaaaccaaagaaggacaggacaataaagaaaccttttgaaccaatctcactcataaacatagctacaaattcaaattaaatactaatgaaacaagcttaggagtttatttcaaatagataatacatcataaacaagttgagtttaaccagaaatgcaagcgcagttaaacattaggaaataaaaaatatggctaggcatggtggctcacacctgtagccccagtgccttgagaggccaaggtgggtgaattacttgagcccaagagttagagaccaaccggggcaacatggtaaaaccccgtctctaccaaaaaaaatacaaaaattagccaggcttggtagcacatgcctgtagtcccagctacttgggaggctgaggtgagagaatcacttgagcctggaagtgaaggttacagtgagccaagatggcaccactgccctccagcctgggcaacagagcaagaccctgtctcaaaataataataataataataataaagaaaagaaaatataaaaatataattcattggccaggcacagtggctcatgcctgaaatcccagcactttgggaggccaaggcaggtaaatcacctgaggtcaggagtttgagaccagcctgaccaacatggtgaaaccctttctctgctaaaaatacaaaaattagccaggtgtggtggcacacacctgtaatcccagctactcgggaggctgaggcacgagaatcgcttgaatccaggaggcagagtttgcagcgagctgagatcgcaccattgcactccagcctaggcagcaagagtgaaacaccatctcaaaaaccaaacaaacaaacaaacaaacaaaaatatatatatatatgtaaaatttaccgcattaacagactacaggggaaaaatatgataatctcaaaagatgcagcagataatgagcagacttattaaaatcaggaacaagacttagaagtcctatttacttctactcaacattatagtggattttctaagtgcattaagacaagaaaaagcagcaacaagtacaaagattgggaacagcaataaaaggtaggagtattggaatatacttcattcataaggatataattctctaaacagaaagtcccacaaaatctacaggcaaattcttggtaataataacagagctggccaggtgtgtggctcacgcctgtaatcccagcactttgggaggtcgaggagggcagatcacctgaagtcaggagttccagaccaacctgatcaacatggagaaaccccatctctactaaaaatacaaaattagccaggcgtggcagcactcgcctgtaattctagctactcaggaggctgagacagaagaatcgcttgaacccgggaggcaggggttgcggtgagccaagatcatgccattgcacttccagcctgagcaacaagagcaaaactctgtctcaaaaataaataataatttaacaataacagagctaaccaacatggctgaatagaagaccaatacgcacaaccaaatatatttctaagcattggcaacaaacagaaaatttaaaaagtataaaagcagtttaccatatgatatggtttggctatgtccccacccaaatctcatcttgaactgtaactcccatcatttccacatgtcttgggagggactcggtgggaggtaattgaatcacggggttgggtcttttctgtgctgttcttatgagagtaaatatcacgagatctgatggttttataagggggaattcctctacacaagctttccttacctgctgccatgtaagacatgactttgctcctcctttgccttctgccatgattgtgaggcctcccgagccacgtggaactgtgagtctatgaaacctcttgttctttatcaattacccagtctctggtatgtctttattagcagcataaaagactaatacaccataacaacaaaaaagtataaattacatctaatgaagttataggagacctatatggaataaattctaaaactctatttgataaacatcagagaagatctactatagaaataaataaaagacgacattcaaaacgaagactttctattgtgaagttaccagtttttcccaatttgacctacagattcagtgtaatttgatgccaaatcacactttttttcccaagaaactaagaagctgattctaaaattcctatggatgaacaaaggtcaaaaatataacaaagactcttttggagaagaacaaggtaggaggtatgctttatcctgtttgaggactttgattacaaagttaattaagagagtggtattaacgctgcaatacacaaatgggttaatggtatagtagagacttgggaaacagagccacacatatttggacatcatatataacagaggtggtattgtatataatcaagaaagggagaattagtcaataagtggtgctgggagaatatggggaaaaatgaaactggattcctacccaacatgatacgtaagtcaattctagatgcatgcaagacttggatgtgaaagctgatattttaaacatctataggataatatctttagtttcctggggtaaagaaaacacatacaaaacaaaaacaggcttgtctgaaactgagaacacaaaacaccccaaaaaacttatctaaaactgaagagattaacaaatttgactttctatttttcaaaatactccaaacaagaatttgtagacaagcgacaagccagtagtagatatttgctatatataactagtggtacgcccatacatgttttaaaaacctagctttgcagagatgaaaaaagccatgatttgttgggtttgattcttttcaaggtggaaaagtttatttcaagccaccaacatgatgttgctaaacatgaagttaggaagacatacacaaaatctctcagacgagtctacacaagccagctccagtacaccactgcatataacactaaaggatttgtttccagaatgcatgaagaactctttctatttatcaataattaaatgacaaacaatgccacaaaaaagggaggcatgaatagtcattttgcaaaagaggaaatatgaatgaagaaaaaatacatgaaaagattctctacttcacagtgatcatataaatgtaaattaagattataatgagtaaacatattatactctcctgatgaactaaagttaagtattactgctgggtgcagtggtggatgtctgtagtcccagttacttaggaggctgaagtaggagaatcacttgagcccaggagtttgactctaacctgagcaacatagtgagaccctgtctctaaaaaacatttaaaaagaaatattactatattaatttttcccaaagacagatcaacgggaactcttaaacaatgctggtgtgaacataaattggcacaaccaccctggaataggatttggcattatcttacaaagttaagtactgtacattctacaatccagcaatatgtaagctcaggtatatattgtagaggaatgcttgcacaagtgcaccagaaaatatgaacatgaatatgcacagtagcactttttgttaaaaacataacaacccaaatgtaatcagtcaaggtttgttcatagaagtagaactactaagataaattgacaaaacggatttagagacttgactgtatgcaattgtggaagctggttatactctctaggggaggctgttgtttctgtgtctagtgctggagctgaagttcacaggaccagtggtcaggaggtagagagcaggaagcgaggacaaactggaatccatgaggatggactggaatctgcattggtctctcaccacctccaaacctctggtggaggaggagttaaacacacctctgacccaagagttagagaagctgaagcataagatccacaggagctggaggagctatggaccctgcacctacctcctgagtgttaggaaatacagctaatttcttcactttcactttccacatcaggcagaaaatgtctctccaggttcatctagtctattttcatatgagaagtttaagaggcccagagaagtgaagtgacttgttacctagaagcctgtttttaaaaaaaaaaaaagtcttatgcatctgaaactcttcgtaagagagtgcacgtcagtatttttgatctaggtacaggctgtccgagggatattcttgactcatgttcttttgccagttgcctctgattatatcacataagagggcttaggcagctttgcaataatagttctactaattattctccaaaggaaattcctcattccactgcaaatagatgtgatcttaagactgatttcccccagaatcactacaatatactcttatctaaatttgagcacagcatctaaatattcattttatttaaatgtgaattgctgcattcgagctaaggccgagttctccatacgagatccaaatttggtaccaatttggtaaccataatccatggttactctgtgactactaatctgggggaaaaagaaaacactctttggcagaagaggataagtacattcctaattttcatttccagattcttagccactcatccaggatgaatgttaaaaccattatcaaaacatagccttagaaataaaattgttagggagataataataactctttgtcaatgaatttattttgagcaataataatacaacaaagttccagtactgcgaaaaagtttggctaatctcaagaacattatagcatatgcaacttgaagtaatttctttatctaaaaatattgggccaaaagaaactaattagagtttaatgtaattttatattaagtgtcttgctgtggttttaagattttcagtaatatactttattttaaatcatctcagtgatttaaaagagtaacacttttaaatgataaaaaaattttaatcatttatcattttaaatgataaaaataaattttgagtgggaaacccttttcataaagaaaaaagaaaaaaagaaatttttatcatttttagtttcacaaaataacaaattggaaggtaataatgtaaatttgtaagcttttcgctgcaaaaaactgtcataaaaatctttagatggtgtgtttcattactgactttaaaataaaatttaatataaaaatataattcatagctaactttttctgaaatgtgtttctttttttacaaagtgagatgtatcagtacttctttcgtttctatgcaataatattgtcactctcccttttcttttttattaactgatttggactctatttctaagatagcgtataacaaaatgcccccaaaacccacaactcacaattttatggatactctacctattgggatatattccaatatggttatcatgtagaaacctcaaaagagaaaggctaacttcctcctgtaaaggagtgatcattaccaccaccaatcaattgaacaaagccacttccacacagtcaataagctgctttgactttttcttgttctcacttttctgggtctagacttggggagttaaagtgttaaggtctatgtactttggccatgggtaactgccacaaattgggttctcagtgaagcacagtctggacagagattggggtgaaggaattttattagggagtgttcttgggatcaaaccagtccactgcctggtcttaggacaatagtaaagaggggaatagcgccctcccccacaggccaagggaagacaaaattagcaggatgtaagatctagctattcttccccatgtggagattctccttccagtgaactttggagaaccgtttatttttattaagaaaggcaacattttttgacatgtacaaagcactttcctatatttttattttttaatttttgatttccataggtttttggggaacaggtggtgtctggttacatgagtaagttctttagtggtgatttgtgagactttggtgcatccatctcctgagcagtatacgctgaacccaatttgtagtcttttatctctcacccccttcccactcttcctctgagtccccaaagtccattgtgtcattcttacgcctttgcatccccatagcttatctcccacttatgagtgagaacatatgatgtttggttttccaagggaaggcaatatttttattaggggtctataaatattagtggctgttttttaaaatttggtatttcaactgtagtcttcatgatcagtgatttagaaaaataccatattgtactgaaataaatttgctatatatttatttcagattctatattaaaaattgaaaaattagtgttttctgctgtttggaaaatacagtaaattttcttctctaagttttcttttgctagagtttttatgtgatgtcacgggcctctccatgccctttgcattctcttccaaaaatctgttcttgctgtcagttaagtggaaatggttagcaacgaagcaaaatcaaagtggacccacccagcttttatatcctgcatggctgagctttaatgaaagtttgagtttttccaaaagtctggtctctactgactgggaatgaaaaacatttggaaaaaaatgccttgagcatgtgaaccatgtaatttcatttgaactaaggaattccaaaaatactttgcttattggaagggcagttatattgctgcattagaacttgatattgagaaggataagtactagttcttttctccctttttctcataaacattaaaaaacttagactgagtggctgggtaggaaaatagtgtaaagaggctaagttggaccaccaggtgggcttgctctagaacctattccttccttaggagatccatctactcttccgggttccatagagccccacgcagcttgaagcaacccactctgcactgatgacaatgcagggcttcatctggccatatcttgatgactacttgaactgaggcccagtcctttagtcagttctgctcaccgacaccagtgtaaatgctatgccagtagcaaaactggaattgctgggtccctgctgggcaatctggccagagaacaaagtaggtcctgttcagttttatgtctccatgaggggatcaggtgttaatattattaactagcatttttgggaatatgtactatgtgctagtcacaatactggatacttttacatggattacattattcaatctccgtaacaatcctctatggaattttgaagcttagaaaggttaagaaatcaggttttgaaaccaatcagtctgactccaaagcctttgatcttctttcctattttgtaatccctggcttttaatcatgggtcttagtgtactagattgggatcacagatagcagtgtggcagatacagttggtgccctgcccatgtctcctgagccttaccaagtgccagcagctggaccatcttgcttaatggccttctctggtggctggagctccatatgtgagcataggtttgaggagatgtaatgccttaagtgcagcctttaactaatgattgataggagttggggtatgaatacttcagctcctttgctactctggtagagtaactcagaggcatgaattttacactggtacccaaaattctccagagggattaagtccattacccacagtactaacccacttgaaaacatgccctttttattgattgccttccctctttgtctcacttcccttgcccatatttcctgagatcactacccaagtaagctacttgtgtacatattaatgccttaggatctggcttctgggggaaccaaaactaagacaaagagcaaagaaacggtggacctatgaagaaggaggacccagttggagtggatggggcaatgctggaaggaaagcatggggttgcagtctctaggaagaagcctctgatgatggtttcctgttcttgaagctgacagtgtcattgtgagacaggagacaaaggttttgggggattattgaatattgacacactggatggttctttgattgcttgattgaatggaatttctttcagaagttctctcttggtctgttcttttcaaatgtattctatatttacccaagtttaataagaagagattccagaaaatgcaaccattaataactggaataatgaaagaaaatgctaacacgttaaaaacagaacattgagtaaatggtcataagtaaatgaaagacaaatgtatatatataattttggaggatgtataatttactcatatggcctgaatgtggtaatactatgtatcatatttcatgcaaacataaactgaatgaggctttttttttttttaagacaaagtctccctctgtcacttaggctggagtgcagtggggtgatctcggctcactgcaacctccgtctcccaggttcaagcaattctcctgcctcagcctcccaggtagctgggactacaggcgcgcaccaccatgcctggctattttttgtatttttagtagagacggggtttcaccatattggccaggctggtctcaaactcttgacctcgtgatccacccacctcgacctcccaaaatgctgagattacaggcatgagccactgcgcccggtcaatgaggctcttttataccacttttactacacttataggatcatttctcaacttgtgactctatcatctttactgattaactggacatccagtggtgcccaaattttcagggaataacatgggcatgggcaaaatcttgccttgttaaggttaatggtattgtaaattgttaactattgcatttaggtcgggcatggtggctcacccctgtaatcccagcacttttgagtggccgaggcaggcagatcacttgaggccaggagcttgagaccagcctggtcaatatggtgaaacccatctctactaaaagtacaaaaattagccaggcatggtggcaggcacctgtaatcccagctactgcagaggctgaggcacaagaatcacttgaacccaggaggcggaggttgcagattgtgccactgcactccagcctgggcgacagtgagactggaaaaaaaaaatcaattgcatttacacattttaatatctgtcattaattttatatattcaacttcatgtccgcattaaccaagttttgcctgagacatcatacttaaatttacatggctgttataataatctgaaacaaattggtttttgaagcagtcgcttggggtattgttaacacattcatgaagagcaaacttagaaatgcccattattttttataaaatctgtagattcagagaggaaaataaagttgtaagtagacatttcttcttctgaatactccaaccacaagaaggaactgtatgagcaataacagaatattttgagataatctttagagtatctaagcactcaatccccattcattgagtcttgaagacgcccaatatgctcaccacattccagtcaaacagcactttcaccagagatttgagttacagagctggataacccctcaatgcttttttttttttttctttagatggggagtctcgctctgtgacctaggctgtggtgcgatctcggcttactgtaacctctgcctcctgggttcaagcaattctcctggctcagcctcccaaatagctgggattacaggcgtgcaccaccacacccagttaatttttgtacttttagtagagacggggtttcaccatgttggccaggctggtcttaactcatgacctcaagtgatccacccacgtcagcctcccagaatgctgggattacaggcattagccaccacgcccagccacccctcactgctttttaacaaatactaacaggtaaactgtttatctgcttgatcatagaagaacatggactcaatgatgaagtatatataggcaatggtcaactttgttttctaatccacacatacagctgatttaaacccatgttttcatttactggtcaagataaaaatatggagggagtcttgctattcatgcaaacatttttgtctttaccacacaggaatcctcagaaaacctctgagaacaatatgtttgcttggagttagagaggtgtccagttaggggagatgttgggacactttgctcccttcctacagaagggattcccaagtcctacagaagaagattcccctctaatggaaagcagcacgtagtggcagcataagctaagaaaacaatcaactcctaggaaactgtggaggacagtaagagcctgtagcgcattacaatgggcatcctgagaaagtgaccagggtacagggagattctgcctttggtgtattatatattaaatgatgtggatggattaatgttgttaaaatatggagacttcttcccccgcccttactcttcagccccagtccctcccctcctcacccccttcaaaaaagaaagaaaaaagaaaaagaaagaaagaaaatggtgttaaaatatgatcctattgttaaatgttaactctttgattcatttatagccttcaacatcatacctgggtgatgtgattccttcttccctctcttacttttacatccatggatgtatgccacagaaagatctacagcactgtttattttcaagaattcacatgaccctttagataaattattgttttcatttttgcctaagatacacaagatattattctccaagtaaatgtgaaaatactgatttccttcatttctttagcaaagtaattttatacatgaaggattgagtaaaaacaaataccttaggagttaaaaaaaatgtagttaataagacagcctgacataaattattatatacatttagttggtgagaaaataagtttgtggaaagagatggtatagtgaagttgataaacttggggattctgggttcaagttttgactccatcactttccagctctgtgagccttgagcttctctaagccccaatttcctcatctgtaaaatggggataatatgtatctcatgtgattgttgagaggataaaaattaaataatgtaaaatgcttagagcagtatctagtacataagtgcagaataaatgctagttactgttataatttatgtaacagtaccaatcattagacacaaagttctttgtgactaatccacaatataccactaaaggcacagattaatgccagtgcctggtttctagcacttaaaaaaataacaacctggtatgacagatattaacatttccacctgcaggtaaaaaaacggttaaaggtaacttagggctagcagggcaatatgaaggtgatcagcaggggccaggtggtcaggtttaacttgcccataattgctattgaatgacccaaggtcacttccactacttggtcttatctggttttcacagcacaatttttacatccttagacagctctctcattaggaaatcaagaaaattcagatctgctggagaagggatcatggccatatctcccaggaatccagtgcactttttgacttgtttacaaactaacagaaggttgagtacagagattccagaccatattcaaagtacacaccggacacttttttttcctcctaaagaaatgtcaaccttattaatatgcatgagactcatagtggatatttgttaaaaatgctaattcttgggccataccatcaacatcaaggactccggattcagaaagcctgggacttggccaaggaatctgtattttaaatatatctctagacaattctgatccagatgactggaccacactttgggaaaactgatctccttgataacaaattaacaattttaaaaatagtacttattattttttgatgataaaagaaaaattagaaagtgctcagaacagaaaaaattaataattatattttcaggagatgatgactgcaaatatagctgtcctaatttttttaaataaaagacaataaaggaaataatgtattttggggggcatttggtagccatttttccatatctcttttcaagttcttacattcaagtgtattggttgttcagtttcacaggtatattccttttataccaactcttaatggcttttataaatgatttctatgtttgaaatatatataaatttactctatgaaatccacttatattcttgttgggtcaggagattggactggatgtgtttaaggcccattctgactaagatgtcatacttgtaagattgttataactcttttaagtataaggaataaccccattcaaacttgacagataatttaaaattatatcccccaaaagttaaagatttcctcttggggtttgaccttttatgcagatctcctgatgtgacagtatatcaaaggtagtaacatttctccaaaggtgatacacaaatggccaacaagtatatgaaaaaatgctcaacatcactaatcatcagagaaatgcaaaccaaaaccacacccattaggatagctatcatttaaaagcaaaaacaaaaacaaagcctgaatataacaagtgttagcaaggatatggaaaaattggaacccatgtgcactgttggtgggattgtaaaatggtgcaaccactatggaaaagagtatggaggtccctaaaaaatttgaaaagtagaagtaccatatgattcagcaatcccacttctgcgtatatatccaaaagaattgaaagtagggtctctaaaagatatttgcacacccatgttcgtaacatcactatttacaatagccaagatttacaacagccaagttgtggaagcaactcaaatgtccatggacggatgaatggattaacaaaatgtgctatatacatgcaatgaaatgttattcagtcttaacaaggaaagatatcctgtcacatgctacaacactgatagaccttcagggcattatgctaagtgaaacaggccaagcacaaaaagacaaatactgtatgattctactcatatgtgatatctgaagtagtcaaattcacagaaacagaaagcagaatgatggttattagggtctggggaaaaggaggaaagggaagttgatgtttcatgggtatagagtttcagttctgctagatgaaaaaagtctgtcatgattgggtaatgaatttgactctaagttcactgatacatacaggagataatggactgacacaatgaatatgaaattttggctaaattattgaaggcatatttgtctgaatagagagtagggtgggaatctcagaattatagggttaaaaatgtcttgttccaactcctcttgccattttagtaaagaatacacactgaaaatgcaggtatgactttttttttttatactagagaactgatagggacatggtcaaacacaattgttactgttggctaatttatgtagaatcaattctgtttccaatcagttttcatttctaaaaagactaaagtgaagagcaaacataacgacccttcccattttgcttggttagcaatagtaggctgtttggctttattttccagtttgtgctaatgctccagcccagaaagtctcactcagatccattaaggcttaacaataagccatcctgcctttaaggttaattaaatgatttgaactaatatttaacactatgaactgtgaggagaattgtggacaaagtagactggttagtcacatatgaccagttactgacatgttcttttcaatttaaatgtttacattttttattaatattatttaaaatgtcaaccacataccaaagtggagcagataacacagtgaactcccaagtacagtcacacactgcctaatgacaaggatatgttctgagaaatgcattgttagacaattttgtcaccctgtgaacaaagagtctacaccaaactagatgttgtagtctgctacatacctagacaatataacatattgctgctaggttacatacctgtacagcatgttactgtactgaatactataggcaattataacacaataagtatttgcatatctaaacacagaaaagttacagtaaaaatacggtataaaagatttaaaaaaaaatgatacacccatacaaggcacttactatgaatggagcttgcaggactggaagttgctctgggtgtcactggatgagtggtgagtgaatatgaaggcccagaacattcctatacaccactgtagactttataaacactgtacacttaggcaataaatttatttacaaatttttctttcttcaataataaattaacctttgcttactgtaattttttactttataaactttagttttttaaacttttaaactcttgtaataacagcttaaaacacaaatatgttgtgcaactgtataaaaactattttctttctttatattcttattctataagctcttatccatttttattttattatttatttgagttggagtctcgctgtgttgcccaggctggagtgcaatggcgctatctcggctcaccacaacctccgcctcctgggttcaagcaattctcctgcctcagcctcccaagtagctgggattacaggcgcccaccaccacgcctggctaatttttgtatttttagtagagacagggtttcaccatgttggccaggctggtctcaaactcctgacctcgtgatccacctgcctcagcctcccaaagtgctgggattacaggcgtgagccaccaagcgtggcccatttttatttttattttttctcagacacagtctcactctgtcgcctaggctgtagtgtagtggtgggatccagctcattacaacctctacctcccaggttcaagagattctcgtgcctcagcctcctgagtagctgggattacaggtgcacaccaccacacccggctaatttttgtattttttaaattttttgtagagatagggtttcgctatgttggccaggctggtctcgaactcctggcctcaagtgatccgcccaccttggcctcccaaaatgctgggattacagccatgagctaccacgcccggcctattgttaaaaaatttaatttttaaaaacttttaaaacatttttgttaaaaactaagacacaactacgtaagcctaggattacacggggtcaggtcattaatattagtgtcttacacctccacatcttgttccactgttaagttttttttttttttttgacagggtctcactctgtcacacacactggagtgcagtggcgtgactaaagctcactgcaacctggaactcctgggatcaagtgatactcctgcctcaatcttccaagtagctaggactacaggcatgtgtcaccatgcctgactagttttttaaaaaattgattcgtagagacagggtcttgctaccttgcccaggctggtcttgaactcctgcctcaagggatcctcccaccttggcctccgaaagggcagggattacaggtatgagccaccacatgggcctcccactgaaagttgctgagaggcaataacacacatagaggtgtcatatcctgtaacaatgccttcttttggaatacctccctgaaggacctgcctaaagttgttttacggttaagtttattttttaagtagaaagcgtaccctttaaaataaagaaaaatagcatagtaaatacataaactagtgacatagtcatttgttattaagtatcatatactatatataattgtgttatactcgtatttaactggcagtgcaataggtttgtttacataggcatcaacacaaacacatgagtaatacattgtgttatggcagtatgacagtatcatgtcaccaggtgataggaatttttcagctgcattataacctcatgggaccaccattctaaatgcaggctgtcactgactgaaacatcattatatggtacaggactatactcatcactcagcttcaaagaaaaacaactcatggccaattttgtttcatatatatttcactcacccccagattattttgaagcaaaacccagacatcatatcaattcagctgagatattacttactttcagaagggacaaatgaaatcaagaggctatcccagtccaggcaaggtggctcacgcctgtaatcctagcactttgggaggcctaggtgggttgatcacctgaggtcaggagttcaagaccagcctggccaacatggtgaaacccccatttctactaaaaacacaaaaattagctgggcgtggtagcatatgcctgtaatcccagctacgcaggaggctgaggcaggagaatcgctggaacccaagaggcggaggctgcagtgagccgagatcttaccaatgaagtccaagcaggggaacagaacaagactcatctcagaaaaaaaagccacccaggaagcaaatacaacagtttatacgataaaagtgtaatcaggttgaatattaaaaatatattaaagtcataaatgaaagcagtaccattttcaatggatattatcataggttcttacggaggtctccaaataccgagagtagtatgctcagacccaaaatccagccacagctccatcatcacaagcctgtgaatacgtgcgaaagtacacagggcctacttttaatctggtgactcagggtacccttcctcctcatcttcttctcactaggcttgggactgagccagaagctacacattacactactccctttgacttgccagttctgcaaggtcctacttaaagcagaacaaacaaacaggacattactaatcataagcaatttaactttttaaaataactttattcttatcacaaaagtaacatgaactcattacagacaatttggcaaatccaaaatcccaaggaagaacataaaaagtacctataattgcattttccccattttttattaggcacatatgtaatttttttataaacatgagattatattttacatactgtatttaatctgttttcattactttctaatatatactgaatatacttccaagtgattaaatattcttcctcaacataagcttttatttttgcaaaatactcaggtgtaaggaaggacagtaattaatgtctttttggagacatttagattattcccacttagatacacctttagatttaaagctaaaattctgtaaatatcagtgtttatttccttagaaaataatcataggaaagaaatccaggcatacttcagagatattgcaggctgggttccagaccaacccaataaagtgaatattgcaataagatgagtcacacacattttttggtttgcaagtagttataaaagttatgtttagactgttctgtcatctattaagtgtgtaatagtattttgtctaaaaaatgtgtatactttaatttagaaaatactttattgcagccgagcatggtgactcatgcctataatcccagtactttgggaggccgaggcgggcagatcacctgaggtcaggagttcaagactagcctggccaacatggggaaactccatctctactaaaaatacaaaaattagccaggcatggtggcacacgcctgtaatcccagctactcgggaggctgaggcaggagaatcgcttgaacctgggaggcggaggttgcagtcagccgagattgtaccactgtactccagcctgggtgacagagcgagactccatctcaaaatatatatattattgctaacaaaatgctaatgatcttcagagcttccagcaaatagtaatctctttgctgctggagggtcttgtcccatgttgatggctgctgactgatcagggtggtggttgctgaaggctgtagtgactgttccaagttttttttttttttttgacatggagtcttcctcggtcgccaggctggagtgcagtagcgcgatctcggctcactgcaacctccgcctcgcaggttcaagcaattctcctgcctcagcctcccgagtagctgggactacaggcgggtgccaccatgcccagctaattattatttttttagtagatacggggtttcaccatgttggctaggatggtctcgatctcttgaccttgtgatctgcctgccttggcctcccaaagtgctgggattacaggtgtgagccaccgcacctggcccctttccagaaggttttagattcactttgctcagatccatcagaggaatcactgtgtatagcagatccactatgtatagctgcatttcatagcagctctagccttatgaaatgtatttcttaaataataagacttaaaagtcaaaattattccttggtccacagctacagaatggatattgcattagcaggcaaggaaacagcattaatctccttgtatgtctccatcagaattctaggatggctagatgcactgtccgtgaacagtgaaagtttgaactatgtatagcagattcactatgtatagctgcatttcatagcagctgtagccttatgaaatatattccttaaataataagacttaaaagccaaaattactccttggtccatgggctacagaatggatactgcattagcaggcaaggaaacagcattaatctccttgtatgtctccataaatactctaagatggctagatgtgctatccatgaacagtgaaagtttgaaatgactctttcattccaagtagtagttctcaacaagagcttaaaatattcaataaatcatactggaaacggatgtgctatcatccatgctttgctgttccatttatagagcacaggcagagtagacttgacataattcttaagggccttaggattctaggagtggtaaatgagcactggcttccaccaaaaaagccaccagcattattagccgctaacaagggagtcagcctgtcctttgaagcttggaagccaagcactgacttttcctaactatggaagtcctagatggcatcttattccaacagatggctgttttgtctacactgaagatctgttgtttaatgtagccacctttatcaaagatcttagctagatcttctggataacttgctgtagcttctacgtcagtacttgctacttcaccttgcagtttcatgttatggacacagcttcttttggtaaacctcatgaaccaacctctgctagcttcaaatgtttcttctgcagtttccttgcctcccttaggcttcacagaattgaagagagctagggcactgctctggcctaggctttggcttaagggaatgctttttaaaaactggtttttgcttcattttagagacagggtctcactctatcacccaggctagagtgcagtggcgcagatagctcattgtaatctggaactcccaggctcaagtgatccccgtctcagcctcccaagtagctaggactacaggtgcacaccatcatacccagctaattaaaacatttttttttaaagaaatggggtcttgctatattgctcaggctggtctcgaagtcttaggctcaagtaatcctcctgtctcagcctcccacagtgctgggattaaggcatgaggcactgcgtctggtttaagggaatgttgtagcttgcttgatctcctacccagaccattaaaactttctccaggtcagcaacaaggctgttttgttttatcattcctatgttctccaaagtggtacttttactttcctttaagaactttttttcctttgcattcataacttggctaactggtacaagaggcctagcttttggcctatctttgctttcaatatgccttcctcacttagtttaatcatttctagctttttacttaaagtgagagacggggattctttctttcacttgaacacttagaggctactgttgggttactaacaggcctaatttcaatattgttgcatctcaggggatagggaggcccaaagaaagggagagagacagaggaactgccagttgatggaacagtcagaacacacataacatttatcgcttaagttctccatcttacatggatgtggtacatgacaccccaaaacaattacaatagttacaacaaagaccactgaccacaaatcatcataacagatatactaataatgaaaaagtttcaaatattgaaagaattaccaaaatgtgataagagccatgaagtgagcatatgctattagaaaaaatggtgccaatagactcactcaacacagggttaccacaaaccttatattaaaaaaaaaaattgcaccaaatcatacttccatcaagagagtataaatgtatccccatttcttatgtgtactcttaccaacattatttctagtaatttaaaaagtttataagtttcatagatgaaaacatgcacctagtaacttttttttttttttttgagacaggatttcattcctttcactcaggtgggagtgcaatagcatgatcttggctcactattacctctgcctcccaggctcaagcaattctcctgccttagccgcctaaggggctgggaccacaggtgtatgccacagtgccgactgattttttgtagagacagggtttcaccatgttgcccaggctggtctcaaactcccgggctcaagtgatccgcccacctctgcctccgaaagtgctgggattacaggcgtgattaccctgcccggccccctactaacttttatcataagcttaatcttagaacagagtccaaaaattttgacaggagtggtggtggaaactagtagaaaaaggaggagaagacctaaggcatgagaactgtcagtatattttacaaaataaagttaaaatatgatatttgaaagttgaagccaggcacggcggttcacacctgttatcccagcactttgggaggccgaggctggtggatcatttgaggctaggagttggagactagcctggcacatgatgaaaccccatctctactaaaaatacaaaaactagacaggcgtggtggtgcatgcctgtagtcccagctactcaggaggctgaggcacaagaatcacttgaacccgggaggcggaggttgcagtgagccaagattgcaccactgcactccagcctgggtgacaaagcaatgctctgtctcaaaaaaaaaaaaaaaaagaaagaaagaaaaagaaatgatgttgaaaaatccagccaataacatttttgtcacaataggggaactctcaagtatagggttttggagagtcagatatttccttttctccccgccagggagaaagacctagaggtttcccccactccctctcactgtccagagcaattaccacaatttagttcagcctaaagagcatatgctgttggaaaaacagcaacaatagacttacttgatgcagggatgccataagccttaatttttttttttttttttgagacaaagtctcactctgttacccagcctggagtgcagtggagcgatctcggctcaccgcaacctctgcctcccaggttcaagcaattctcctgccttatcctccagagtagctgggatgacaggtgcatatcaccatgcctggctaatttttgtatttttttttttttagcagaaagacagggtttcaccatattggccaggctggtctcaaactcccgacctcatgatccgcctgccttggcttcccaaagttttgggattacaggcatgagccaccgcgcccagccaaaccttaaatttttaaaaaaatcacacaggaggctgggtgcggtggctcacgcctgtaatcccagcactttgggaggccgaggtgagcggatcacctgaggtcgggagttccagatcagcctgaccaacatggagaaacctcgtctctactaaaaatacaaaattagccaggcatgttggtgcatgcctgtaatcccaactactccagaggctgaggcaggagaattgcttgaacccaggaggtggaggctgcagtgagctgagatggcaccattgcacgccagcctgggcaacaagagcgaaactccacctcaaaaaaaaaaaaaaagaaagaaatcacactggatctgtagaaagaacatcagttcttttcaggccatgtgaattcaggcacatctaccacacctgtcctgtttcctcacttgagaaagtgagaataacaacatcacaccaatgtcactcaccttgaatgtttactatgaattaaatcaagacaagcatttggaattattttgtgaatcttaagtgctacacaggagtgtggcagaggaataagcttctaaagtcagcaagtaaggttaaaattgagtgcaataaaaattgcttagaagttccttaaattgcccatgagcacagtatgacaaacttgagacacatgagaacaaagactctctgagagacagctgggacaaacattcagtaacactgccagcaaaattgctgcactagaacattttcatttcctctttctgccaagtgcataactgaatctaagatgaaagtatgatgcaactttgttattctacaatttgaaattggcaagttaagaaacctctctgggcctctttgtctaatggtgtagctcagctggatcagggtttcctccacggtttgtctgacaaatactgccagcttactatgcttactatgttccaggctgctgtgttggactgggggagggtagacgccaaggagacaatctgatcgcaacaggctggtgagtggtgaggcagtttcaacctccatttgaggaatacaggattctatcatcaccttccagggaatgcagtgaatgtttagaaaaattacagaaagttacatatttggttatgaataccagctacaatgctatatctaatatgaattaagtttctttgtttccttttttctgtttatgttgctacttttttttttttttttgagacagtctcactctgttgcccaggctggagtgcagtggagggatcttggtttgctgcaacttccgcctcccaggttcaagcgattctcctgccttagcctcctgaggaactgggattacaggcacctgccaccacgcccagctaatttttgtattttcagtaagacgggggtttcacgatgttggccaggctggtctcgaactgcttacctaaagtgatctgcccgcctcggcctcccaaaatgctgggattacaggcgtgagccccagcaccccgcctacgttgctactttttaatgtggggtcattttttaaacctggctttttaattgaaaaagtaatacaaacatatggaaaaattcaaactgtactaaaaaaggtagacaatgagaagcaaatctttcttctatttcagactcctccttcccccattccacaccatatcccctcaaccctccttctattcagacgttaccactgggtcaatccgttgaaagttacagctaaggtgatacctggggtccaaaagctaaatatggacctacgctatcaccagtcccttccagttctaaaactaagtccaagccttttgcagcacgaaagagatagcctcctctcatctaaagttatggctggtaaggctgagacgaatggaaatggatttcaaagacatagatttagaactcctgaaaggcaggagacagaactcaatactttcatggtgagtggtttatttactgattaaataaacgctcccttagggatgtaagctccacaccggcaggagcttcatcaccagctctcactgcagaccccggcattaaaggagctcacacggtaaaagcccctaccgcccaccacagccacagcggccggcagcccaaagtgggaaaccgcgccggccgtcacgtgactccagctccccccggcaaccggcccgcccccaccgagaccccgccaatccggaagggaggtccaatttggccaggccagggcgtgttccaccggcccagtagccttgctgctgcgttatccctagactcgccccacttgcctcggagtctcaggccgttgcctaggtcctcccggtaaaaccctggagactgctagggagaggagcaagggaggggccagcgcgcagaagtgcggacgcaacccggcggccgcgggcgaggcttatgcagagcttcaagaaacagctagggagaccgcaggagtctccagagcgcgcgcgcgggccctccccggcccgacccacgcggcgcggcgtggtgacgcccgcgcggcctgaggaaggggcggggtcggggcgggcctccgcgctcctcccgccctctctgtgtccctactctccctccccttccctcccccacactcggccccgtcagcttgggggtgccttcgtcgcgcagccttgcgtcggcccggcccggccaggccagcgggcagatgccccgagctgccgccgccgccgccgccgactcggccggtggcggtgtgggaggtgggcgaccagcccggggccgctgagtgtgacggacgcaactgggggcgccgggggctccgcacggaccatgtattttctgagcggctggcccaagaggctgctgtgccctctggggagcccggccgaggcgcctttccacgttcagtccgacccgcagagggctttcttcgccgtgctggccgcggcccgcctcagcatctggtacagccgagtaagtagagccgcccgccgcctttcgccgctgcctccccggcctcccggcgccgtcccacccccaacttccacccagagcctaggactcctgccccttcgtgccagacccacctgccttcgcagtccgcgtcctcgttccaccgaattggccgcaggtacccgccggctgcaggcacgtcctccagccggcggtccggggtggatgaagtcgctgctgccgaaaatccctgagcctccccgcgttggaccgacggccgcggcgtgcagactccgcacgctccccggccgagcccagacttgttcttctctcccttcccccattcccc

SEQ ID NO: 327 - DNA, 35878 bp, Homo sapiens
aggggcgcccggagggcggctagagctgggcctgagcccgggaacgcgcctgatcaggggtggcggagccgcggtccccacagccgccccacccgcgccgctgcctcgctggggcccgggcccccttcccggtccgtaagtgccactgcccgctgtgtctcggcgaggctggggagcgagggctagggagtgagggcggtggcttcggccagggcagcgtcagggagctgggctggactgagagagggggctggggcatccctgcccggcccccttgggcagctcaggcagctggggcttccctttgccgctgggcgggatgagaggtgcgctcccactgcgggtgggaggcaggactcagtcatcccgggcaaagggttgtggggcagtgggaagcgcccagaggtgaggactttgggtgagcggaaaggggaagggcgcagggtcggctggaagttgtggggctgcagacaggtttagcagaaaggaaggtttctgaagtgaggttcctgtgagtcccaggatcgccctctccctagccactgcccccctaccccttccttcttatcccctcccccacaaaaaataataacctagaaagcagcttcctgaaaaaaatattttgagaaaaatgcaccacacagcacccgctctagacaagatttatgacgtttttccccctctgaaatgggaagttgttgggaaatcctattcactctgctccccactccgtgccccagaacaggcctctttgatctgtctgtgggcgtctctgcagcctcctccagcctaggctccactgagctggagaagaatatgggcagcggtggaggttgagtcaagtgaggggcttctttggaagaagggttggtgggggagttggtccagtttggacccgtcagagcagggaggtaacagaagctgggagaacttccagggtcagatcacagaagcagtactggagtccagaaaaacacactgaatctttgtggctgggcagaaatcgaggtgctgggcctaaagggagcccccttttgtgtccccatatcctggaggagggggattcttaagccatggaggggaagaggatggagtttgagggtctacctttcaatcaaggaacagtggccagaggttaggctaagtgggcactgagatgggggcatcatacagggtccacctcaggacttccattagcagtatctgctgctggagaccccagggaaggggtagtcctttgtccaggccttttcaggaggggtgttttcaggttcctgcccagtttaggcctccccagagcccacacctcagctgctgaggagagaggctggatgtgggagccagagagagcattaccgctcgactgaccacgtgtacatgaaggtgggtgtgcaggctctgggacctcctgggtgcagggagctgggtccatctgagctggcccaatgctgggtctctcagctagcagtcctgccggcctccagacaatagggagatcagcttaatcaaagcttgggcctgaggaaggaacaagggagggagggggcagtggggtgagggcaccctggacttagcctagattgtggctggagacactgtctcctaattaagaacccgtgggactcaggaaaggagcactagctccaggctgaattgcaggctgggtggctgcatctgcctggagtagcgcctggggagttccattggcctctggctcccagcctctagatcagggcaagtctggtctcagtagaagggtgcctgcgcagggctgttggctagggtcagaactgtccccctctcctgccacttaaccacttaatttgctatgtcctgaaatagaaggcacactcctgtgggttgttaggtcccccgcgctgagttgtgtaactaccaataggaaacaggaacttgggccaaagccagcttggagtccaagcagctgccactgccaatgggtacaagagtgtacacgtgtacatgcatgggcaaggtaccagccacctgtcttaggctggctgctagacggagggccaagtgtgtgagggggtattgtgcagatttggtgagttgagggagtgcaggatatgcatgtggttgcagcaggaatgggcatctccgttgatctggatatgggagtttcatggcccaggggctctctttcctcagtggaggtttgaatacgaaaaattgagtcccaggccctccgtggaggcacctagtcgctgaggctttctttttctctggctgttagcttctcctggtagctgcaggtgcccctggagcctgggtttaggactgagggggcgaggtggaagaagttcagggcaagcggggaggtggagagacaggcctggcaggcagctctcagcaccatggccagggcccaacaactgccaccggtgctttggcctgggtgcccagtggccagccagacccagtacctgatcttctgaaactttagggactgtgctggggctgaaggccaaggctaggggcttggtgtggggaaagctcatggaacccagacacagcctgaattgcaggcaaaggggcaatctgggtcaatgctggtggctggtcaggttctccccacttggtctctgaattggcctgcccagcagtctgccagcctcagctggcagtgcccagcccacacaatgcgcttctgcctggtgtcgacctggatggcttcccgggctcctgttaagctgtgtgtggaagccggctgccaacccacggagactgcagctgccttgacccaccggaacagcctcctctcagcagcctatggccttgaggctcggtctttctgtggccttcttcctgggagtggggctacagtgagatggaggaggcactgattctggggccggtctcactcaagcagggtgtgggagcctccccctggtcagcctcacctgctcccaagaagggactcgatttcccaaaaagacagtagagatgtggctctgatgacagtggcctcctgcatctgaactgaatcgaaatcaggcttttaattctttctcccaaagccccaacccgccctaggcttgcaggccggcctccgcgcgcggttaccgcgagtctcgctgaggagccattttgtgcagcatcctgcttaaatcacactccgaggggctcgttcctcgctccctcttccccctcgcttcctctctttcttccctctctctcaggtgaaacatgcttctgggcccctccctgcctccgcagccccacccttcccacccctgggtggcccggaaaggactagggctcagaaggccgcccacacacacatcaagaagggaagagggtgcaggttcctggagctgcaggaggaggggaagcaaggggcgcctcccaattatggaaattcatggaattaactgtctcgggcccaaattcagagcttccttcctgaaccgtggctggcctctctgttcctctgctggttcagctgtccagcccttgttcaccttctggaaaaaggaatgtgtctgcgaagtgggatttcgagggaaacatgtacatagcagatttggttggtcacaagctggctgggatgagagcaggatgtcacctgcttcggatttagagatgggatgaaattagaacaaaccacagacaagcaatggggaaagaggcatttgacaaaatccagaacttgacaaaatccacatgtgtcatttttaggggagtgtatggaaggaagagatttttagtaaaatcatgaaatcttttccaaaccatccacttttggccccttctttccaacccatcctgcaagggttttacctggctcagagtggcccagtgccccagaccccactaaaatgaatctgcacgggtacctccacctaaccccacagtgctcactgtagacagcagcagtgagagtctctgtgactcccgtgtattgactgctggaatctgggaatccacttgcccagtcccacataaaatctctccctagctgttgagcttaagatttttctgggggtatctaggagcaaagatattgcatttttcatactgaatcctttgcatcttggggatggctgacaggcggaggtgaatcatagggctcaaggctggagggtagccacagcagcaaggaagaagggggtgatggctggcatgagcacgaagtggtacccataggccactcacatctggaaggctgcaatggtaccaccaattcagctgccagctcagtttaggggtgattccgggagacccaaggtggcagtccctttccactgttgcggctacttggagtgagtagccaggtgtgtgctgagagctgaagaaggagagtggaggcatggctttgtgctttaatttttggtgaaatatgaatttaaccaggagccaagagagagcctaggacttctccaaggtgcttggcacaatcggttttacactcctagtgtgtctaggaaccgagagagagaagggacctagcagcttggtactcagggcccaggccagggcctcgcccaagtggagcatagctgaggaacctctgagtgccaggtgttatgggtgggacaccgacctgcgctcaccgggacacttaattcttcctccaatccctggtctctgccgcgtgggctagatctactgcaagtgctgggcatggggaaaggaagagagaagttaaaggtgaaatggcttctgctctcggcctctccgtgagcgctctcggccctcctgtggagatcgccacgtcctatcacacgcgtccctaaaccttgtcactcgagcattcttgtctcccaaactctgatggtccgcagtgggtactgggctccctgggccctgggaggaagacggaggagtttgggtgaaagatcagacggtgcgcagccctgaggcttctgagggcagagggtgcgcttccttgccctcggggcggggaagccgtgaacgccgaggccattgtaaggctgggtggtgcggagcgcgggaagggggctgggatttgaatgggagcctgtgattggccgatccctggactgacgtcacttccccgcggggcgattagcctgcgagaggagggccggcggtccagtgcgctgggggcggccggggcgctcgaggctctctaagcgctccgcgcgggtgccctacgtgagccccgggacgccgtcgaggcaggccggcagcgccggtgccaggacgcacggaacggggagcaggggagaaatgcgccgggagggcgagggaggaagggaactgggcgggggctgcgggcctaggtggcgggagtcagcgtgtgcgtgtgtctgtccatcccctctggctctccgcgtgcgccccaggatccgggcacggcgtccgctcaggctcccgcgctcggcaggcagcagcacgtggagcccacggcgcggcagcggcactggctaagggaggcccgtttctctctttggttatctagctgtatgagtgccacagagccgtcataaagctagataaccgaaagtagaaatgattctcacaacttctgcgtgcgagcgcccgccccaccgaccgccccggcccggcccgcaagagccagaggagccgagaggagcccagcgccggcccagcggactccagctcgacggagcggccgcgccccgaccaggtacctgacctcggctctctctctggggacacttgcagtgccagctttcccccagtcctcctctttcctggtcccccacccctatcccccagcgccggagcaggaaccccaaagtggagcgggccggggagagggagggggttggggttgcagaggggtcgctggaaggggaaggcgccagccttcgccttcaccccataaatcaggctggaacaatccgctcccggagccgtggacggggattttgggatgcaaatgcgatgggagagagacagcggtcggtagggggtgggtggagggagtgaatggggtgggctgggggctgccctgccgctaacaatgcggcctttatcgaattattcgacgagtcagcccctgagcgccattagcatacggctggggggttgccggagcttcgcccctcggtgaggtcaagttcttgataatttgatcacttttcacgggctctggcagctgcctttgtgtgcagttggggggtctgtgtgcagcgtgaagcggagcagaactggcggggagtgcgctcaatggcaaggggccagggcaggggcctccctccccgacgggtcggccctgccctgcatacaaaccaagagccggcgggtgggcgggaggaaccgagctcagtctcccgctacctctacgccagccccgaccgggctgctcctgcccaagcctccccaacttcccgcgaggttaaggtgcaggcaagctcccagagctccccctcctccctgccccaagaagtcacgacataagatgtattacaatgtctagcaaataaaaaagcaattgggggaaatctgaattcgttcccatggcaacccaatgcagcacacccggccactcaggctcccagcccctcttaactgggctcagggagtggggcttgcccctgctcagtgcgtgggggtcccggccccacacagtgctagggtccctctcgagtttctcatctgccttcaggtcactttccaccctgatgccttggcttgtcctgaagctcagggcccctgtagcttgggaaacctcccaagctccccagcgagtggctgtagaccaaggaagggaccctgcccggcttcagggaagaaaggaagaaaggtaggctcagactccccgattggtaggggggctttctaagtatatgggtatgtgagtgctatgatagacaggctgaaaggaactggcaccaccacccagccctgacccccatcccctcacccttttacatgagaggaaacagatctggggatctgaagtgactccctaagggtcacacagctcagaaggcagagctggaccccaggccaccttacgtacatcttggctcacttcactccctggagcctctcccttagtgattttcacggcccctcttctcccagcctttgcccagccctcttgtaaaaatagaaatattttttccatcttcactcctgcaaaccttttttgttctttgcctaacaaaattattttgaatatagggtatatatgtaaatggtgaaaattcaaacagtacaaaaggaaaaccccttggctctggggaggagaactgtgtggctgaggtggatggtagagggagacttttcactgtatacctttggaattgtgaaccctgtgagtgtgttagcattcacagtaaaattaaataaaaaatacacacaaaagaccaggcagggaaagtcagctgccctcctactttggtccccggttctcctcagagataatcatgggcagaaggttttctgaatccctttgtaccccacctccattttgaaaggccagtttccctttttttctgacaggaggctggtgaagggtgactagagtgtttcgggattcacgaggctatgggctgcatcccttgggccgtccctcccttcccaatgcacctgggagcctgtgtgctgatggtgacctcatttcggaggaaaccggagcagcacttcctgcccccttgccctgcactccctgccttcctccctcaccggccaacgggtgtgggcaaaccctgggccccgggcttcgatcttcccctcccaccacccctacccgtttgctgtgttgcaagaactagtccttcacttgccagggtggctttgcagcttcccagcagtgtctacacagttcagatgagtgttgttgttaaacaccactgtcccataccatctgggcaggtctgaaacccgagttgagggtctgatgaaggaggagtctgtgcgggagggcaacgcggcattttcccgctttctacgaaaatctgttgatgcaaacctcccgcttcagagaaagatcgcggcagcagggctgcggagggcgatgagcatgccagttctaatctccaggagcccatcccacaccttccttaaacggccctcggagagaggccagaggccagaggccaacccatccgatttcggcctcctggtacgaatgcctgcccctactagagcaatgttcgaatcccctttggacacttaaagcccaaggcacagactcaaaattggtgcctgggcccatcaacgtcttctggcctgcctggacctggagtagccggacgggtctggggccttctcagtccctcgtctcctccattcctgtgccccaggaaggccttccccaagcctcctctggccactggctccccacgtttgggcttcatttttgtctccggtttgtgctactctttcttcatccaaaaaggcgttggagatcccgagaatctgctgcagcttggaagccagaatcttagagaatctcggatacttctcaccccattcctttcattttacacctagaaatggtgtaaaaaggcccagtggctcacggaaggtcgcacagaaggccactgacagggcagcgatcagtacagccaccgtggtgggcgaggcatccggggcttccttttctctggtccacgaactcccaactccgaacgctgtgggactgcatgggcctctgcccgggccaatgaaatgcgctgccgagaggaggctgcggcgcggcctgaggccggatctccacaggccggagagttctctgccggccgcggccggacctcccgggaaatgggaccagagcgcggagggagcctggccaggaggcctcctaggactcagccgcgacgctgaaaagcatgaagggtcggaattaggcactcatttagcgagcgttactaatccgaagttacagcgctaattccctgatccggccgctcccacacgcagcgccgggattagaggcgcggccgccgcccgccccgccctcataccccaaacgcgcccgccccgcgccctcgaggctgcgggctcagggctaatccgccgcgccgcgctcgcctggcccgagcgcgcggcgggtcgggctcggccagctggggcgagccggcctgttcgctggctcgggcgcccggttccgggctgggcaaggagcgcttggccatgagccgcgggacagcccaggcgggacggatgcgccctccagggcccaggcgaggccgcgcggtgcagaaccgccgggatttctccaacccgggtatgcgcacccacagcagcggcctttggaggccgcggcgccattttagtggccttccttcccccttggcatctgtcgtgtatggtgtggctgggtgtccccagctccccccatcccgctctgactttggctgccccctccgccagcctggatagagtgaccaatcagctctgacctagggtgggatgcgcgtcaccatggcgacggctagggcgccctggcagtgctgcccatcgcagagggcaagtcttcactccgcctagatgggtgtgaagggaaggtggggacaggtgggggggaggggcggatggagggaggccgtgatgcctcgtccgcattcccaccccattttgcctagggtcagttcagctgggtcaggcaggggacaaatggatggtgtggaaggggcctgggtaggggcctgggtttgtcctggggcggctcttccacgagtcctctcatcccccccaggacctagctctggtataaaggctcatcttggtctctcatcctcttctatgtctctcttccaaagacagtggtgttcaggagcccccagacgcttccccccaattttcttgctgttaagtgctgtgattttagacaagtcgctttccctgggtcttagtttttgcatccagaagatgggctgctgtgcaggctcatgcctggaaagccttcagtgcacaccggctgttctgtcagtgttagagctccttctccctgggcaagacctttgggggcaggattcagaacctgaggatgtcctttctgtccagggcagccaagtttgggtgtctcgtggcttcctagagccagcttttcatctctcctccagacagctgggagaggagggaggatttttaaaaatagagccagggtgggggctgtggctggaacaaaaccttggtcagtggctctgagaatggggcgctgcagctcctaaagctctggctccttccttcaagcctggtctggcttaagcaccactttaagtggtcccggcattcactggccagcccctcaccgcaattgagccgcaggggtttgaaaagagggccagggcctcaatgacaggaccttgggccaggctaattggttttggttcaaggggatactggatttgtgaaaagctccaaaccgcctttcccacgccagagccaggccatggctttaaggagaagggttcaaggagcttggggccaggcaagaaagctgagaatgaggtgccttcagctgatgaccctgctgtcatggccaagacagccctctggttggagagggtaggaagctgttgtgaggccacttccaggggcacctgcatttatggcctgtcaggtactcgagagtcagctggatacattcctaaccttctacacgtggctgtgccaagaaaggggcctcctcctttggcataccttagtggtggagaggccccattttctcaagtgggatcatccagtaaaagaagccagcaatggccaagtttaatatttcttgccccaggagctggactaaacccagacttttatattcagggggcatcctggactccatcctgaggcaggtatgcagttggtctcaaggtgataacccacttctgtctcttgaaatgtccttacactaccctgggcatggacaaacaaagcagagatgagaaacaggaagcccttggtacttaaaaaaaaaaggtcaaatatttctattctcaaaagtccagcattaattatgttatgatttaaatctatcattatagataattttaatataaatgccttgaagcatgtatcttaaggtgtaccagttacctatgtgtttggactaaatggtttcacatatgtatatataatatacccattctacgtgtgcatatatatatatgtgtgtgtatacatggtctatataccaaatcatatgcttatattaacaatcagttatgttaaggatggaggcagggtggggtgctataaatcatcagtcccatttaaaataacaacattgcattgactgagactagtgtttcatggttcattgtgtgttgaggggagcattcctatgtgatcacaggctgaagaaatcccctaccttttctattatcatccaaatttttcactgtgtttgcccacttgacgcatataaataggagaaaggcactttgaagagatatagaactccgtgtatcacattttccatttttatttcaatttttaattgcccagagcctaatttctgtgggcctctgctgatttgcacatttgagattcgtgtgtaaatatgcgtgtggcatgtgtacacgcctgggcctccttatcacaaagtgtgctctctcagtgtttaaatacacacaatccacatcgacacatgattatgggcttacgtatttgcttcttctctagaatcgggttaattttcccttcgctaatcctcaaacccattaagttccccacctccccacccccacaaaaaattgcaaaccctaccacagaccagtggtctcaccccacttctccagcaagcagttctccaggcggggtgctggagtgacggttcctattaggcagacttcattaatgttaccaaatataccttggcacatttactcgcctactatgaagtattaccataaataattaaaattaaactgcacttgtcaaaataaatgaacaaagtagagttagggatgtctttgccttgatttgcttggtttgcttattcactaatttgaagaaagaaagtgagagaaggaaagaaagaacactgctacagactgccacgggatgggcagaggagatagggagagaatgcagagagagagaaagagaaagagagacagagccctcagtcatctccccgtgggtttccagtcattagggcactctgggaggctggaatgcagcctttaacgtcggcccataatgaatattgaggtgtggatatggaaggagggatttctttgtttactgaggaatggccatgggagtgggggagaggattgcctttggggattaaggagtgggctttgtttttataaagggccttacttcttttctgaagttttctgcagctaattgattcaattcagacattcctcctccccgcccggccctggcctcgtgtttctgagatgtgcacagccccatttccccatctgctctggcctctttttccactgtgacccttgaaaagggtgtgaaccttcacatcaacgagatcacaggctatggggaaaacagtcaggggccgagacctttgtatggatatgtgtgtgatataaacgcacatacacatacacgcacatatattaatagaggtataatttacacctagaaacagatcataggtgtacagttctgtgggttctgacaaatgcatttatactcatgtgaccaacacccaagataaacctcatttccttcattccaaaaacttctttcctacctctcagcagtcaatccctgccagtccccattccgatgtctcttaccatagattagttttacctatctagagtttcatataaatggaatgtatgccagggcttttgaaaatgaatttatttagagtctggagggagcaatgtcctgggaggcctggctgagcttgtgtccaggagcactggacttgtgttaaacactgtccccttggatgggcccagaagtcaaacctgtccattagattttttttttttttcctttgggagagctggtatgggctggttgtcctccaggagagccctgttctcacccgaggtctgttaatgagctggggacaggtgagcctcacacgttccaacttggctgccttcagcggcatccaggagcagtggtgagctattaatggaaggtgccggctttgtgctaattagaacttcctttcagcttccatctgtgcagacactggagcccctcactggtcagcctcgccgtcccaacccccctcagtttgcaacctagtttttgtcccccccaccccccatgaattagggggtgctatgagtggagctgctttcctctagctctggtcaaatcccggctctttgtgtattgcagaactgtactgggtggtatttctcagggcttctctctcttgttggggtggagatggacctggaagatggagttggaaagggatttgggcaccatggccaccctcctgggtaggctggacttacatcatcgacctgagtttgttttgtgaaagacctctctcctctgccctctggagactgtgacttcagacccttgtcctctccattaccccagtcctgatgtctcccaagtctgatggtacccacccatgtcaactacagctgccatctttgccatctcaggcagcctacaggtgggggctgtgtccttgaccctcttctgaaaaagaaaaacctatttttttccttcacttttgctttttatttctttcacctcaggcccaatggatatatatatatatatatatatatatacatatatatatatacatatatacatatatatatatatatatatatatatattttaatggaggttgtctcttacagaggtttcattgaaaaagaagaaacaatgtcccattaacgtcatttaaagaaaaagcacctctcagaatggaggttgggaaagctagggtttcttgcctgaatatcagttgggatgaaatcccttgtaaggaactcaagagaggagcgtttcctcagaatgctttctttagctcctgagtctccttaggtctccactggggttgtgtgtaaaaataccaagccctccctgacaatgcatctcattctcttctgcttgaattatcctgataatgagagatcacccacttctttgacagtgtagactaggattttaaaaattgggagtgaattattggacagtgtggcacttcaccagcttccctcaaggttctggatctatgctaaagaggggtggaaatgcttctggggtgtccagaagggctgcagaaattcctcgtcactggtcatggggagagcaggactggcttgcctctgtggcctcttctgcctctggaggtgacaattcctgatttgaggcactagggtggaagactcaggactatccaggaccaggttaataaaccggcagtccagattgcagaagggcagcagctgggggctggggacatgcccatgcctgtgggacagagttcttttgcatgctttggcctttacgactctgtatccttgacaagtcacaggcatctctgggtgaaatggggacaatagtacccatacctccaagggttatgtgagaattaagtaaaatatgcaaataaagtgcctggcatacagtaggcactgagcaaacggtagctcttttttccaggctggggcaagggatgcatataaatgtctggatctgaagtttgaaattccacctgctggagacagtgaacaccccagtagataccccaaatcacacagaaggacggatgaccagctgccttcttcccccagggcatgccatacacactgggcctgaagtgggagaatcgggaccccaaaaaaacggcttgtggagcggggttgcacatgggtgtaaagttcccagcttggctgcctggggagggggagcatgtaaatgtctttagagatttgaagggaccaggatctggactgatttgcgttgcccagggggctggggctgggagccaagggggtgctgccgggaggcccaggttagcttggggtatggcatttctaacagttggcgcctgcggaaaatggcctggggttccagctctggaaggttccgaatctcagtattcacgagcggcgctgtccggagcagccagggttgtcccttggtggtctcgggcaggttctccgcgatgcgcttgctgggtcgcaggtgagaacctcacggttctccatttccggagatccagctctgagcaggcagagggtcgctcccgtcgcctgcccctgcggtagccaagcgggtggctggaagcgtggctagctggcaggtaaggagctccaggtgagacggaacacgacccccaacccccttagccggtgccccacccgatttctctcctgcgtcctgggagggcatggttgaggcgccaccggtgcccagcaacctccccaggctgtggttgtgacctgaggacgcgtgtgtccccgccctcaggccaccgctacgcgaccctgagtgcaccttcaagaaggccgggcacgtttctgggcgggcgtggggggtgcctgatatctccgctctattttacagttactcccctgctggtgcctccctccttggcgcgcttcccacctgcgatcggcgccctcttcgcagtcacgaactcgccagcagctagcagcactgactagtaggagggcccgccggaggagaggtgagcgaccagagccagggagtgggtggaggagctggctgcccgcacccgcactccgctccagatgtctcagagagtggactgcgggttgggaggttgggaaattccaggatcaggttggtagtgcgcctgtgtttttacctgggtcaccagcaagacgactcccctcctccctaggcccggatccaatgtcatccctcaccctcaacctgtgaaatggctttaaccatacacctgctggcttgttgtgctctgtgacataatttggcagaacacggcgtgtagcacacagtgggcgcaaagtaaatggcggctctggcggttctagcaccggaggcggcttcttggacacccggcgttcgcgggagcctgaggcgctcggttgctagagccttagctgggagtggcgcggctgcttcccgcccgcgcaggatcaggccggcccccgcgggcctggagctggatccagagctagggaaactggaaaaacaggcacaaactcggaagccgcggtacggcaagagcctaagcaaagaatcctttccaagattcacacctcgtctacaccagggcaccgcctgggcctacggccttccgaacccgaagcgcccgcagcccagagctggcatcaggccatcaggccgggaaggtcgtcgcaggccccagagtgcgggcgcggggggcgcgcgcccacaggacgcccggggttgggtaggcaggagagaagggcgccagcaggcccgcggctgtttcccctcggtccgcacagcgggcccgggaggccattttgagagcgcgaagaggggcggcaagatggctgcgtgggcacccggaaggtcgccgcgccaagggcccgctgagcccctcctcccattcgtccagccgcgcggcccacagaagcggaacgcgcgtcgagagcgccctgtccgctcgccccagacagatgcccggttattcattaccgcgaggcctagaggaaagagtggctgccgtcttcctgcccacagcccgccggaccctccgtcgcggctgcccggtccccggagccgcagccgccgagcccggctgtgcgtgtcgtggctgctggggagaaagaggcttccggtaagagcccccctgactgggctgcccaccccgggcaggggcggaaacggccttccccgcgtggggaacaatggcgttattttggagtctgcaaccgcgagcgcttcaagctctttgattattttcgaggagtgttaggtgcgtggctaactcccgcgttttcttggaaccacgaagcccaaaatggcgagcgggccgtggccgccctcctggggctgagtgtggtccggagcgctgagagtggccagggagccgtgggcctccatcgtccctgtggttgggactgaggaccggcctggaggctccattcacaccatcgcagggcaggctgggggtcagatgcggatgaagcgggccgggcagtggagctgcatgtttgagcttgccctctccaggcctaagggccagagcttctgctcttctgccttctttgctcctatcctaccctcgtgaataatttaagcacaatcactgtttttctagctgtccgcattgacccaccgcgacctcgaagcaggtcccaggcgtgtgcatttatatgcagagtgaccaagaaacttcagtaatactagtttgtgtctttggagtcccactttttgccagggctagtgctaacagcttcaggagaattcagcctcaccttgacaggtagggtgatgattcactatttgtggcttttgccgtagctaggatgtggcagagccggttgtggactcggggctatctgccccaaggcctgcgttcccaacctgtctctctgcacatacacaggaacacagggattcatcaccgctgtggtttcatctttcagataagcaccaagcctttcctgaatccaagtccccatccccacacagccctgcctcacaagtgaggcatcccccaacctcccagtctaaagccctggcctcagatagattgtgtgactgaataatgtgtttgttctgagcttcctggcagccaagaaaagcaaacatgatggtttataaccttgttttcaaaatgaagctcatcaggattttagagagatgaacatttttcctgcataagacttatagaaaatgtaaagcttagtgattatgtaggtcaactgctcatgtcacggatgaggaaccaggtccagagaggttaagtgattttcaccaaggtcacaaaattagctcatacagtgaggactgagacccaggggtcctgactcccagtccagttcccatcctctcatgaccaggctttagtgggcttctcaacttggagatagtttaattgtggtctagcgactccattcctcactataaattgctgagacctggatgctgccttgttcctttctttgcccccagttcctagtgctgggctggactcatcattgtgggtgtctaaatatttgataattgagtggggctaaaacttctgataatgaggggatgggggcggtggtagaggggaagtccctgacttcagttttctagggggcctttttttttaatgttaggttcctgatccttaattccctaggtctctctcctggcaagtggtacgaggtgggtagtgtgttttcccttttggcagtcatcctattcctaactgccccatcacattattgaaccttataggaaagggtcatttgtgtcttgggggactatgttgtcagtgacacctgcaagtccctttaggtgaactgagggaggtttccccaccagcacaatggccatgagacctggccgactcattcttttatcctctttgggtggagagtcagcctttctgtacttgctcaggtttgattcccatggcttaagtacaaatcacagaacgtggcttagattagtaaatttccatggctcccaaaaggtagcctttgaatccctggcatgataactgtaggtgctgaataaatttagtgaccctgcaacagaccagattctctggaattctaggctggaaaggtgtcacccctggatgtggggagggttatgcttcttgatgggagcccccgttggtagaaaggctccaacagatcctggccaaattctgtcatctttgggtagaatctgcatgggcaaagcagagtaggtaactagggcttgtttgcagctaaagccccagctgtggaagaaaaacagggttcagctccccagattagttactgtctacaaggattaaaggccccaaataatggctggcttctcccctcctctgtgccaagggaagacatgtaaatacagccccacgccagcttaggcagtagatgtgtataaatcgaatttagcaaatcagatcatggtttaaatgcactatttaaagcagtcctgcagtgaagccttttacaaagggaataatcattttgtgatgctaatcatcagcctccaatttatctcctttgtaagttcagatgttggtgcactgggtgttctgaaattggggcgctcttgtgtagggctctggtgatggctgtctgcctttttctgacctctcgttttaaatgggtgcatgtcctgtttctcactgggggcctcaggatgcttgtcacttagcctgatagttctcatctgtcccacttatctttttataatctgatagagcccaccgttcagctgctcctggctccttttttgagacttttgcccttcctggggagaaatacaagccctgctgttcttgaggtgttaaaaccagctccctctctgagctgaactgccttttgtttccctgagcttctggtacctctggtgcagatcagaaagatgatcttagagtcgaccagataacacaaatcagccctgaatttagaaggcgaattaaatgcagccacccatttgctgaataggcaatatccaaaatattctccccattcacggcaaaataactgaggcctggatgttaaagtgacttttcccacaagttaaaatcaggactccaaggagaacctgtctcccaattgctataaaagtgttttatatgctgagctgtagttcctttctctgcagagaaaatataatcagagaccatctgggtgggagagaaagaacgaagagaaagaaatggatcagagtggaataaaggaagtgggaaggaagctggggggcttcgaggagcctgaccttgcttagcttacaggccctgatatagtgtctttgtcaatgctgccactattgacgcgttcctcggtaattatgactgtgtgttggcatggcgactcggagtaagaagactagaagcactgggtaaatgcacgacttgttcttgccttctaaagcagagaggagcttttgtgggtagttcctacagggatacatggtagaaaattcaccaaacccagtgctggagtgtatttacaccccataggagccaggtggccctgagcatagattgtacaaatagaggtccttagcaagactggcatctaatgcagaggtctcccagagcctccctcttgtgtcttcctgttggtctttgttccttagccttgtaatgtcaagtatattcatttctgctcatttctgggttgtctgtttcaaaataggtttatgttgcagtctccctgaatttgattgatcataaaattatctatttcataggccatgactatgtatttggaaactgaagggaaaggctgatgggcacagctggggcttccctttctatccttgtgtgcttttcttagatacttggaccacattctcatcctcttctgaaaatggggagaagttgctgttgtcaagagctgtgctgtcctttatgataaccactagacacacatgctattgatctcatgaaatgtggtcagtgtggcatgttgaaatgataatgttgggttaagtacaatatattgttaaaatgacctgttcattcttactttttaatgaggcttctgaaacatttaaaattatacttggaactgacatattttcactggacagtgaggtctacactagatgctcaagacctcctccatccccagtgcttagtaactaatcctgatctccccccaggaggcctctggccacacagggttctgtgcatagaggtccatggaaaagctagagaggaggcaagtagagagcctcgggccttaaggggcttttaggagtgcctagttcagccctttaaatggggattaccccccagtccttggaggcagaagtcgtggcttgaatctgcaggcaacattgtatttttcagcatttaaggtggggacaaggcagccaatgggtaaaccccagaagagtctttggatgaaggtttagcactgccccagtggagtttgaatgggcacagctgtagataacaggagggtcgtcctccttcccctgtccctagcagtgatttcatagtctcccagatgtgcagaaaccacagggcatgggaaggcagccatgcatcccaggttcgtgccaaacccactttcagcaggtttgtttcctttggcccgagggctccttgtcgcccctctcctggctgcccctcctcccctcagcctgtgctgctctccgtgagcttggagcttctgggatgcgtcttggctcagagccagcgtcttcttggagaggcctcctgccctggctccctgccaaggctgagggcctcagagagattttccagggagatgctgggctcatactgctgtcaaagggcagaggggcctcagttagccttctgcccttggaggacccctggctgtgggtctgggcttgcctccagccccctttccccctcagaaactccagtttcctcccctggaaaccctagactgagttaagggccttccagctccagtaagccttgagtttataaaaagaaggcccctcacatgagcctgggaggtaaggaaggggcatcggggaggccataatgagtcatgacgatggggacaggaaccatttactgagcactgactctgccaggttctgtgctaatgctttgtatattgtatctcttttgagggccatctcttggggagaaaaaagaacagtaaatctgaccagggatttgcccttcttttctaagccaaatgccatttgggtgactgcatggggtgtgttacaggagctacaaaccttgcataggagggactatcagcccccagtgagtccttgtctcccagagaatcagcctgggctttgggaagcagcatgagttcatttgcgttgccaaaggatgcctctgcagtgtttcctgcttgaggctggcagtacacctggagaatcaagatgggagggctccatgctgggcccctgggagccttggtgcggtgctagaggggtgagcagcataccacccggtctggattcatctcctaattgtgtgccccatatccttgctgtgcctcagtctgtaaaattagggggttggcccaagcctaccagcctgcccacagtgccaagggattgtggctgctcgggatgatgctggccttttactttctgcaatgttatatccccctgatgtagcacgtatgatcttctggaggagggaagggggcccacatcctctgtcccatctcatcttgtccttaagcagagaatatcaagccttcctcctatctgcccagttctgcaccatagctcctgctgtctccttaggttaggagaggtggcacatgcctctgaaggcatgttacatccttgatgagtgctgggggaaaagggagtaaagaaacaagtctcaagtttatagccaccccttccctttgaatctgtagcttttacccagtattgagtccactgttctctcttctactgtgggtcacagactccaagaccatggtggtgtgaggcagaggcagtgtggcccagtgggtatccaggtggaggggttggtctgacctaattcagaacccacaggacaccccttcccctcttcctctgagccagttttcccatctgcaaaattgggaatagtaatacttaccttgtgacactcaagatgcatcccccatcttgctggtctgtcacgagtaaaggccaggtaaggtggccagcaagggaccagggtcagtcagctctctgttagtcactctacaataagctgtggtgtttacagaccagccataagctctgcagtgcagggagaacccctgacctctaggagcagagaaactagtattgctagcctaaggcagcacaaaaaatccaaggggcagattgttttgatgttttgtctctgtccttgggagttaagagaagaggaattagattgaggcggagaagcctcactgtgcccaaacaggtcttctaggctgttgagagggcaagacagggcatccctaccaatggggagaactctctgaccaggaccttagaggtggagatgaagcgggaggaggagtcctgctggactgggcctgagatttgggtataggtcaggtcagatggtggaggataagaatgacagaggtagggagcaggctaagagaattggtatggtcaccatgtgcaagatgggtgggcactggaggctgtcaggccttgtgctgcccaggccaacctgagctgagcagccacacccatcctgtgccactcacctcttatggttcctggcctggacgtcagcagccccagggctgtgctgtggagccatttcccactttgcaagggaactgcgcggctctgaaattggaagtcttcccatgccacactgtattttttcttaccacactcatttattcattcaatgtctattgaccacacattatgtgtcagcctctgggcaaggccctggggatacagagagggaaaccacattccctggcccagcactttcgcttgtggtgtggaaaggcatacatccatctagagctggaaggccgggctagcgggggtggcgtgctagactagcaggcactccgggtctgacacttatcatcagtttgtggcttattggctttcctgcccctctccatgtcccaagagcctgggagaacagggtcagaggccatgtcatgctttgcccgtgatgaccttaagctgtcgtttagcctcagctagaactgtaattctctagattgcattgtttctgtatagaattgtgacatttcagtttccctttcttcatttaaaaagacacctttttttttttttttttttttttatgagacaaggtcttgctctgtcagccaggctggagtacagtggcctgatcatagctcactataacctcgaacttctggctcaagcaattcccctgcctcagcctccagagtagctgggactacaggcatgtgccaccacagccagacttttatatttattttataaaaataaaaaaatatgttttattttgtagagacagggtctttgttgcccaggctggcctcaaactcctggcatcaagcgatcctcccacctgggcctcccaaagtgttgagattacagcatgagccaccacacccagactaaaaggcagtttgattttacaaatcaaaatagcagtaatctatggagatttacttgtgagattggtaggaaacatcttaaatgtaatcaaacaataacttacatcttgatgaattcacgtgtaggtttctcttcctcagaagaaatcagatgctgttcagagcacgaaggctagaattttaccctggttctcatgctaccttgcacccaggttggatcctgagtacagtttttggcaggtgggcctgcatataagttagcaatgggggatacccagctgcctctcttcatacagctgaggttttggggagtcattcttatagcccctgggttgggcctagtcctgcaaatgaattcaccagccctaaagcccaaattgcagcctctgtcattcaccttccaggagtggaaagggcagtaagtttcatcttattattattgctattttggtggttttgttgaggttggtgtgtgtatgttagtaagataaagctctcagaaattacatagcatttgtcaaggatataagagggactgtgccacatctggctgtatagaaggtggttccatatctttaaatagagccccaggtccttagccaccagaaaggttttcaggggaagtgtgcaccctcagcagctgctgctggtgggcaggatgggcacgcatggaacaggctttcctctgtggccaggtgagaagcaggtggtgagacacagagcagtgctgggctctgcttctgaagcctccaacctttccttccctaggaagccccagagagattggtgagggtgatttcccaggaagacgcagtgtgctctgacttctgtgacagtgagcaacgggaccagtggatgtccagatgctggcaatgagtaggccttccctacgctgggtggcgtccacaccctccggcttccattgcctgggtctcctggaggtggtttgctggatgaataccgcatgcacagaggctggccttgggtttgaatatggcagccagtggacagcatgtgcttcagttatgagactgcccaggagatgcttcttccaaggcagagcacgtgcagagtccagtgctggagaggccgggtgcgcagttgacccatttccagttctgttttccctctcatgttcctctgtccccatctaggacatgctctggagtcagaagacagcgaaaagagaagcagaagccccggtggcaagagtctgaaggtgggttccttcctgacatgggcattgggctgcgcatgtgtgttcgcagttctttccagctgctgttctgacctctttgtgcagtgtatttatgtggctgtagatggatggtccaaggtagatttaggttttggaatactgttttttttttctacttcagggagaaaataacccagtttgggaaggacatttaaaaggggaaaatattaggtatgatggcacacctgcagtcccagctattcgggaggctaaggctggaggatcacttgagctcaggggtttcaggctgcagtgagctatgatcacgccactgtactccagcctgggtgacagaatgagacccgtctctaaaaaaaatgtaatttaatttaaaaagggaaaatatccttggtggtccttggaaccagcacttaccaggttgacccatatgaaatttctttcttgttgatgaaaaatagtcaaatattggcaatttcttatggttcaacatgttacagttccattcctctgggatggtagagggatccccagaaacacattttaaagagtttctgatactttaaccatttgtgttcctcttcatcctacgatacccttcacagaattttttttttaacagcaggaaggatgactgtagcctgtggattgtactgcagtaggaaactgtcctagcaaggctccactttgccccagcttcaaggtatatcgtctcaaaatgcaggggacttcagatgagttttgagcaccctttcttttattataaaaaaaattccagacagttcagccaatactgactaagggctgagaccagttccatgcttttctgtctccagaggaatttgcttccatctggatgcctgaaacggtattttacttcacctcctgtgtcaccggcagcagtcctgggagccctggggaggaggtttttgggagagccagctcacagcctctccatcaccttttagccaccccagtgctgggcagccagggtgtgggcttttgactgaatgcacttgccctcctgcattcattacaccattgtcagtgtgtgtgtctggggctgcctctgggtgtgcatggttttttttgtgtctgcgtgtcagtgtcaggctatgtgtgtctgtttctgtcggcctgtctaggcgcgctcagtgcaacaaggagctgggggaggtggcggtaaagaggaagggcatttcaaagcccagctgtcctcctcagggacctcaggagatgcgtgtgtgtgtgtgtgtgtgtgtgtgtgtgtgtgtgtgtgtatttttttccatgctgctcattgtgtggggctgcatgcgagtgtctgaccaggtgtggtgtgagcagccgctgggctgggtgagccccatctgccgtgagctcccagacttgccttctagccctctgccgccatccatggggagcctctcccttcgcagctcaccgtctcttctctaatttattagctggaaaggaggagaacatgaaacattgcttgaagacaatggccgagacagcaggtcccaccctgcacagccaccagcatctctcccctcagccctgtctcctcttctgcagttgggatctgcacatttaagcctgaagtaagaataaaacaaacccccaaaccaccctattaaaaaatgtgcctggccttggacatgcagaggtagctataaactgttaaaggtgggagaggtcaacaaaatgaaggtttgagccttcttctactctggggccccccacctctgagtcccagcacttccccccagctccaagccaggttgagggggggcaggggggcaagggggcccaaggcagctgcaggggctgtgttagtaaacactttcctgggttcccattttctttacaccccccacccttctctactccctgatgccccgttatacactcccacccccagcatccccttttctgtggcctgcacaatgagctcattgtcccgggtgtgatttgaataagggatcggtgggcctgttcccagcattgtccaaggggctgggaaaaaccccagcgcaggcaggaggaccagaccagacagagacagatgcctaaattagcaacaaagctttgtgcacgtcccctggacaagggctcgccttgtttgcgtggactcgagggtgtggagctggccggctgctcgcatgtctccccatgttaattagttttgcatgcatgtctgagaaggtgccaggggagatgtgtttgcctttccccgggagggggccctgtttgtggctggccagtaggctggggtcttggagctgatatgggctgggcctacctggggagccaggctctgagcctggctggggaatcacggctttcccatcctgtagttctgtctctctgacctctggggggcctggctttgctccctgtgccttctccctgccacccctccatgtttgaaagttggtcagctctgactactgggactcactggcttcctcccagacccaggccagtgcctgtccatctggcagtctgtctcttgcgacacagggcccctcgggaccgggcagcagaaacagccagtctggactcttctccgtccccgagccagatggccagtctgctgatcgcattacggcctcccctgtccccagacccctgccgcctgtggttggaccaggatcttgtgtgggatatgatggagaagctcccttttaggacctcctagaggcctggccctgaaaggaaaggggtctggtagacagggcgtaaggcatgtccttgctaccagcttctatgtgacctcaggcaggccaagtgaccccgactcctgaatcttagttttcttgttggcaagaggagtgagtggagcttcaggaatctcttggctctcttctagctcagaaaacctctgatggtggtagcagtggtgatcacttcaaaactgtgttgatgtagcattcactgatgtagcacaatgacaggaatgggactaatgaattctggctggggtggaggggagtgttgcaggaaggagttcatccctgttgatattcagtgtgggctcctgttttcagagtgtggggaggaccaggagcaggcagagcctgtcttcccaggtcttcacagaggagcccttccccatccctaccctgcagtggtgagaagcaggccctggcccagcagaagggagcttggcagtggcaaagaagaagctggagggatagcagctgctggccagggccctgggtgtgtcctggttgccccttgcaggtcctgggatggggttggtgggggtgggcaggggacagggctgagaagggtcagggttcatctggaaacttcagagtgggaactctccatagcccttcagaataaccccaggtggtgggtggggagtgggatgaagcatcaccctgctattcagtgcgggggtctcaggttcagcggtcagggtgtctggctccttctttgccagcctccccatctctggcaccctcccactctctcatcaggtgttgtgggatgtatcttgcactggggccaggcagctgaccagagccacccacaaggagcctctggaattaacctcaggtagccactcaggccaggcaggggagagaccctgggcctcccttccagcagggaccttccttcccatgctgcggtgccagccagttcccacatgcagtgcacttgttccttccatttgggctgcctttcccctctccgcctctctctctctttctatttctgtttctgggggacctctttttctacccctttccctgtctccctgagctgctcctaactcaagctggataactggtggtaaattccaaagctcaatgaagaaaagaggatagaagttagcgcttcatggcaaggatagagtgagagagttgcctacagtatcggttgggagaagaggcagggcagcagggccttgggagagctgcccactgccctccctgcccctccccattcctacctcccagggtttagccgcctcagctgtagctctgagctccttaatctggtgatccttgtggtgctggggggcgggctggcagaggctttaggaggtgacaggggatcttgggagtcgcactctgctaacagagtgtcatgcaaagctggagaatcacattccgagcgcagctcctccttctaaggcagtggcccggcagggctggacccagcacgggtggtgcccagtggagggctgaggcacaggccctgcacgcagtcgggcatcacctcctctttgtcgctcaagaggaaagttcccaagattagggctttctggccctttctgcatggctaagatttcattgtttggtagctgcccccacccttaccccagctcccaaatcctctggctgccaatcccagttagaagaagtctctgtaagtcacaggtatcatccccctggtcagctgttggggtagtcaggggtggggatttgtctagaactaagcaagtatgccgggtggaatggctcccctgcctagatgagaaggggagagaacccctgagatgaacccctgattctctcagcgatgggccctgagagaagccaggagagacaggaaattgaggtgggggtgcaaatgcaagcgcaagtggttctgaggcatccagctcagcagaaccggggcagcccaggccttggaccttggctggagggtagggacagaggagaagatgctgtgggtcgaggcccagggctctgcttctgccatgactctgcagcagaccctggatgtctcagagcctccaaaccctcatttgtaaaatgagcatcataatccctacctccattggagctgctatgaagactcttgggcacacgggaaacactcagtggggttaatttttcttctccttttcccttagatatggggcagagatgaaggagttaagcttctccaggtcacttaagatagctgagatttggggaatggggacagtggtgatattcagaatatttaaccacctgtacaggttgggcaccaaccagtcagaatgacacctggcccaaatcatcacccagggaggagggcacagctgagcagaacttctccctatatctttctgccccatcatgagtccatttatcagcaagcatacagacatcccttgagggcagctcctgaggaggttgcaggatgcgggatcctgagatctttgcattcaagcaagtcaggcctagcatggggcaccctgcctgacctggaagaggacccggaagcagagggcagtgagctgagggccttcccagctcctgccccaagctggcagcagacctgccaccaggctctggggaagagctgcttctgtgggctttcgccatcctcacgtcccctagagctgccccctccttcctgtcccttcttctcaaaagcaccatgggtcaggattagagggtctgtttgttctctgatctaactcctcgtgcctgtttcttcatcagcctggggaagttcatggtttctgttatctgactgtggagtatgggagtgtggtgttggggtagtgtggagccatgttctatcatcatggaaagattctggcctcaaggcaggcagcgtcttcccccagccccaggctttctgaggccacacctggacacgtggtgcacttagccaacactgacttattttacctggcctatctctttgccttgttgggtgaaattaatgcctttgagggcctaaggtggtctggttaagtgacaagggcataggaagacacaaccttacctagctggaagtcagagatttggactctagcccactttcccactgagtggtcttgggcaagccacctcctttactggatccagaaaagtagcattgagccaggtgtagtggctcacacctgtaatcccagtaactggggaggctgaagtaggaggctctcttgaggccaagagtttgagaacagcctgagtttgagaacagtgagaccctattcttaaaaaatgaaaaaattagccaagtgttctggctacctgggaagctgaggcaggagaatcacttgagcccagtagttccaaggctgcagtgatcataccactgcattctagcctggatgacagagccagatcctatttcttaaaaaagaaagagaaagagaaaaaagaaaaggaacattgaataagatggtatctgaggtcccttttagccctgcattttttcatctgggagttcttcctgccttttctactctgttacctgccagtaacccctgctcccagccccctggctcacaggaaacatagttagctttgtcccgttcaagctggcctgggatgcaatgaggcaccattacctagaggctacaaaaatgaaaacccagctcactgctggcaagggatgtggggctgggcagtaacctgtcctggagcaagacttgggcagagagcatgagtctcacctaggtgcactcccagcctctaatctggatgcctttgtcctttgttctacttctgtttgctctgcatggcatttgccttggtggctctgtttgctcaggtggccctcaaggtgggtttgcagtgctctctttgggatttgtcccattccacttccttaggccagaagctttagactcaaaagctccaatccctgagaagcaaccatgggggaaacactactttttggtgctgacccctctccgcagcacccctgctaggaggctcttccactggtacagctgatacatggatgtgggctcagcatcttatatgactggcatgaccttgggccagctccttagcttctctgatcctctatttccttatttctaacatgaagataaccacacctttctcataaagttgcagtgaggcatagaaataacacagataaagtaccttgaaatgatgttctctcttaccttctagtgccagctgcacccagaggcttcaaaggccacagacataaacccttaactttcctgacctcttgcctttgagtttcaggactgccctgctggggaagtgctgagacaaccttggaggagctcctccccccagcccaccgcccctccttccccagggggcagaaatacctagtttcagccctaataatacctgaatgagatttataggacaccttcctccccagagtgcaaagcttctcacatattatttctcttatctttagattgtcctgtgaagtgaagtatgatcggacagcctcttttcagcttttatgacaatggagacagaggaattgtggctcttgccaaggtcacaggattggaatacagagccaagccaccccaggacatgcaagagcctcagaagggaaaaaagcccagcaggaagggagaacaagtagcctctgtcctgaagttgtaacagccaggggccaggatggaggaggaggaccccataatctgcccatctgggacttggcaggggacctgggaaaatgtaccccaacccatcccttaagggcctttgtctttggcccattggcctagcatctacttcttcaccgtgtctgttcttgtcacacctagtcaggtctgtttgggtctgaggtgcatggaacattctgggtaggcctccagcaaacggaagctcttcaccgtgtttccagcctgggaccaagggcagcatactggcaaagttgccaaagcaagggactccagcctcttaggagttaatgactccctctccccagctgtcctccccttggtgctcctcttcctccctcctcctgctcacagcaggcagggcctagacccgggagccatgctgctgtgctgttgccaggggagcacggaggcagatctgagctatgcagggaaaaggcccagcctgtcaaagtgtctgagatgaaccgccgccgtccctgtgcagctgggctcagacgtgtctcagctcttgttctgtgcctgagaatggcgaaacccagtgaggttcaagggcaaactcgctattcattagtcaggggttcttgacgtcccgtctctcccagggatgagttcccccctcctctttctccccctcctatgacacattcctgggtgcctttggtgaggactgcacaccctcctcctgcctagccccctctccaaaggcccctgaataaactccccccaaggagaccaggcagggcagagacaatggctgcaggaaatcattcaggcgggacatgctggcctgccctccacccagtccccctgtgggccccactcccttctgattcagggcacccttgggcccccagcctatacaggcctggacaggaagaaaccactgggaaccaccctaaggacaacatgctagtccagtgccattcttcgctggctctgtgggtgcctttgtggcctgtaccgactggctggctaattttgtggtttctgtaccatcacatgcctattttaagacactctccagcactgtcggttagggagtgtaaattttgcaatattttctgaaatgtggcaatatcaaaatgtaaaaggcacacatacttggtcacaaacaaatggcactatttactctgtgggcatatttgtaaaagttgccaaagaattatatacaaggatgttcatcagagcatttcttttgaagagtaaagaaatggacatgaacctgtggtccgttcatacggtggaatacctatgcagctgtaaaaatcagtgtggtagatctccgtatatgagttgatgtggaaggttggccagttcacatgataaggtgaatagaataagttacagaacaggctgtagagtatgatcttatttgtagatgtttaaaactgagtcataagtatgcttatatacagatcgtttctggaagtatgtactggaagtctacctctggggagtggggatgggggagtgcactcttctatactgttatattttcttttcatgctcctaaggtacttttattggaagatgtaaagcggttcaatgtaataggcttaacttctgtcaactaagttggcgtgggtgctttaagagggtggtagtgatgttgctggagaaagtatcccacagtcactggtggcttcagccacgggccattttggggcctaataatcacatatcatcatggttgctagtgttaatcgaaaacctactaagtgccaggcttactgtctctgggtcttgcttacgtggatgtcatttttccagttgcaccaaatcgaaagaggttaattggtttgttggagttcctttgtaggtgaagggcagagccaggagcttggctagggacaggggaggtgagtgggggatggtggataggtcttggctcccagtttccttctgggcagacattgcccctctgccctgaggacctgcttgtttgggggaagaggcctttagaggcaccagggtcatgccaggtgttggacatggtgaactgggaagtgctcccatctggccacagcgcagaagtatcaccgtgctgggggatggggaacagggctgtgaatgggcctatttgcataagcagcatgtgtctggagagaaagacatcacagagcagaagagtgcgggtgcccaggagtgcacttgccacccctacttcatccctgaaagagtaaatggcctggaaggtgtctctgagaggtaatgccgcacaccaccctccctgggggcagggtcaggctacacctgccttaggtcgggggctgcagcagcctgagagctctcagtagggcctcagtagcctgggagggagcaggggcagggggcagggaaagaggcgtaatggggctgtccagaggggcctgggaaacctggtccctgaggcctgggcacagctacaatcacttcaaattggctgtggggccagtggactgggaaggaaaaaagcaataagagtgaccaagtgcagaaggctgtcaggtcccaggtcacatgccttagtgcagtgactcctcatcattttatggggtgtgggtgtcgttggtacacccattttacagatgaggacaccgaggcccagaaaagttaagttacatgtcctaagtcacacagcttgtaagtgccagaactgagatcaaaaccaagtctctttgactttaaagtctgtactctgaccccaaagagatcctgtttggccacttataggaggtccctaaagctgcagactccccttgccggcacccacatatagagacattaacccttcccctgcagggtcacctcaaatagtcttttagctgggcttctcctgcaattccacctaatgccatcccctgggttttgcccaaacctgaactgggcagtggggtgagaggaggggtttacagggttacagagcctcatacagataggagcccatggctgctggtcatctgcattcctgcaggattggctgttccttggggtccttggcaggaaaatgaggattgctccgaggcctgctccagtacttcccagaggctggcctggtgtggggctctgggaaggctgaggctggagaagcgtaagtaggagggcagagatggcactcaggtagcttgaatcaccaggacccttccaagccccacaggttctgagggagtactagggccagctctgggagaggtctcttcctatgctgtgaaccccctgcctttcttgcagcctacaacgaataaattttct

SEQ ID NO: 328 - DNA, 109975 bp, Homo sapiens
aaggatgatacaaatttatggtgcccagatttgacctctgactaaataattttgagtatttttcttttaggtagccatatggtacctttgcaaagacaggtcaaatacatatcttcaggcttcttagcaggaaaagagaaacaaacattccacctacccaatttatagttttctatcaatacaaacagattggctgctgctcagaagaaactcagctactccagatgtagaaatctcaaaaaggaaactttgtaggtatagtgggaagggtgttagccaaccttcatgagcacaattttgatctttttgtgtgtctcttttgtagagccctgaaatgctagctgatgaatatctccaaaggataattgagatggtacagttccatgaagggccaagtatgcagggctaaacccggggtaatatttagaacagctagaggagtggatagattccatgatccaaggcaatactccaaaaatactctttctcacaactggatttttttttcaagatgtttgggtaagaaagagcacaggattataatctaggtaaggaattagaaggcaaagtgtctgtatagcagattacgtgccgattcagaggacaagaaaacatttcatttattttaaaaatcgcatcaccatcccaatgctcatgtctgcatggatggccacctgactatggcccaggaaggccccgggaattctttcaccttgcataccagctagtgttagtaatatctgtagtagcaacatgtatgaatgcctgcctcttagcacccttaccagcactgaatattttaatttttaagtgtttgccaacccagtgggtgaaaaagggaaacatattttttaagtgtgcatttctttagctaataatgaggttggttattttccatgtgctttgaccatttttctatttggagtcttactgtctttttcttatcaatttgcatgggctctctatatattcaacatgttcatccctattaacctggatcttgagccactccttagtggaaatataaagtggccagcagaatccaggaccagttttggaaagcatggtgggtctagttggtttaaagtactgtaatgtggccgggcgtgatggctcacacctgtaatccgagcactttggaaggctgaggttggcagatcacctgaggccaggagttcgagaccagcctggccaatatggtgaaaccctgtctctacaaaaaatacaaaaattagctgggtgtggtggtgcatgcctgtagtcccagatactcaggaggctgaggctgaggcaggagaatcgcttgaactcaggaggcggaggttgcagtgagctgaggtcacgccactgctctccagcctgggcaacagagcaagactccgtatcaaaaaaaaaaaaaaaaaaaaaaaaggtaccataatgctatgatgctttaggctggtatcaaaaccctttacttgtaattcatttttaaacctatccttactccccaaaagactagcagcaaacaatgtaagctgctttagtaataattttggtgtgaggcagtggcggagaagaaatgggggccataaaacaacatgtaactttagcacataatttgaaattattaaaaaatgaattcagaattccatttcctttcatagtttgcaaagaaggcatttcagtttgacattatataagtatatgcttctgtatgcgtgtgtctatgtgtattttgtggttttgtaacaaatcactttccttagccactaagggaaaacaaagtgtgaagatttcaatgactaagctcagctataatacttgttttaaattaagaaatacttttattgaggtatgaaatttacatatagtgaaatgcacaaatcttagttattgagtttggtgagttttgataaatgcatacatctacatcggccatacctccaagatataggatgttatcttcacctcagaaagttctctggtgccccttcctagtcaatctgccacttctagtaaaaaacgatcagatttccatcaccatagacaagtttgccccttccagaacttcatatatgcgtatggattcagataatatatacgtactctttagtgtccggctcctgtcactcagccttatgcttcggagacttacccatgttgttgtatgcaactgtatctgtgggttgctcccttctgttggcaaataatattccattgttctatggtatgaatgatcttcactttgttgatccagcttccagctgatggatatctgggctgtgtctaatttttattatttatttatttattttattttatcattattattattattattatttttatttttgagacagagtctcgatctgtcacccaggctggagtgcagtggtacaatctcagctcactgcaacctctccctccccggttcaagtgattctcatttctcagcctcctgagtagctgggattacaggcgcacgccaccatgactggccagcttttgtatttttagtagagatgggttttgccattttggccaggctagtctccaactcctgacctcagatgatccagccaccttggcctcctaaagtgctgaaattatgggcatgagccactgcgcccagccctaatttttatttttgtaaataaaattgccatgagcattcttacacaaggctttttgtggctataggctttaacttctgatggataaatacctaagagtgaaatttctgggtcatagggtagatgcatgtttaatgtttaggaaacttccacggtttcctgaagtggctgtgctatttatactccctccagagctatgttagagttctaatcagtctacattttcaccaacatttggtgtgaacaacctttgtacccacactttggtaagtatgaaaaggtatctcattacagttttaatttaccttcctctgatgattaatgatatcgaatacttatttttatttttttatttttttttgagacggagtctcactctttcgcccaggctggactgcagtggtgctatcttggctcactgcaagctccacctcccgggttcaaacgattctgctacctctgccttctgagtagctgagattacaggtgcccgccaccacgcctggctaatttttgtatttttagtagagacggggtttcaccgtgttagccacaatggtcttgatctcctgacctggtgatctgcccacctcgacctcccacagtatgggattataggcatgagccactgcgcccagccgatattgaatactttttcatgagcttcttggccatttacgtatcttcacttataaagtatttgttgaagacttttgtccatttcaaaaaaaaactgtattgtcttttttaagttgtaggaagtctttctatattcttgatacaagtcctttgtccgatatatgttttgcaagaattttctccaagattgtggcttgcctagaaattttgtctttgatgaacaggcatttttaattttaataaagcccatttaatcaatttttttacagttcgtgctttctgtatcctaagaaatctttgcctatctcaatatcaggaagatactctcttgctcactctagaaactttgtgatttagcttttatactcacatctgtgatccctctcaatgtcactcttatgtacagtgtgaggtagcagctgaggttcacttatttcgctgtgaatattcatctgctctataaagacttggctttcctcattgaattgttttgtcaccctttttgaaagtcatcttctcatatgtgtgtgtcataactgtactcactattctatttcattaatctatttgcctattcttttaccaacaccagcctgccttggcctcccaaaatgctgggattataggcatgagccactgcgccctgcctacactgtcttaattactgtagcttagtaataaatcttgaagtcaagcggagtatcatactttaacttgaaatcctcctttaataaactacaaggcttcagacatctatcctgcttcccaaatcagagataccgtaaagtatctatgggtgtgcaccaccagtcatttattctcatattgagctgtgagtgccgtgaatgtcatgaagtcccttttgctgtgaatttattatgagcacatacttttgaacatctcccactccacaattatttccaaagtttttcaagaaaaaactttctagtatggtgttctggatttagaaaaaagagaaaagtgagattaaaaaaagaagaggagaatgaaaatgagtttatactttacagcttttacgtcctaggtataggtggggatggtgcactctggtgtcgctctctccttgctctgacaagggagatagggcaagttacttaaactctgcaagcctcactttcctcatctgtaaaatggggataaaatattaagcacttaagaaatgtccttgtgactcctgggggcaaaaaaaaaaaaaaaaaaaaaaaaaggaattttgaggacttcctgtatagctctattaacccagatggtgctgaactggaggagggacggacaggagtacacacacctgaagcggagatgagctctcacgtcggatcgagcgagtcatccacgaagtgctcgtacattttcacctgtgactcaatgcgaactttctctagggatgtccctgtgagcaagatcatccgtcctgagcaaagggctctggcactggttttcctcaggggcccttttaacaaagattcccagggaaagaggggagaggaagggaggaaaattagttggggtaaaggtattttcccaaatcgtcagagcgtgtgagcctcttcaggcagaccccgatctccccccggggatggagtgtgctcctctcctcttccctccttccccaccctgccctggcacccggtgccacccctgccttctccccatctttattatgttggcccgggctgcctcacagcatgctcggtttattttctaattattttctcctgctgcaaactttagccagccctgtagatatgatatctggtgattctgggggactcagagaggcatttatttattttcttatttatatgagctatattagttgggagttctccttttggaactagtgaggtctagtttgtccactgcgatgatctctggggcagcggacaccatcccaggctctcccgcaggagggaagcagctccctgagcctcgccccgcccctcagtggaagagctatcctggattagggatgcccgactctggtcacttcacatcctcctcactgctccgcaaaggcacttgtgccagatgagaagtctccttttgggcagattcctatgattgaggggaggctgggggggccctgggggctggaagcaaagcctcccacatgctgaattcttatctgcagctgtgctctgtttgggcccttcccagggtgcatcttggaggactacttgcactgtgtctggtgggtttgcttccccgttttcatagctatatagtttctgccctttgtagtactctcactatgctcccccatgtggacctgactagctggaagaaaccgagcacgtcggggagaaaatgtcatttctctttcagatctgatgtttaagaaatgtatgctgagcgtaaagattattactggggacagacccaaccaattccagggcagggttggctagcagaagcctggagaagattccctgaggctgatggggatccgatcagcctgggagagttctgttctcagggttttatcttgggcttttatctggtcaatgaggtctgaagcctcttttgcagctccagagggcagagggcagaccagttccactctgagactgtcagtcaaacagatgggataatcactcgtccctccggtcaagtttgcaagtctaaatttctagcatacctgaagttgttctgctcctgaatggtgaaccgagacaatgtgtcctaagccagttgcctgccattctgtggaccttccgtgtgtttccacttcttattctggaaccgtcttctgtgaaagtgagcactcaggcactgaccgttccctccgtcggtgcagcccagccccctgccctcctgactctccatctttctaacacggaggggagtgctgggcttttgtgaggcacttaatggttatctccccagaatataggctcagcgtcgagggcgtagaagagttccttccagataaggagcacatcttaggatgtgacttgaattctctagacttccttgggtttagcgctgagtgaagaggcacggagagggtttggagctttagggtaaagcactgatggaagaaaggaattctgccacttactggggtgcctacgggctctcccacttatggtctacgtagggattctaccactgtaccctacttaaacggacctaccacttgtgcgtactgccacttatgggtctgctgcgtggccgtgggtaaataagcttccttcttccctgctcccataaggccctccaccaggcccccttcattatggttctctgttgtttgatggcagaaagagggatgttgtttctctagggaactttggaaggtgtgacttggaggtggatgctagaacttccgccggaaattggagctccagaccctcctcttccccaggttcagttgctttgttacccgctcttgctacacctccttcccctcaaactctgcccacctctgaaggggagaatgattactcacaaagacaaaccaagcacagaaatagccaacctatttgtggcttaaatgcaagcagttttatttttacagtgagttgctgtattttctctaaggataaatcattatctaccaaaaatgcgactccagctccatctgtgatagttcctgctttgttagtggtgccaattagtcacaaaacaactggggccttccgccacccactcaagctgggggcaaagagagccacctctttctgactctcccggccggccaccaacccctttggagactctctccctacctagaagccatcgggccaccctggcttcctggcggcttgctcttcattcaccttgggaccattatcaatttccaaattgggcagcttgttgtcctctgcccgtgtggacagacttctgttaggcactggaaaaagcaaattggtgaggacctctgttctgttgacttacataatgacgttggagtcctccttctagttggtcactctgcgcagggtttcacagcacccatggggacagggtgaaatgttcataacatctgggcagcccctgatctgagaagcagcgaatgtggagcagagaggatccctctgtcgtatcccatctccttcatccctcatttccttcgggatcaattcctcccctgctgggattggaagcttcctgggcagcctcttatttttccctaatcatgttttcttccgtgggtctgatcctttcccacccgtgctccttcttttctgccttgcagtctgctttagatggtgcctgtttcctttttagtttctgaccatcctctgggaaactaaagttcttcaggaggctgaacttctccttccttggagcatcagaaccaggtaatgagaacacctttccaacttcaagaccgagttcacctggtctgttgatttgctgctcagcactgcctacccagtagatgcctgctggcttcaggggaagctctcttctctcccctttcttcttcccactgggagggccgagctgctggtcaggcttcccacaagagtagtttggctctgccctgggactatggtcttcctgcttacgaaaacagtcggaggggaacttcatctgtgggttcctatgtctgctttcccacagagtctgaaactgccttcttaccccttttgatatagttggtccccgaggttcttaatactttggcacaatatctatgaaggaatccctttaaacaagagaaaatgctaccctgagtgaggggtgggtcttcaggcttgggatctcagacttggctacctgagatccaagagatccagaattctcagcctttggggcttcacattgagttatttgaaaaatgggtaacatattggccatttttggtttttaaaaggtagaaaaacaaaaaacctaaccaaacaacaacaacaacaaaaacacaaaaaatgcagaacagggatcggggaaaaggaatttgctctcatgttcctgactgcacgggtgagagttggcatctaacagaaacagctactcccaggaggagcccccggaccaggctgggacgcagtctgggcatggccaatggtgcagacccctgccttcacccctgaacacactccttggcttgcttgcttttcatagcatcctacgggtcttatatactacactgagcatgatactctccgaaactgggttggagaagggaacaaatccttaactatctagccatgtgtctcccgtatgtctctctgggtctatacatagactcatctcatcattactaggttttgagttaatattattagctccattttacagatgagaaaaccaagtcttagagagcttggcagaggtcacataacttattagaaactgagctgggaatttgagatggttctgtctttctactacacatgcggttttgcccttccatgtggcatttctccacgtcatctttctctttagccctggctggccttagtggttcaaggtgatccactgccttgcattatcaccagctcacaccccgctctggattggcgtgaagattttcacttgagtgtgtcactgaatgatgccattggaagcttctgctgataagcgtgggaccatctgcttggcacatctcaaatattttcagcagtgggagagcagctctgattccttcagagatgagaggctgcagccatccttcgagatgttgggaccggagaccctgcaggctggctgggcattgatgccccagatgtgaaggggcagccaacctgttggccacgtctgacccttcctgagcaaatgacaccagtgagtctgcgtcccagtttttcattgcttagctgtccttgacaaccagagtaagattttctctctttaaaaagctatttcttggataactcttttctgtgctggtttttctttcttttatttttttcggtgtgttagatgtttgccgttggtgtgtgttggcaaaaacttctctttcctcctgcctttgttttggaaaatttacttctttgctgagttaactgttcccagacattgtttttcaacttcagggttgaaacttcgcagtagcgttttcttttttaactcgttgcaggggaaagaatcttaggatcaattcacagtttgaatggtggacttggaggttttcaaggctgcttaatgaaagcttatgaatgataaagaagttgaggtttgaaagagttgttactgaatttgattcctctggagaaatcacttggctatcagctctttggcatcacaggggcaagctgtattgatttttcttcatttttccttagtgggcactggcatcagtattagcttctgttgcttatgaagccgtatgcattcctttggtgacaagatgtctgttaaaaggaatctcctgcccagtcttgatctttggtatgagcgtcttagcaacacttcccagccaggatacttaggagtaatttggtgagagaatgtatagtgtgttgttagattgctatgggtgcagcagtaaaaaggtggtaagaagctggcctctagcagagtgccacggcctcggcactactggcattttgggctgggtaattctttgccgtgtgggctgtcttgtatattataggatgtttagcagcatctctggcctctaccaactagataccagtagcacactcctctccattgtgacaaccaaaaatatcttcaggcatgccaaacatcccttaggggacaaaatcaccttccccccttttagaccagggctctaaattgatcctgtggtatgtttggaaagggagcaagaagtctctgcttctgcgtacagatggccctagtgtggggaagacgggaatgatgcatttaataccaggacagatggtcctgccctgtacattcccatcggagcccttgcctgccatggaaattccatctcacaaatgggtttctgtttgtccaggtgactgcacacacacacagggaagaatttgcccttttctctggatctgcacacctagaaatccagcctagggtcaggctgtcttttaagttgcctgggaacaacaggcgctttcagatggcccactcccccagcctgagttttattggcttttctctctttccttttttctccctgcctttctccccagccccctctttctttcttctaagagtgatgtcctaggctgggtatctggggccatggaaggactgtgctcaactgaatgggaatgtggaaggggttgtttgcttctgaggtctctagagaacacttgagcagcataaatgtatggcatttagaactctctgctgactctgagtctccttgttttttctatcagctccaccacccatctgttcctctcactttcattgagaggtaattgcagccagcaatctcaggtggacctggcaggacacaggctctgcaaagcccacatccttacacatcaatggaaaccaccatgcttgttttccctgcttgttgattcattatctcagtttggcatttccatgagactcatattggcaaagtgctgttcaatctctagcatttcttataccccagcctttcaaactacattaaaatgccagcatgtgaagcagttgagacccagtggggttaatctgcttgatggaggacttgcctctcatggtcagtttgactgaaagtgcagctcccaggccaagcagccgtaggcacaagcagaataggctgtggcctctgcactgtactttgatcaatgtcaaaacccctcttctcaaaagtctcttctgcattcagatgcgatactgcccacaattctttgagttttgcaggaaggtggtgggtgttaagtcctactttccaccatggtcaccctggcttatggtgtcttgtgtgaggtgctggagcctgaataggcaaggatcatccccatgggggcagccacgccggggtgagggcagtggcagtggtgacatggcaggggatgtcagtgctgggcagggcaggatatctgcatggggggtacagggaactggtgctgggtgttggagctcctgcagtgtgaggtctgtgtctcagggtagggggcagggggagcactggtccaacaggaagtaaaagggcccaacaaagtgaggagggcatctgtgcaggggcaggggaagagcagtggcagacataggcaaccattcataggtgggttgatcaaatgagtaaatgcatagagggccaagggagccaggtttctcagagaagggagttacaaatatggagagggagaaaactcaaatgaattcactggtggtgggtcaaaactggagatattggtgtcaatttatgattatatgtatatattttataaagatataaaaagacatagaaatacagccataggtgtgtgtatgtatgactatacataaatgttatctatgtacatatattccttagccctgccactgagaggggctgggagcagcgacagcctccatgcaatgagcacattttacacccagatcttggcttctaaatataattatttactgaaaggaaccagggctccttggagaaatggctgattctaggcactagggcaggggacatacaagattatggtaaagtgtccagttttttgtgttggaaggctattaggcatattggaggaagtgtggaccagcggggaaggttggattgctgttttggcccactgagactgctctgccacctgatgaggctcagttggagatacccaggacatttgggtatatgggtctgacatgctggggagatgtgtgagctaaagctgtgcatttggatttcatcagaaaatggtgatggttgaaatggtgggattgaacaagaccacccaaggagagtctgtggagtaggaagggaagagggtcgagaacggagcctgcagactggccaacacggcaaaactccgtttctactaaaaataccaaaaaattagtcagatgtggtggcgggtgcctgtagtcccagctacttgggaggctgaggcaggagaatcacttgaacccgggaggcggaggctgaattgagtggagatggcaccactgcactccagcctgggcgacagagtgagaccctgtctcaaaaaaaaaaaaaaaaaaaaagaatggagcctggtggaactccaaggtgcaaagggcagtgtaagaagagatccagcgaaggagaaagaagaagaactgcaggaaagcaggaggagagccagagggaagaaatatgctaggctctggcatcatctcggagacaagaggcgaggagacgtgaagtggggttccatagcaacattcatgcattggggaggggctcgagccccagatcttgtctcacctgcttctagaggacttggctgagagcgctgcgctgttgaatgcactggctcctttctcttatttgttctgatgaaaggacatgcctgaattgccccctctgacatcaattatctttacccataatggtgaagcatggtgtccttcatcaatagatgtgtttattgataatagtgatagctaggagccactctgtttcacagaagaaagtgaaaacagagacaatatttctgaaaacaactcattcctgtgtgtttgtgttgttttggttatgggtttggtattgggtaggtggtgctttaataaataaaaatccattctttgataaataagatccatcctttgataaattaaaaactccatcttttaaggatcttaattactaacaacccagttgattgtgcggttgcttctggcgacataaaagccgttaataaatgttccaaaagtcctgacagccccatgaatgggtgtgtgaacttcacacatagacggactgttgacaatgagctggtgtgtgtgtatgttgggtggggcaggggagggctagaaatagtgccaatttggacctggggcaatccaggctctgctgctgcctttgttactaagtatgtaaccttggactagtcctgagttaatttcctcacctggaaaaacaagggggtggtttgcagtatctgcatgattttttcaagctctaagtcttaatgatcagcacaggatggtctgactttaccaataagaaagtgtttttaagaaaactccaagccgcatcctttcatgtcttttataaaatactccagttgctggggaaaaatataacatatacatatgttgtaacgtataacatataacaaattgccatatttacaaatgtttcttgcagttcaataaaagaaatggacatagagtatgaaaaaacaatccatcaaaaaatacaagtaaccgttaacataaaagaatgtccaacctcattaggaatcaaataaatgcaaattaaaacaaggtatcttttatcatctatcaaatttgggaatttaagaaactgaagatgttgtagaaaaagaaacatatatatgctgtgaaaaaaactttatatactgttgatgttggtattaatataattggcatggttattttggatgacagtttgttaatacacatttaaatcttgaagaacgtttataccctttggtctagcaattccacttttagaaatatgtcctaggggaataattagagatgtgcacaaaatttgcatccatatgaattcattacggtgctttgtttttaaaaatagcggtgaaaaatcagcagcaaatggatatgtccaaggctaggggattattaaaaatgaataatgaaagctgggcacagaggctcacgcctgtaatcccagcactgcgggaggccaagacaggagaatcagttgagtccaagagtttgagaccatcctgggcaacatgggaaaaccctgtctctacaaaaaatacaaaaactcagctggcatggtggcaagtgctctagtcccagctacctgggaggctcacttaagcccaggagatagaggctgcagtgagctgtgatctcactgctgcactccagcctggttgacagggtgagaccctgtctcaaaattataaatatataaataaataaacaaataaatcatgagaccttcagttagtgatactgaagtcatacttttagagtatatactgacatgagtaaatgtttacaatatgatactgagtaaaaaaaggtagaaagaaaggataccaaaagattataaaatgcaatctcaattttaaaaacgagcgtgtgtaagacattgaacaaagaccaatggaatatcctaaatgttgaatctggttaatttttaatagtagttgtatgtgtggattttctgaattttcttcaatgagcacatactgctttaaaattagaagaaaggcgataaacatttaaaagaaaatatccccattttgtgttaagattaaagaggctataaaatgagccctgctgggactgtaactgcctaaagggttctctttgcctgctgcccagacagagccgatttatcaagacgggggaattgcaatagagaaagagtttaattcatacagagccagctaaactagagaccagagttttaccactcaaatcagtctccctgaaaatccagagactgggtttttttgtttgtttgtttgtttgtttgtttgtttttgagacggagtcttgatctgtcaccccggctggagtgcagtggctcgttcttggctcactgcaagctccgcctctcgggttcacgccattctcctgcctcagcctcccaagcagctgggactacaggcgtccgccaccacgcccggctaatttttctgtatttctagtagagacggggtttcaccatgttagccaggatggtctcgatctcctgaccttgtgatccgcccgcctcggcctcccaaagtgctgggattacaggcctgagccaccacccccggccggagactggggttttttttaaggataatttggtgtgtagggcaccagggaatgtggagtgctgattggtcaggttggaggatgaagtcacaggaagttcaagcagtttgtttttgcggtcttctgtttctgggtgggatcacagaaccggttgaggcagattatctgtctgagtggcaccagctggtgcatcagaatgcagggtctgaaaaatgtcttgagcacaaataacagattttacaacagtgatgttatccctaggagtaatggggaggtagagaatcttgtggcctctggctgcatgactcctaaaccataattttgaatcttgtgcctaacttgttagtcttacaaaggcattctggtacccaggcaagaagtgggtttgttttgggaaagggctgttattgtctttgtttcaaagttaaactataaactaagtttctcccaaagttagttcaggctatgatcaggaatgaacaggggcagcttagagtttagaagcaagatggaatcagttaggtgagatctcacactgtcataattttctcactgttataatttttgcaaaggtggtttcagggtaatcatttttttgatggcagagctctttgaacaggcaggtgtggtttgatcagtccctgcggactgcttcacagtggactacttcacatgcagagaccacatagtggcaaagtcacaactagaaattaaacaagtcttttttttttcttttttgagatggagtctcactctgttggccaggctagagtgcagtggcgcgatcttggctcactgcatcctctgtctccggggttcaagtggttctcctgcctctgcttccgagtatctgggattacaagtacatgccaccacgcccggataatttttgtatttttagtagagacagcgttttaccatgttggccaggctggtcttgaactcctgacctcaggtaatttgcctgcctcagtctcccaaagtgctgggattacaagtgtgagccactccacccagcctaaacacgtcttaataaaaaatattccctacaatatggtgactttaattccttaaataggaaaggttagaggcagactagattcaaaaacttaagtatagagaggctgtaaacagtaaagtcttaaaaataggattaggccccagagtgtaatggagagagctccgggctaagatcaggcacgctgggccacagggcttctcaaactggttgtgaaggttggcctgcctcacaggctctccaacaaccactcactgtcctgtaaagttgaggggtttggtagaacagtgatttccagactcctcctcctcctcctcctcctcctcctccttcttcctcctcctccctcctcctccctcctcctgcctcttcctcctcctacctcctcttccttttccctgttcctccttcctcttcctcctccttcctcctcctccctcttcttcctcctccctcttcctcctcctccctcctccttcctcttcctcctcctccctcttcctcctccttcatcctcctccctcttcctcctcctccctcttcctcctcctcctcgttccttctccttctccctgcttctccttccccttctcccttcttctccttctcctcccttctcccttcttcttctttcttcttactgtctcagctcatggtcagaagtcaagtgacctggatttctgcctggccagcactgtgattaagatccacataagtttctgggcactacagccctgcaggacccagggagcaccagacacactggagcaaaggcagttggtaggcccttgggctgtgcaaaacggtggctctgagcctggcatgttttttaatccttaggtttttccctctaaaaagggggcaatgatgtcatccttatcagcctcccaagctgatttcaaggctccaaagctaggatggaaggaaaggtgctttggccccaagagccccacactgcgatattctcacagtctaacttatttctttctccctagacatctctttcgtgagaagaaagagaggagggaagatgctctgtgatgctgccagtaatgctgaccagtcgtggtgctgtcacctccttggctgtctttgcaatctgttcccaactgaggtttccattgcagtgtaactgaccactccaggggccactgagggctgtcaggatgagctatccctccaccccaggctgtcactgccaggtaaacatgcatccctgcaaatgcaagtgctgtgtaagaaaaatgattggtggccgggtgtggtggctgatgcctgtaatcccagaactttgggaggctgaggcaggaggatggcttgagcccaggagtttgagaccagcctaggcaacatggtgagaccccatctctgtaagaaataaacaacaacgacaacaaaaattagctgtcatggtcgtgagtgcctgtagtcccagctactcaggaggctgaggtgggaggatcacttgagcccaggaagtcaaggctgcagtgagctatgactgcaccactgcactccagtttgggcaacagagcaagacactgtttcaaaacaaaacaaaacaaaagataatgaggccgggcgcggtagctcatgcctgtaatcccagcactttgggaggcctaggcgggtggatcacgaggtcaggagttcatgaccagtctggccaagatggtgaaaccccgtctctactaaaaatacaaaaattagctgggtctggtggcaggtgcctgtattctcatctactcgggaggctgaggcaggagaatcgcttgaactcgggtgggagaggttgcagtgagacgagatcgcgacactgcagtccagcctgggcgatagaatgagactccatgtcaaaaaataataataataaaaatgaaaaatgtttggcatgtctgggcagagagcctctggtcctagaattgagttgacccagagagaagttaccctactgattcaccctgcagtgcaagtgcctacctcgtctgcatggctttctgagatctcaactgtgtggtcttctctctgctgttggggaaggctcactgagccaacactaaattattctgagctagactgttttgtcagctagcagcaattacccttctactctcctcacacttcccaacctcaaatatccccgtcagtcatccaccgacagagttgaagaatccacaaaatgaccaaggagctgggggaggaaagggctagggtgacgagcacgtagggccggctgttgtcaaggcatttctcgccatctgctatttcacttcagagaccgaaactcagttggttgggtaagactgggaatgtgatttttagcaatgtgtttgtttaaatagaaccccgctataaaaacaatttggaggattatgattcgtttttgaatgagaactagttttaatggaattttttatgtgcattccaatcatgactaaaatccgcatcatgatcaaagtctgcctgagtactgtatgtgcttcatgagttgtgctctaaccattagaaacccatgtttattcagtgtgatgccctgcactgaaagtggtggttttctctcgtggggaagcagagtgtattcttagaactgttataatgggctttatttcttgaaacagtttgataagtatttattaaatgcctactgtgtgcaagtgttggagattcagatgcaaaaaggataaggtcctggtttcaaggagtttgctgtttagtgggtgtattaggctgctctgactgccataacaaaatactatggactgggtgacttacacaacagaaatttattttctgacagttctggaggccagaagtccaagatcgaggcaccgtcagggctggtctggtgagggctttcctcctggtttgcagaaggctgccttctccctctgtccgtacatggcttttcctctgtgccctcacagagagagatctcttatgtctcttccccttcttacaaggacaccacttctattggattagggccccactcttaggaccttatttagccataattacctccctacaaggccctatcaccgaatagagtcacattgaggattaggacttcaacatatgaattttggaaaggaacacaattccgtccacaacagtcaataagatagaattttaactctgaggccaggcacagtggctctcacctgtaatcccagcactttgggaggccgaagcagggggattgcttgaggtcaggagtttgagaccagcctggcaacactacaaaaaattaaaaacaaaattagccaggtgtgatggtgcatgcctgttgtcctagctgttcaggaggctgagaggggaggattgcttgggcctaggcatttgaagctgcagtgagctatgattgcaccattgtactctagcctggtcaacagagtgagactatctctaaactttttttttaattaaaaaattttaactctgctctgttacaaggagaaatgtcttgggtatgaacatagcaagatcccatctctacaaaaataaaaataaaacacaagccaggtgtggtagcatgcacctgtagtcccagtgatttgggagactgaggcaggagtgtcacctgagcccaggagttcaacctgcaattagttacgaccacacagctgcactctagcctgggcaacagagcaagaccctatctctaaaaaaaaaaaaaaaattaatgaaagaagatgcaatttgaaacacctttctcagatgaattttgtgaatttatttggaaacttttggggaaaagaagaaaagttgaatacagaaatagaaactggtattgtgaaaggaaagggtaggacaggccgcttgggagaatgggtcagtagtaaaaatagagcatgccttgaatctaggatgagcaagcagggtgacagagaaggggaggtgacctggggtaactgagagctctctccacacagcaagaagttgcagctgaaggatgtggtccatgagagatcccagggcatggaccagaggcagaaagaggatcttgtcagtaacctcaaaaactcggattaggtcctgaatttacatctctggtctttggtttaggtttgtaattaaaagatgaaagcacttggcttccttgcataagcgactttggttttgccatggctgtctacctgtgttggccaacatggcagccccgagtcacatgaggctcctgagcatagggaaccaggctcatctgaagcgagatgcactgcaagagtgaagtacccgctgcatctgggggacttaatgcatgcaaaagaacatgaaatacctcatccatatttttggtattgatgacgtgttgaaataatattttaaacacattaggctaaataaagtatgttattaaaatggattttgctggtttctttttactttctttaacatggctattagaacttcacttgcacaggtggcccacgttgtgtttctgttggacggcgctggtccaggcccttgtcacccctaccttttgtgtactttgaattttcttccctctctcctctctctccaacaccagcagcagcaggagcaacaaaacaccagtctctgaagtgcgtgccggccactgtatcgcctcccaccctccttgctgtggttggttcggacccctgggctgctgtcccaaattccttgacgatttcagcacctggattacagccacgttttccaacaatattcctggtctccaacactatttctcagcgatttcagcatctgtggataattcttccagccctgtggctccaggttctgctctcagctcaaatgatcttatcctccactctccctcagcccttcttttccacagtcacactctgcacttaatactgataaccccaaaactacactgccccaggctcagttttaagcgtcacgttctccagcccccacctcctccttccccttcagtgcctttagtacggggacttcaatgattccctgacaccgctgggacctccgatatgtagctcctatttcctgctcacatctgttacctccctcatgccctcatttttctcctaaccccactgggctccagagtccatcatcgtagcccttcccttctatgtgctttgcttcctttgacccccactctgtgtcgtacccgcctggtaaaccccagccctggttaaatccacctctcctctttctccatgtcggcacctggacagctgaactaagccgtagagaagcacaggtgaggctgagtagtctctcccaggttcccgagcactaagctgggcgggctgtaggttagcctggctggagatcctgcactttgtgtatgtccctagccctctctttccctcatgtatttcacatcgtgccctctctccttaaaccctgaacatctcctcactcttagctgatgaccttgctccttactttactgtaaaagagatactgcactttcagaagacagcttctcgccttgggcactcccacaaccacatctacccacctcaccggatctgcagccacacaccctgccttccccttcaccaggtataaattatgctgtggcaaggctgtgactcctcccagctctagacccctacttcctgactcctcagttatttgctttctatccatgtataattcttatccatgtatcacttctcaaccccacagcccccaagagggttgtctacactcactgtcttcacctgttctcctcccattctgtctaaaccacttgcatcaggcattcattttgtccagtctactgaaaatactcctaccaaggtcagcaatggctccactcccatggtcaatatcaagttccgggtctcagcccacttgaacttgcagtagaatttagcccagttgattccactttcttccccttgaactcgttcttacttggcctcctgggagcccttcttccccagttgtcctcctgcctctctgtcaggtcatcctcagtttcctctccttcttcctcctcatctccccagcctctaactttgaaatgcctcaaggcccagtccttgaatgtcttctcctttttaatggcccgtatttcacagatactctcatcttgcctcacagataccctcgtcttgcctcacggcctcaaattccacctgtttgcatacaacacccacatttatatacccaagctacaactttcctccggctcctgacactcccctggacatggcctggctgcctcacaggcttctcgaactccacaggccctgctaacccgcttcacctgcacctgtccattcagcaaatggctaaacacgtattctctctttctaccacaacacgtatctcttccgtcagtgaatcaaatcgaagacctcccaccagatagtactacctctgccacaacctgatttatgctaacatcctccctgtgtctaggccagtgccttcacctcccacctgacctcctccttcctgccatggcccctagagtgtcacctgaacacaggggccataccgaggctgttcacgcctcagtcccccaagttaaccacattcctcctctcagaacctcctgtggtttattatctcactgggggtaaaagcaccagcccacaaagcccgtttggacctggtcgccaaagacccctgccttcagcacctgactgttctccttgccgggccgttcctgccttgctggcctttctgcggttcttcactcctggctgcctcctgcttctggaacttcgaacttgctgtttcttttgcctggaatacttttcccccaagaacctgctggcctcggtcgcctatttccttcatgtctttgcccaagtgtgacctcatgagtgagacgtttcccatcacactatggacgatggaacccccaggtccctgccactcctttcctttaatgatgctttacttttttccatagaactgttcacgcactgacatcagtttgattgttgttgctgttattgtattttgcttgactgcctccctactgggatacagactccaccaggccggcactttgttttatttactgccatgtcccagtgcctagcacagtgcctggcatgggctaaatgtgtggggggagaatttggggaacatggtggtcttacttgcaaacttctaacaaggcctggtctctacagcagggctttggttaggcatgacagggcatgcgagctctcatcctgtgtgggttcttttccgggtctctgtctactaattatgaagtaaaaggaagctctcctccagtgaaagtaatttcctgcatcccattagaacagctgagggaagtgtcaatgggataggtgtgattgggaccacggaggcagtgtcctcctgggtgcctggatcacatcgctggaaggaaacacctgtttcaccaacccaaaggctacctgctggtccagggtccaggcccggctgtactgagatcacagctcagggccctgcacatgctggggctctgctgacttgattctagaaatgtctaatatcaccagaaccattcaagtgccacgaaataacacatttatgtattattctgcttcaggtgagctcaggaggaaaagacagatatctattcactaaaaatattcttttgattggccggcacggtggcttacacctgtaatcccagcactttgggaggctgaggcaggtggatcacctgaggtcgggagttcaagaccagcctcaccaacatggtgaaaccccgtctctactaaaatacaaaaaattagccaggcattgtggcacgcgcctgtagtcccagctactcaggaagctgaggcaggagaatcgcttgaacctgggaggcggaggttgcagtgagctaacatctcaccactgcactccagcctggtgacagagcaagtctctgtctcaaaaaaaaaaaagttattttgatcaacttcttatggacaaagttcagaaagcaaagaacaatgttttactacatacacatacacatgcatgcacacaaactagaaaaaaaaatttttttgagtgctttgtctggcatctggcgatggtgtttcccgcaccatctggcctgtggtctgtggggacgtacatacgtcttgttagggctctccatccagtccacacatcaatggcttgcctggcttacgtagtctgagcaggtgcccagctttgtcgcagatattgaagccgtgtaaaataaatgccttttgattgttcacactttaagcaatattggtacaatattaaacccattgtcccaggcactccctctccttactgcttatggcacttcatgtattaaaaaatgacagtggcagcattgcccagacatgcgttttgtcatcaagtcttaatgcagtccacctggtccctcaggcaaatgaatggaggcacagaagatgaaatgattttcaaaatgccattaggaaagctcaggccagaactggaaatgggtcccgcacagggcactcggccactcttgcctggccatctcctttttggcactaagccacaagcacacaatgatatagaatgaatggttatcactggggatccagaagggtcattcaatcagttctcagtcttatcaggtctaagttcctttcttatcaggtcctaaaggcctaatcttatcattgtgacaaagataactgtagagtctgttaaacttttttttaataacatgaagattatgatttatagctgaatttctcccttttattccaattcaacaattttcatggctttttgtgtttgttttgttctggacatatttacagaaaattacctgaagagttccaacctgaggcctcctcatggatgggtcaaacgtgacatcatttgttgttgaggaacccacgaacatctcaactggcaggaacgcctcagtcgggaatgcacatcggcaaatccccatcgtgcactgggtcattatgagcatctccccagtggggtttgttgagaatgggattctcctctggttcctgtgcttccggatgagaagaaatcccttcactgtctacatcacccacctgtctatcgcagacatctcactgctcttctgtattttcatcttgtctatcgactatgctttagattatgagctttcttctggccattactacacaattgtcacattatcagtgacttttctgtttggctacaacacgggcctctatctgctgacggccattagtgtggagaggtgcctgtcagtcctttaccccatctggtaccgatgccatcgccccaagtaccagtcggcattggtctgtgcccttctgtgggctctttcttgcttggtgaccaccatggagtatgtcatgtgcatcgacagagaagaagagagtcactctcggaatgactgccgagcagtcatcatctttatagccatcctgagcttcctggtcttcacgcccctcatgctggtgtccagcaccatcttggtcgtgaagatccggaagaacacgtgggcttcccattcctccaagctttacatagtcatcatggtcaccatcattatattcctcatcttcgctatgcccatgagactcctttacctgctgtactatgagtattggtcgacctttgggaacctacaccacatttccctgctcttctccacaatcaacagtagcgccaaccctttcatttacttctttgtgggaagcagtaagaagaagagattcaaggagtccttaaaagttgttctgaccagggctttcaaagatgaaatgcaacctcggcgccagaaagacaattgtaatacggtcacagttgagactgtcgtctaagaactgtgagggaagttgtggataaaaatggtggaacacaggtcatttttagtttgtgcttggaatatgacttaagtatctcctaaatgtgatacagaagaacatctcatcccatatgcatgagatactaattaatgatgaaattgaactcttgtactgtatcttctggaaatgacctgtcatttctgtacttgacaaagactctatttctttcagctcttttggcagcatcttaccatgaaccataaaaatgacttttgcaggaagatttacagatgtgtacgggacaaggtaacaaaactatttgttggaacttgaggaggcagcttgatgtagcaggaagaacaagggtcgcttcctgtgtgacctcaggcaagttgttaaacctctcagagcctcattttctcactcataaaatggttgcggcaatagtctatacctccttggtctgctgtgaagatgaaatgagaagatgaggcttgtaaagcacctggcacattgtggatgttcaacaaatatcagtctctcctcactcccttcaatggtagacaagatataaatttttgttttgtaaagcacacacacacacacacacacacacacacacacacagctctatcatgtacagaagttattatgtgtttttacatgttgaatgtaaatttacgaaggtcttctttttgcttgcagcatgaaagcatttcatggcattacacctctattgaaaaacatcgcggatgttatgatctaacaagccatgtgctagtgcatcatttcaggttgtgaagaaatacatttggccaccagtagaggagtttctcatggctccccttccctctgtgggaatactagatgaaatgaaagtctgtgttttgaaatcctttgattgcataaacatttttacgaatggagttgaatttatgacttcctgggggtgactgggaccttcctcccccatgaagaggtgggttatttgtagccagagttctcacctgcagccaagtgcgggtctctgcacctgtctgcctcctctcctcctgaggctttttttttttttttcatcacacctggaaggaggctcagtggcaagggctaatgaaaatgtggtcacatcctggaggactctgatatttttgctcatgacagatccttgcatgacttcctcagaatctttactcagcactccagggggggctctgcctcttgcctgccatgagttgccctccagacactgcacgtcctgggttttagctgtgaagcccgtcgcatagctatgtttatttccttctgtcccttctaggagttccacaaaagggcaatatgtcacatgattctacaggttgtaaaatgttcaagtccatagaaatgagcccgatagtatttattttaaccatttgctctttaaaaggtcagagaggcagtgatgtaattgttctctgttgctgcttgtccttccccatcctcttcctttctcaaaagaaatgatgtggggcagcttcgctgggggagaggagtctgtcccctcgagcaaggaccccactgccagccaagcttggatgcaggaggcttttcagtgggtgacaacatctgattcagaaacaaggcagctttgctttcaggagcccagatggggtgtggagcaatgacatttagaatgatcttgtttttggttgaaaacagagcattttccctgggaaagaacagaatatggagatcagagcaactcccctctgtttcctgtcctctcctgtgtgtgctgtgtgctggcctctggggtagggaaagggggccaacctcgtctcatctctaaggggatcttagtctcaaagaggaccctaaagactatcagatacaaggaatttctacctaaggaaaatatggtgaactaataggaagcccctatttattgtttttctgcagataaagtggggaaatcgaatgtgataatgaatataaaaattattctaaccttttaaaatgatgccttaccaagaggtaggaggtaggattcagagtttggcagggttataaagactaatttctttctgtcttcccccaaacccattcccaaagtgaactgtaaggttaaaactataacaagaagatttaagtaaatttgcaaatatgtagagaatactaaatcatttgtatcctttaggcattcagacaatttgcctaagtcattgtaggttactaggtgccacttccgagaattccttggggatggggaggagattgtttggataatgcctgtcctaactgaacgggaagggtttgtagcattcctactacaaagattcatgcacagccttctctgcagaacaccatgatgtggacaaggcaaagacggggaagcggaagccgctgtctatgtcataggagaaagagacaccgcataactacaacaccaggctgcacacaagtttgtttgacaagtgttaggaacaaaattgtgtggcagaggtcaccacagcaggggctcttcctgccacccccatattgcatgcagcctcttctgttccctcccctgcccactggggtttctcctcagcactcatcatgccatatatcgatttgcttatttgctcgttctctgtctcttcacgctagactataagctccttgagggcagggacgtagctttgctcactgctgtagccccagcttatttgctgtgttggtcgaatccactgcacccctctctgggctgtttcctttgtacatataaatagactcaaattgcttccacctaaccagaagccattccttgccccacagccctttccagtttctatctcccctccctcccttccttccaaaccaccttctggaaaggctcttccacactcactgtcctgactcttgccacaattcacccctcaacatcctgccatttgtcttgcagcctgaccatcatagagagattggtccagataggaaggtgagtaacttccacagtgtcaaatctgatgggctgttttctacctatgccttttgtggcatttaatacccacagtcttcctgaaattatctcttttcttggattctagtttgctacatttttctccagctctctttttgaatcctatcttcctgattggaatcttctcacttctttcctccctcttctactgctcctcccttaaatggacacattttccataattcagtggctgggcctctgctctcctctttctgagaaatctccctggatcctgatccataatcacctgcttattaatgaacctcaaatagacatttgctgaccagaaccctttgctgggctccagtcctgtgtgtccaatcatctaatggactttttgacccaatgtcctgcaggtgcttgtaacccattcatttccccaccgtttcttttttcttttcttttcttttccttttttttttttttttttttttttgagacagagtcttgctctgttgccccagctggagtgcggtggcgtgatttcggctcactgcaacctccacctcccaggttcaagcaattctcctgcctcagcctcccaagtagctgggattacaggagtgagccactgcgccgggcctgcccctattcttttttcagtgaagtacaccgctggtcaccctgtcccccttgctatgctattccctttgcacagactgctctacctttttttaatctagcaaactccatttatccatctacgtccagctcaagcattagagactcaggagagcctctggaagctgagttcctggataaccgtgccataccttttctttcccagactttccacatctttcccttcctcactctcagcaaatgatggctggctcccctttacacaaggggaatagaagcaaccggaagaactcttccagacatccccgctgtcccctctgctgacctagctccatcttcttcatatcagcctctcccctgtgtgctcagggggaactcactatgcccctccctggctaaggtgataccctggctaagatgctccaaccccttcccctgttgcctgcccgatggcatttcgccagcaattctccctctctgtcctgcaccatcaatttcagtccaggataacggaggacagaattttcaggaatcaggatggaggagggttggtgaacagcaccactggccttgactagcctgctccctgccacacatactggttgtttctctggagacagcattgtatgcactgagatgagcaactggagagccaccagcagccatcccctctctttgtgcctcacagctccagtgactgatggagatggagatgggatcgttggctgccttcatggagttgtttaaggagcacttagaagatgctttacgggcatccctagaatttcaccattagaagagtagttctgttaggttgaaatttgtctttttactcaacctcttcttaaattaggaatcacttctggaaaggaaaacacatcaagccatacatactttttcctgtgctttttctcatggagaggagcagcacaagacaagacacccagctgttcaggctgctgaatgagatggtgaggagtgggtggtagaagtgaagaaaggaggaggtgggagcaatcaagtatttgcttgcttgattccacaaacaagaagcttcttttctctttaacctaacatttgactgtttaactttgcaaggttatatgggaaaaaaaatccttgatatgaaaacattagcaaatgtatcacttataaaatgggtaccatcaggcctccccctgcttagcaccagagtctctctcactgcctcatctacagttttgtggatcagtcttgtgatgcctgagagtcaatgtgcaaactgtcctcgaactttaattgatgatcttgacaaacattcaggattctgtgaaggaggtaagagaggtgtcacagaactgctaaaatacacttcaactattgataaaagagcatggagcagagttagaccggttagcagctgaatcagaggtaaataaacaaggatgatgatgagatgggagcttccaaaaagaagcgttttaatatcaaatgttgaagagaggctcttgggaaaactgctgaagtctttagatatttttgcaaaaattacccactttttgatgttcagcaaaagtaaccattaagtaaagacagaaaaattggctgggtacggtggctcatgcctgtaatcccagcactttgggaggctgaggtgagcagatcacctgaggtcaggagtttgagaccagcctggccaacatggtgaaaccccatctctgctgaaaatacaaaaattagctgggtgtggtggtgggcacctgtaatcccagctacttgggaggctgaggcaggagaattgcttgaacctgggaggcggaggttgcagtaagctgagatcgcaccactgctctccagcctgggtgatagagtgagactccgtctcaaaaaaaagaaaaattatgccaaaaaattaagtacttttgtggcttaaaagaacaatgtattgtcatttctcaaggctccatgggttgattgagttcagtttctcatttggcgtctcttgtagttgtagtgagttgttggctgaggcagaagccacctgaaggcttgactaggcagggcaatcgaggtggtacactcacaaggctggtcatttcctggggctcagctggaaaggtggaccagagttcctacacaaggccctttgatgtggtttgggtttcttacaacatggtgattgtgttctggaaggaagtctcctgagacttagcttttcctaaaggccaaaaatcagctattggggtctcatttgcttaaaattattggcatgttgttgaaattataatgagttttagtaaagcaaaattaaaacaattttcatgattttaatttcacttttttcatgattttctatgaaattttggtcctcattttaacaagattcctttttaacaatcttttactaaaaccagtcattcatggataaggagatcctcttacactaattatttaaatgtgtacatatacatgttaatacaaagggttgaattgttaaagcaaattcagagtgacttacagatcttacccaacatgaaactaatgattcaaatgataagaggcaagtgccaggcacaaatgaaacactcttttctggaggagaccaacagttttaattatttctggggtttttttggtcaaatttctcatgttgcttctagattgttttccaaatgtcatttagttttctatctgtactttttgtgattctctgaattctctgtcagacatttcggagatcttcaattcttctgggtccattgctacagctttgttatctcttttgatgttgtcgttttcccctgagttttcacagtccttgcacttcacgtcgatccccgtgcaattgagaagatagtcacctctgacagttttttaagggttcttggtggtgtcagagctttgctacttagtattggaacttaaactctggtctgttgtttcttcctgttctgagtgagacttgcggtgagcactggaacttaaacattgccctggaactatattgctgctctgtcaacatttcccagttcagggaagatgtaagtgggtatcagaacttaatcttgagctttttgttgtttccaggccaggggagggctctcgagtatacctaggctcgtggaaaatgcagccagggatttggacctccctgtggattgtgccagccagtcccttcaccatggtgtccccactgatcagagctcagagtgcaccagtacaccagttgctgcaatcagtgcttggctttttgtccccagttcaccccaggtcattcagctatcctggcattcccagtggttcctgtgggacggggccagagtgggtgtcccatgaagatgaccagatcagtggggagataaaatgctcacctgtaattctctcctgtcaccttggaaaccatggatctagagacattctctgagtgacactatgccagctgggagtggtggcacagtccgaattgattgtttctcttaccagttctggcttctttcaattctgtggacctagggggtttctcagcttctccccaaagttctggtgaattcagggtggtgttcttgtctttgaatagttggaatctatttctgtggggggaatggttccagagaatcttctattctgccatcttgttgagctctcccaaaatgtccccttctcctacattggcacacgctttggtttcacattgactgatgagttttgagcaacgtatacaaagaaacattgttctcaaaggaaactggtgaagtttgggggtgcctccattttgcacgttgttcattacacaagtagaatatacttatgtgactacccgtaccctttctccagcctccctgccccataaacctataaatcccaaatttatttataatagacaatcttgacagattaggtatatcctgctggaaataggactagttcactgagtataacgtttctacagagcagtctgattgaggtcttcagcatctttgcaaggtgccctggttgaggttattgttccgcaggcactcctgtggggaaggagtgatttgcaggcttcatgctgacattacctgtatggtacattttggccaacaccagcctgttaatgcctgaggcagaggcctctggaatgagaaaacaggactggaagcctgcctacttagtagcttggcaagtgtcaacaagttaatctctgtgactggtgacttagttggagttccacccaaagcagatcctgagacaaggatttagtgcaagtaattcatgtggccatcatccagaggagcatgggagaaagtggggaatttagacagggaaaggaggaagttagcaaagggtgagtgaaggagaacaagggcccaggacagtgaggccccacctcagaactgccctcctggaagggcgaaggagccgtggcgccgacccccacctcctgcccctcaatagggagcatcactccccgacgtcaactcccagctcttcctggcctgccctgtgctcaggccgagcatggcctaaagcagggaatatgtctaggcagagtgacacagggagccatgggcaggtacaggatctacctgcaagtgactacaggggtggcttcagggctgaccaatggcatctgctatcatggaattaaagtaacctaccccacgaagtagctgtgccaagtaagtgaaataatgcacaaggaaattctgtgtaaactttcaagcatcaagcaaatgttagttatttcttgaggacgttatgtaaagtgatataagccaggcccggaaggacaaagactgtatgattccactcatatgaggggcttagagttgtcagattcatagagacagaaggtagaatggtggtggccgggggctggagggaggagggagtggggagttagtgtttagtaggaactgaatttcagtttgaggagatgaaaatgttctggggatctattgcacaacaatggacatgtagctaaccccactgtactgtattcttaaaaatgtttcagatggtaaattttatgttatgtatattttaccacaataaagaagtgagttattgtactttcaaggcactcggtgtgtttctcaggatgctgggcagcccatggccccgagacaggtgccaagtcaatacttgggtgatgaaggatgaagacaaacctcctcttcatcttcactccagtgagtggagcactggcactgttgccagtgagaggcaaagacacgaggccaattcaacaacccacctcaaacctgtatttgcaagtgagtgcagactcccctgattccaatgaagctgctgttgagggccggatagcagccactcttggctttgcgggccgtacagtctgtgctgcaatgacaactctgtgggtgtgtgaaagcagacactgcttagatgaacgaggatggcggcacgccaacaaattcattatggacactaaaaattgaatttcatgtaattttcatgtcatagaaattctttcttttccccttcaaccatttaaaaatgtaaaaaaactattctcagcttgtgggttttacaaaaacaggtggcagccagatttggtagtggccggactttgccacctccagcctggagtgttttgggaattccccattctgaaatggtctccagtgtggctgcagcacgtccatttgacaatcctgacctcggtggtggcaaatcttccttgtttcctggtggatttaactttgcagaaggaccagcagacatcctgacccaaacctgatggatgagattggtgtaaagtggagaaattctgttttggattaatcacaaggagatttaaaaaacgagagattttctgtagtaagtacattgcctgtaaatagaattccaattctacatgctcagggaccattttgttcacttgtatcaaactatattctctggattcagagggaattattggaacttttcagagatcaggaataaaatgttcatgcatgagaattttgtgttgggcttttagaaggataaggatctcacatatggcttctgggtacagcatgaataaaatgcagttgctgacaaattaaaaaccagaacgttcctcatattgggttgattagcacttgcaggttctgtaccatcactatccttaacgaggaacataagccttgtcccaagttgcaggataaatatttcaggaactcagttgcaaaggtcagtattacattgatttattgatgtatgcttttaatcaaatgaaccctttagaattagttgcccttaggcaaatgtcagaagctcaaaacattccttaaaatacttaaaacaaaataatgacacaataaaacatcattaaaaatccttcaggctcattagctctagttaaagatggttgaatgcttatgataattgaattgagccactgagcacttcctgtctttcttcttccaagaggagagaaaatagatgagggctgagaagcagtcttccttctgcatgtgactaagctaggagcttgctaacccagtgagtgcatgacaatgctgatagtatttttggagggtttagcatccccaaatcttttcttttatttctacagaccaagaacaagggtatttccctgttgaattttaggtgtagacatatggaaaagaataatctatattatctttagatggataaagcttgcctatcagcctagtggcctgtgtcagtcctcgacgtccagccattttctcctccaggacagtggctcagcatcctctcccacaacgcttcgagcaatatcatgttagacagttcctgcttgctttgacttctccttgcagacctcctgcccagctggtatggcctgaaagcttgtgtactcccagattcatatgttgaaatcctaacccttcatgtgacggtatttggaggtggagttcttgggaggtaagtgggtgctgaagataaggccctcatgaatgagattagtgcccttgaaaaggaggcctcccattacctccctcaccccttccaccacgtgaggacacagtgagaaggtgctgtccatgaaccaggaagcagccctcaccagacactgaatctgccagtgccttgatcttagactttccagcctccaaaagtgtgagaaacaaatttctgttgtttatgagccacccagtttatgggattttgttatagcagcatgaacagactaagacaccaacttttgatcattttccttatttttcataaagttgctgaacagaagtgagggaagacgatgccagtgacagcagaacattgctgagggctgcagaaatatgacagcccctgggcccctgcacttcccctccctgcacagacaagagtatggtgaagaacggaatgaagttataacgcttgggaagtggcctgtgaggcctgatgagcccatgttctttctctcacgtggtaagaaatgaccccgagtgaccagaggggctcatcagagctgatctgagttcagtaaaagggctgatgtggaagatgaggcagagagtggaccttagatctcagaagtgtctgttggatgatggagaccttcacagagaacactttctcaggaagcgttcccagcagaggtctcagcccctggctgattcacagcctgcatttagaacggagattgagtcagaggagattccacctctccatgcattcccacagtcctgaaactagtcagtgttagaaccagaattcaaactgacggtctgagcccagagctctgctcttcatcttacccagtattacattcattcccatattgactgaagattcactttcactgttatcatgaaaagtaagttgagaaattgacatgtcatgtagatgctatgaggaatcactggggagagattaagatgttccttcaagcttcagatctttcagagagataagtagtgtggagttgcactgttgggaaacgagtcttggcgttctggctcttcacttgttcgcctgccttcctcctccagcccagctgctgcagtgtggcatgttacgcttacacttcatggaggaaatggaactggggctgctccaatgttctcttttcaggttttaatggaaggttctgcattcagctgcaccaacactgcttgcaaacaagaaaagaaccgagagagtggagaacactgtgcagggacttgggtatggattccagggagtatctggaaattcccacctcacaggtccatctcacctggtggttgttcctactgaaaaaggatcccgtggtcctgtgccctgagggccacaaacagcataaatgttccagagcagagcctggaagtgggagggtacagagggaagacataagaagatgggggtggaagcatgaagggcagttctaaagtgtcttggggagaataggagataaattagatgataatgcacaaggccaagggcatggcaaaataaggaaccaagaagaatgaaaccgatttgatgaagataaggattaacagtacacacagttatgaataaaagatgcattatgtaataattagcaggcatctataggttggtgcaaaagttattgcggtttttgccattgaaagtaaatgcaaaaactcgcgactgcttttacaacaacctaatacagcttctttcaccaaggagcttaaatgttttaaaataaacaaaatgtcgttatgcaccctacctccctccgcagtttggagcccttccttttccagaatgatgcagcccaggtccccctaccctttgttctcagcagcaagtctccggagaggttatatatatatatatatatatatatatatatatataaacaaataaatgatttacctttttgccttcctgtgtaccacattcagattttgcttttgaaaattccatcaaggcagctatgatgtccatgtttaatctacttatgtctgcatcaactgctaccctaactttttctctttatcactctcttgcaattaacattttgtcatacctgtgtgctacataatacatagtttttgtgtttttgaagtctataaaaatcatatcctattctatgtagttttctttgtattgttttttccactcagcattatgcagagtggttcaatgtctttgtgtgtagtgtagttcatttattttgactgctaaaatatattccactgagtaaatatactagattttatttatcctcttgtcagtggactgtttccaggtattttttgaaatgtggacatattgctatttaaacaacttttctatatatgtctccttgtacacttccgcaagaatttctcttgggtgtatacctaggagtaagattactaggtcagatttataaaacaataccgaagtgctttcaaggtgggccggtcagatcaagtgaaccaatttacactcccatccacgatatatgagtctacttccttcacattctctctgtacttctcaatgttggccaatctgcagggtgtaaaatggtataacgttgtgggcttaatttacatttaccagattacaaaagtggttgagcatcttttatgactcttagccatatggtatactgagttgaatagagtccctgcctcccccaaaattcctgtccacctggacctcagaatgtgacctgatttggaaatagggttttatagctgtaattagttaaattatattgatgttatactggattaggattgaccctaaatacaatgacatatatccttataagagaaccatgtgaagacagaagtgatatggtttggatgtgtccccacccaaatatcatcttgaattgtaactcccacaattcccacatgttgtgggaagaaaactctttcttttgtagattgctcagtctcaggtatgtctttaacagcagcgtgaaaatggacaaaattggtaccagtagagtggggcattgctgaaaagataaccaaaaatgtggaagcgactttggaactgggtaacaggcagagtttggaacagtttggagggctcagaagaagataggaagatgtggaaaagtttggaacttcctagagacttgttgaatggctttgacaaaaatgctgatggtgataggaacaataaggtccagaatgaggtggtctcagatagagatgaggagcttcttgggaactggagcaaaggtgactcttgttatgttttagcaaagacactaatggcactttgccttgccctagagatttgtggaactttgaacttgagagagatgttttagggtgtctggtagaagaaatttctaagcagcaaagcattcaagaggtaacttgggtgctgttaaaggcattcagttttaaaagggaaatagagcataaaagtttgggaaatttgcagcctgacaatgagatagaaaagaaaatactattttctgaggtgaaattcaagccggctgcagaaatttgcataagtatcaaggagatgaatgttaatcctcaagacagtggggaaaatgtttcgagggtatgtcagagttcttcacagcagcccctcccatcacaggcctggagttttaggaggaaaaagtggtttcgtgggctggggccagggtccccttgctgtttgcagcctagggatttggtgccctgcatctcagttgctatagccatggttgaaaggggccaacatagagcttgggacatggcttcagagggtgcaagccccaagccttggcagcttccatgtggtgttgagcctgtgagtgcacaggagtcaagaattggggtttgggaacctctgcctagatttcagaagatgtatagaaacacctggatgcccaggcagaagtttgctgcaggggcagggctctcatggagaatctctgcaagggtggtgcagaagggaaatgttggttggagccccccacagagtaccacctagtggagctgtgagaggaaggccactgtcctccagaccctggaatggtagatccactgacagcttgcaccatgtgcctggaaaagctgcagacactcaacaccagcctgtgaaaacagctgggagggaggctgtacccagcagagccacaagggcagagctgcccaagacaatgggagcccaccttttgcatcagcatggccccgatgtgagacatggagtcaaagaagataattttggagctttaagattcaatatgccctgctggattttggacttgcatggggcctgtagcccctttgttttggccaatttctcccatttggaatggcggtatatatccaatgtctgtacccccattgtgtctaggaagtaactagcttgcttttgattttacagtctcataggtggaagggattgccttgtctgagatgagacattggactgtgaacttttgagttaatgctgaaatcagtaaagaatttgggggactgttaggaaggcatgattggtttttaaatgtgagaacatgagatttggcaggggccaggggtggaatgatatggtttagctctgtccccacccaaatatcatcttgaattgtaactcccatgattcccacatgtcatgggaggaacccagtgaaaggtgatttaattatggggatggatctttcctgcactgttctcttgatagtgaatcagtcttatgatatctgatggttttaaagaggggagtttccttgcgcaagctctcttctcttgtcttctgccatataagacgtgcctttcaccttcaccatgattgtgaggcctccccaggtttattggaactgtaagtccaataaacctctttcttttgtacattgcccagtcttgtgaaaagtaactaacacaagaaggataagttggagtgaggcatctacaagccagcaaacaccaaagattgccagcaacctccaggagctgggaagagacaaggaaggattcttctctagtgctttcagaatgagcatggctctgccagcactctgacttttttcccctggtcaatgttaaaaaatttctctagcaagtccataatgctgtaattgccatagccttatataaatcttgatatctggagggcaattccctctgctgttcattttgtttaggataatagagcaactgttgccagggctctccccaaattcttttggattcatttgcattctccattgcactaccagttttttctgggagtacttcctaataaattactttcacatgtatctctgtctcagcgttttcttcggaacaaacttattttaaaaaacatcccatatagattttggaatatctcttcaggttacatgaaaatactgttgagattttgttctggaattatatagaatgtatagatcagttttggagcacaattgtggccttatgataagtatttttttacatgtgaatatgaaatatttttccatttatagttcttttaaaacaacttttaatagttttaataattttctgagtaatggtcttgcacatattttattagatttatttctaggcaccctctagtttttgttgctattgtagatggtggggggttgctataattatatttcctgttgctagtatgtagaaatgaaattgattttatttttggttctattttttgtgtatgtgcctggaaacttttggttgaattctggacactgcatataataaatgtgtctcaggaatgctttgtcaatctagagaagcctaaggactacttcttgaagaatatttttaaatgcagaaaataaaatctatgagattacaaagaaaccaattatatgaaaatgtaactgtattagtctgttttcatgctgctgataaagacatacccaagactgggcaatttacaaaagagaggggttcaattagacttactgttccacgtggctggggaagcctcacaatcatggcagaagacaaggaggagcaagtcacatcttacatggatggcagcaggcaaagaaagagcttgtgcagagaaactggcatttctaaaactgtcagatctcatgagacccattcaatatcattagaacagcacaggaaagaccccaccccgtgattcagtcatttcccaccaggtccctcctacaacatgtgggaattatcagagctacaagatgagatttgggtggggacacagagccaaaccatatcaggaaccctagttaagaatgctgcagttatgggtgatattattatcttcttccagaggtgtgtgctgcaagctttggttaggaagatagagtgagtttgatcatcttaatctaatcacgaactgagctaacttgaggctgatctgcactttggaagatgttgtctctctctgatttgcactcccctgctggggtacatctctccggaagttgcaaataggtgctcattttaatgttagataacttttaaccaagagaaaatcccaaccaccctgtgttttagggaatagtatatttggcagaagcaaatacatttccacagataatagcctcagacagattgtagatatcaagacatttaatcacagggttctgacatttaagaacttgggagtttggagttttgttggcttccagagataggcagaacttaataagccaaatcaattattctttagttttctgctgaaaaggctataaatagcattttacaagttctgtctgacatctttttatgaggaacattatttccaatatttttgtgacagaaagaacatttctaaatatatttgttaattaccaaataataaggcaaatgaaagatcagaggtcagttgccttccaccctttctttccatgattcaaacaaatgtttaagatatttttaaaggtacagttttaaccttttggttaatttacattgtattttggcaacagaaagggttatataatagtgcagcctccatctaccaaaaagagatctgaggggaaaaaaaaacctcactatttaaatttagaaatcttgaatgtttggttaagaaggaactgttttcccttttgacattttttacaggctttattgaaactggagctttatattctttttttaaaaagaaacaacaataaatatagtacagtactttccataacacattatttcagtggcttaaggtcagctggaagaaaaatgcagttctccacagtgtgtggctttaaagtggtcattataattctctactttattctccaaattagtgcaaacatttattgatcacctcctgcatgccatgcaccatgctaatcataaattatgcgatcctggttcagagatctttgatttcttaccacgctggagtgttagccatacaggactgctttgtgctaggcaagccagcaagtcaggggctcaaaaacaaagcagaataagaaaaatttcaacaaaacattcattttcaataaactcatttagcattttgcatccagaaggatctagaaattatttttactttcagcatacatataagttttgagttgtacggtttgatattgttctcatttgaagttcatagtgggtgtcataatcttttcagtacttgggaaccactaaagttctcaaagtagtttgcgttttaagctctgactttgccaagttgattgagagaagcttcagtggaagaaaggatacttaattcacccagcctgcttctcctttcctagtgcaccctctaccagaattcctgagctagggaaaagaaatgcaatgagcttggagacagatttttttttttttttttttttttttttttgagacagagtcttgctctgttgcccaggctggagtgcagtggtgcgatcttggctcactgcaacctctgcctcctgggttcaagtgattctcatgcctcagcctcccaagtagctgggactacaggcgcctgccactgtgcctggctaattttagtatttttagtagagatgaagttttgctctgttggccaggctagtgtcaaactcctgacctcaagtgatccactcacctcagcctcccacagttctgggcatgtgagccactgcgcccagccccttggggagagatttgatgcagaggacatggtgatttgaaagtgatcattttttccccaagagtttggacaggaacagaaagggtcaaaagaaagttctttaatgatacaatgaggactgctgtggtcagcttgaaggtttcaaggcaaatcaggaagaggcagccctgtacaataagctttactgggtgatgcttgagtggggctgcctgagaagagggggctccctcgcagcaggagaccctcccagaaggagaagagggcaagggaactccagggccagagagagtcaaagaagggccttatgtgtctaggtgacgtcactcagcaacaaggtggggaatgtctgggtcagagacttccaaagggccaaagtagtttgagatctgtgatggttaatttcacatcagcttgactaggtattgatatgctcagaaatgtggttaaatgttattctgttttatctgtgaaggcatttctggatgagatcaatatttgaattgtaagaccaagtcaagcaaactgccttccccagcgtggatggatctcatccaatctgctggaggtctgagcagaacaaaaaaggctgagtaagggagaattcactggctcggcctgaccatctttgcgccaggacaggggtcttctcttgcctttagacctggactgaaacttacaccatgggctctcctggatctccagcttgccaactacaggtcctgggacctctcatcctctgtaattgcatgaggcaattccttataaatctctctccctctgtgtgtgtgtatatacatagagagagaacacatttgctgggcatggtggctcatgcctgtaatcccagcactttgggaggccgaggtgggtggatcatttgaggtcaggagttcaagaccagcctggccaacatggtgaaatgccatctctactaaaaatacaaaaattagccaggtgtggtggtgtgtatctgtaatcccagctactcgggaggctgaggcaggagaattgcttgaacccaggaggtggaggttgcagtgagccaagatcatgccactgcacactagcctgggtgacagagcgagactctgtctcttaaaaaaaatatatttatatgtgttatatatgttatataatttataatataaattataacatatatttatatatgttgtatgttatattattatatataacatatataaatatatattatatataacatatataaatatatattatatataacatatataaatatatattatatataacatatataaatatatattatatataacatatataaatatatattatatataacatatataaatatatattatatgtaacatatataaatatatattatatgtaacatatataaatatatattatatgtaacatatataaatatatattatatgtaacatatataaatatatattatatgtaacatatataaatatatattatatgtaacatatataaatatatattatatgtaacatatataaatatatattatatgtaacatatataaatatatattatatgtaacatatataaaatatattatatgtaacatatataaatatatattatataacatatataaatattatatattatataacatatataaatattatatattatatataacatatataaatattatatattatatataacttataaatattatatattatatataacatataaatattatatattatatataacatataaatattatatattatatataacatataaatattatatattatatataacatataaatattatatatataacatatataaatattatatatataacatatataaatattatatatataacatatataaatattatatatataacatatataaatattatatatataacatatataaatattatatatatataacatatataaatattatatatataacatatataaatattatatatataacatatataaatatatataaatatatgttatataacatatattgtgtgagtacacatacagaatatatatagtgtgtgtatatatgtatagatacctgtgtatataatatattagaatatgtgcagttatccactgcataatgacattttggtcaatgatggacctcatatatgatggtgatttcttaagattataatggagctgaaaaatcgctattgcttggtgacatcattgcttctgtaatgttgtaatgcaacacttgattcatgtgtttgtggtgctgcttgtgtgtacaagcctactgagctgcaatcatataatagtatagcatatacagttatgtagagtacacaatacttgataatgataataagcaactatgttactggtttatgtatttaccatactatactttttattgttattttagagtgtgcacctatttattaaaaaattaactataacacagcctcaggcaggcccttcaggaggcatccagaagaaggcattgtgaccataggagacgacagctccatgtatgttattgcccctgaggacctcccagtgggacaagatgtggagttggaagacagtgatatggatgatcctgaacctacatgggcctaggctaatgtgtgtgtctgtgtcttagtctttaataaaaagtgaaaaaaaaattttaatagaaaaaagcttatagaatagggatataaagaaagtattttgtatagctgtacagtatgtttgtgttttaagctgaatattattacaggagagccaaaaagttacaaaaaaattaaaaagtttattaagtgaataagttacagtaaagtaaggttaatttattattgaagaaataaatgtagtgttccctaagtgtacagtgctcataaagtctatcatagtgtgcggtacagtcctaggccttcacattcactcaccactcactcactgacatcagagcaacttctagtcctgcaggcttcattcgtggtaagtgccctgtacaggtgtaccacttaaataacttttaaaatacccttcactctgatgtttgcataatgacaaaatcgcctaatgacatagccctgtagttaagtgacacatgactgtatatacattctatcatgtatgtacatatatgacattatgttaatataaagactaatacagcgtagttcataggaacaaggttcatcttacctgtggcttagcagatgttgggcacagttttgtgggctatgtaaagtaggtaggctccaaattgccaaaaatagatttctctggactatatttaaagcaatcaatgtggaagaatttgagtttggtgccagtgggctttgagctagtggtctagcctgctgtgaaggcctaaacaacattgtaggccaacacacgaggccacgtctggctcatttatataactgctatggaggaaaaagaggagagtctttcatcagtaaacatctcagtagctaatggtgctttccctaattctggggttctttctattacgaggtggcaatgagcttgcggttgtatgtttgctgtaaactctttgtcacccttgcttgtctacaccacaccaggctggagagggaagcgagggctcaggtaacggtggcagcagttataaaaatagctgaatcctctcggccaccatccccgttctggattttccctggcagagttccaggcggttccacgtgctttccctggctagcagccagtttagtgcacccactacagccactggtgtgtttgcttaaaaatgtttttcttgttttctgattaaaatatgtgaaatgcttatcataaatcatctgggaacaggaaaatagagacttaaaagtgacctatatcatagataagtgctaacactttgatgtactttttcttagtcttttaaagggcatgtttataatattgaacatcattactgctttgtattcaggtttttgcacctaagttaagtcatatgcctttcctgtgtcattaaatatgtttttgaagcatatttaatgctagcatgaaattacactctatggtcatagtatgtttgtccagttattggacattcaggttggtacccaactggcccactggtagccaatgctgcagttgctactggggcccaggccacccctgctgctgtgcctccagatgagactggaaagggctcctgccccatcagtgttcacactcctacacatcaaagtaaaaagctctttcttggtttctttctgcatctctgatcttatgacatttcattaagctcattctatcaaaagaatacaaaccttctctctgagaactggtgaaacttccaaaagccaataaaaacaaactggtttggaaaaggagagaaagcctgggctgaaaaaaggctacaagggtgacaactgaggcactgtctcaataaggacactgtgcagaaacttgatgtgttcaggctaaatttatgccagagcccacagtgggccacttcacacctgtggctgttattaaagaagaaaaataacaaatgttggcatggatgtggagaaatcggaaccctcatagataccagttgctggtgggaatgtaaaacggtatggttgctgtgaacacatggagtggtttctcaaaaagttaaacatagaattaccatatgaacaaccagttttactcataggcatatacccaaaagagctgaaagcacggacttgtacacatacttatacatcaatgttcataacagcattattcacagtagccaaaaggtgcaaacaaaccaaacacgtgtcaacgagtgaatggatcagcaaaatgtgaaatatacaatggaatattattcagccttagaaaggaagttctgacacacgctatgacatggatgaaccttgaggacaatatgcaaagtgaaatatgccagtcataacaggacaaatgctgtatgcctccacttatatgaggtccctggagtactcaaatgcatagagacagaaagtagaatgctggttgccagaggctggagggaggaggaagtggggagtgagagtttaatcattactgagtttcattttttcaagatgaaaaagagttctggagatggatgatgaagacagttttacaacaacgtgaatgtccttaacgccactgaatggtacattaaaaatagttaagatggtacattttatgttatgtatactttatgttatgtatattttatatataataaaaagacaagaacaacacagtgggttgcacagcagcaggggtggagccagaggctggaatctattagaaaagtgaaagactgaaaaaaaagtcaaggttgactgaagtcccaggacagggattatgcccatcttgttagtatcatatcctccaatctagactagcacctgacatctagctcaaggtttagtgaataaatgaactaagctggaaaagataagcacaagctcagggggcaaagtaagtccactgtgccagttattatgttatccctcaataagcagctgtctatgctcagctgtgtgatgctcgagctaaggctctgcaaacatgtctgctatgccactggctctctcttaggttttgctaacagggggctcaagagagaaggctggaggaggaggaaagggaacacactcctttctgcttgctccctatgggatccatgtctgcttgtgatcctgtgattctcatcttaacgatcttcctccagccatgcttcttcaccctcgcagctggaagtccttccgtagcagcagctgaggccactttgcagttgttccagcacaggcagcaccagcatcatcagattgcacttcagagatcccagcactttcttgctgccaggaaggtgccccttcctcagaagcctggatcccagcaaaaatggtgtctcctctagatttactagttttaataatgcaaatccttccctctgtgccctcagtcctaggaaatctgttcctgtgatgctactttggggtgctttagttttcctcttggcctttcaatttagttaacaaaatacataaatacatagataaaattactcatgctcaacaattgtcaacattccatagttcctttttatttaactccactcctgtcttgttgttgttattcgtagttattgctgctgaagaattttaaagccaatcccagatggtgtgtctcccataaatatctttgtgtgtgtctttggaggttattcttgagctaagaaggggattttctcttaaatcaagtgactattgaaggtcatgcccttaaatcaagtgaatatctttgcagataaagatatttgacatggacatgcaggagaaagggatgctcccaggcctgccgtatcagcaaccaatcagaactactcaatggagtggcagctcctatgaccagatggcctgggcagctaagtctggagttcaaaaaccccagactccccatcacttgatggagagtgagtaattcttttacttactagggcagatcacatgtatatttttggccccactttatcagatacaacccattgtttcattggttagatatgacaaaatgacaaaagtttgagtggccaaccaacgaagactagtcctgtgcaatattgataggttggatactggtagttactgctactgcaacatcagatatgagcttccaagcaccactctaaggaatagagggactctcatttgccaaatacattgacaagtaatccaaaaatacactaaacctttctgagattgaaaactgaagaaaagagattgtcatgaactcaaaagacctttttgataaaaagaaaagtgttagcataactttgacttggaggaagagcattgtggctctatgaagcagcccacagcttggccttatgcccaagatccttgtttagcagatgctagagaggagatgcccaattccccagctcctcctccactatgatcttttcagaacctttaaaaaatctgtgtcacagcagataagaacttaagggtgatctcttttcctggtgctgtctctttgttctcctggagcttacctgaacgggaattcaccaccagggttttgaatctcctggtaagttccactcgatggttgactagcatcattactaccttagcatggtcaggtgcttgctgtctcctctttcaatattggttttgaagggtcacctaagcagccttctttaccaaatgaccaaaaactgcaattttcctaattccacagctagacaagccctggaaccaaccgaactcccagccgccaggctgcagtgcaagagctaagagtagtttggagaaagccacatgtgcttaagagaagtcaaagaggcaaattcaatagagggagcaatgcacagggcccaggatccagaaacctggagcaggatacaggtattacagaccagaagtaggtttagagggccaggggaagctgatggggaatgggagagaggaggtgggagacagggagacggatagtttcctgggctgtttggtccctttcttgggtgatactgcatttatctgcaaggcacagaatttgttgatgaagaacacaaacattggagccccaatgccagaacctatattctggatgtaccagcacactagctatttactccaaacaagtacctgaaccttctgtaactcagtttccttatctatacatgggggatcattataatgtttttctcataggcagttgtgaagatgaactgagttgccatgtgtaaagtgcatagcatagcacgtagtacacagtaagcactgcatccgtgtcagttatgatcacctctaagccctcagggcctcagccatgggtgagaagtggttatggaaacagaaatgcctcaaactggcacccataatgcttattaaacatgttacgggcagctttcacatgcccaacctgctgaggttgcagagcagcccttatgatctttattctacacaggagaggctgagactcagagaggttaacttgttctgactcacacagcaagctggtggcagaattcctaagatgtagcactatacatactttctgctccacttgcatcctccctcctcctctgcccccttagccttcatggaattgtgggcatccctaagaccatgcctggtgaaatcggcatcaatttaataaaaagcagaatgcaacgcaagaggcaaatgcctgactggcttctgaggggctgagcagtgacatgctacttataggacctttctatgcagctgctctgtggtcccaggacccctgtggggtcctgagcagctgtgatccaaactcaggagctgctgctactcttggaagctttggtgctcctgggccacagatgtactggacagaaatcacaaggtcaaggaaggagactcaagcccagagtcacctctactgtgcccagcatagtgctcagcacaaaactggcccctttagccactcatttatttacaggtaaacgggggcatttgagtatataatctcaatgcaaaaggctgcatttctcttatacgaaaagacccttgagagtttatatgtgaaaggagaaaaagaagaggaggaggggggaaatagaaaccaaaaactcaattcttttcttttctttctttaacaggttcatatttgctgttctgttgttcttggtcgtggcagtaattcaaagtctcaagtatgcaaaaaccagttggaaatgttttaaaagggcagccaagtaggcatttctcttccaaataacaagcttgattccactgttggatttttaaaaaacttttatttatcttcaccaattatttaactttgattttcatgccttctcactgaataaatattcctaaataggttaaaataacagagaaatgaaatcatctaaagacattagtcacacagtgtgctctggtgataagactcctggactgcatgaggaaaaagtgttgcttctggccctgccatgaagttgttgtgtgatcgtggaagccgttcaccatctctggacctgttccttcccctgtcaaattaaatggggagggctctcaggtgggcaattactatttttttgatgttcactttctatctcctttttcttttggtaatgagaccctgtatttcctttggggaaccacccctcttctacagtcagtcatttagttcagctgggggaccaccatgagcttgagatgtgggatcccctctgtgacagtgggagttggaaaggatgcttctcatagcatgaaaggataactagaaacaacatttttatgaaagtaaaaatggctagcaagtcaaactatttcttatctcctgtattagtcagcgactgctgcgtaacaaattactatgaacttagcagccagaacaacacacacttattatctcagtgtttctgcaggtcagaagcctgggcatggctcatctgggttctgagcttcagcatctcactaggctgaagtcaatgtgttgactcagctgcagtgtcatcagagactcaaccagggaaggatccactcccaagctccctcagcttgttggcagaattcatttccttcttcttgcagggttgaggctttgcattcttgctgaagctgctctcagcaatggcagtttgcctgcagttccttgccatatgggcttcttcaccatggccacttacttcatgtcagatttttcaaggccagtaagggagagtacagtatgtctgctcctaagagggagacttatatatatggtaacttaatcataaagggacatcccattatctctgccatatcctgttagttacaagtaagtcccaggtcctgcccacactcaaggggaggagagtacccagaggcatgatcccagaaggtgggtgtctttgggggtcactttgggtctttccactacattctccattgaaccttctatgtggaaagactgacttgacatgtcaatgaatatttaatgccttctccattccatttggtaagtgtctccaagtcttggactgacactgcccttattgtacatactgttcaatggttttatcttgagttccttgtgattttattgtagtaaaaggccatttatggaattccactctgtagcatgcattgttgtgttcaggcgccaatgtatttgctttcattttaacacttgggtttagtggatggagtttctcctgggcaaatctgtgacccaggaaacacagcaacctggttggtgctagtgtgtgacagagccctgtgtctttgtgtttacccgtctgtgagattatcccattagtgggacactcctcagtagaagacctttctcagcagggggctgatccccaggtcacagaatggatgttttcatatcctccatttgtgttatgccagagcagcggtgatagatgatgagagccggaagtcctcttctttaacttcccatgcttccataccttccatcagcactgagatttttagattctcctgtgaaaagactttcaagatctgcttttcttatctctgattaaaccagaaagaaaatgacttgaccagggttgaggagaaggaggaacaaagggaagggtgtttgaaccaggaagggttgggggagaaacaaaaacacgtttgctcctgctgcatggagccatctatggctgtttcacagcttgaagaaatgcacacccaacaaataggagtctgtggaagactgaagatttatggtcatttttcagttgggaagataataaaaaaagagagccgttactttttataatggctaggctgtttttcattagttttaataaacctttcctttccctaacttttcttctaaacagttacttggacctttaacaaaaaacaactttttattttagaatagttttagatttacaggcaaatcacacagatcatacagaaggttccacgttccctgctcccctaactttctgtccagccctgcccattgcccagtgccaggctcatgcaggtcatcaataccatgctcctagggagacagagctagagacagcctcttttcctacttccttcttagcatgtaactgtctcacaatttctgaagatcgagagtgatgttggaagagggaaatgagggacgggaaggaggtacaataaattctttaatattcccaaatgtgattttaatgtctaatttcagcccccgtgtctggaaatctttacagaaactgctagcaagtgtccagaacgagggacaccccgtagtccttgttcctacaggagagggcactcctccttgccagtgggagtggctacatgaggcctttggtttgctgtcagcttggctctgaggctggtttggggagccaatgatggatgaattttctgcagagcttcccatcatccacaaaggcccagaaaattctctgttgcaacttgttggcagcagtgctaagaccctttgagcaaaagacaggtcatgctcacctttaagaagaggttgtaggctttcccccttgacttggaaggaaaaaggaattccaaatctccaggataagatggacctcagagccatttttaaacttctcatgctcaaattcctctactgcagtcaaaacagcatgccattggcataaagatagacaaatagattaatggaacagagtagagagtccagaaatatactcacacatatatggacaactgatttttgacaaaagatgctggaacaggtgcaaaaaaaaaaaaaaaaaaaggagaagaagaagaaacttagctccttgaatccataatttaaagtgtgttcaaaaactaacaaatgttgggtgcggtggttcatacctataatcccagcactttgagaggtcgaagcaggtggatcacttgggcccaggagtttgagaccagcctaggcaataaggggagaccccatctctactaaaagaaatacacaaaattagccaggtggggtgacgtgcacctgtagtcccagctactcgagaggctgaggtgagagaatcacctgagctcaggaagttgaggctgcagtgagctgagatcatgtcactgcactccagcctgagcaatgggagtgagaccctaaaaaaacaaaaaccaaaagctaacaaatgagattatagacttaaatgtaaaatccaaaactatagcatttctacaaattataggagaaaacctttgttaccttgggttaggcaaagaaagatttcttacatacggtgtcaaaagcaccatccgtaaagtaacaaagtgatgaactgtactttatgaaaattaaaaacttggccattgaaaaggctctgttaagacaacgaaaagataagcaataaatgggcagaaaatattcgccaagcatgtatgtgaaaaggactttatctaaaatatataaagaactctcagaactcaacaatgaagaaacaaacaagcccatttaaaaatgggtaaaaactttgaacagacgcttcacaaagaagatatatgggtggcaaataagcacatgaaaagctgttctacatcattagacattatcagtaaaaccacagtgagataccactacatacccattaagatggctgaaatttaaaagtctgatgataccaagtgttggcaaagatgtagaaaaactggaagtctcagacactactgatgggaatataaaatggtacaaccatctttgcaagtagtagacccaccatgtattccatgcattccatccattccactcctagatacttaccccccaaaaactgataaatgtccaacgataggtgaatggatacactggtatacccatacagtgggatattattcagcaataaaactgagtgaactattgatacacaggagacaaatgtcaaaattatgctgagcaaaagaatccacataaaaaggagtacatactatatggttccatttatattaaattagaaaattccctctaatctatggagacagaagacagatcagtggttgctttcggggggcagaaaggtatacaaaggagggacaaaggacagttttgtgggggatggatgcgttcactatcttgatggtgctgatggttttacgggtgtatgcatatgtcaaaacttaccaagctgttcagtttaaatggacaatttattgtatatcaataagcaagtcattgcatgttaatgataccccaataaagctttttaaattaaaaaaaaaaatcccttactgaaccactgccaagagcttttcagcaaagctccctttatcaaaatcagagataaggcggtgccaaaactgcaaataaaatggagtcatttgtactgaataagaggaagttttccagtcacatgagttttctccagagggattcagtcagtgggactgggccagggtgaacagcagggctggcaggtcagcaagtccaagaggcttcactccatcttcaagttgagtgttctcatcgctaagatggcagccttggataagatgacctttaatacccaagacttcatggcagtggaaacactgagcattttctattggtctgggttgggtttcgttctccaccaggcaccggcactagtgctggcctttgcggccctcaactccttggcatgtgtgtcctcagggtcaacattagccccttgcgcctgtggggaggattcatggagtggtgtcaaagagtgcctggcttgttttcttccttttccttattctagtgggaatgaagttcagtccaagtcagacatgccagaaattgattttttctttacttttctggtactgaatttaatttctactttgagccatcgacccactgttgagtagaaatcaattaatttggttggtgcccttcctaagagtaagttctaagttgaggaaagtttatgtggaggcctctgggcatgacgcttgctggggtcttgtcctcatcaggggctactcagcagtcggtgccctccaccttcctctagctgagcacccacggctcatgattcgatcttcccagtgcagcctaaagcctcttcaggttcagctctccttggtgtcttccacgctcagaagtctgaggcatgtgacacagtggctcatgcctgtaatcccagcactctgggagactgaggcgggtgggttgcttagggccaggagtttgagaccagcctaggaaatacagggagaccccatctctacaaaaaataaaaataagaagttaaaggcatgggcttcagagactgtttggatgggaggaaggtcccacatttcccagcaaaggcaggaactttgtttttgcatctgaaaacaacagtgggcattaattaaaaatagtttgactcagatcgggcatggtggctcacacctgtaatcccagcacttcgggaggctgaggtgggaggattatctgaggtcaggagttcaagaccagcttggccaacatggcgaaaacccatctctactaaaaatacaaaaattagctgggtttggtggtatgcgcctgtaatcccagctcctcaggaggctgaggcaggagaatcacttgaacccgggaggtggagattgcagtgagccaagatcgtgccactgtacaccagcctgggcgacagagcaagactcagtctcaaaaaataaataaataaataaataaaaataaaaatagtttgtctcatagggttgttgtgaaaattaaagcagtcagtacttagagcaatgcctggaatactgtgagtcttctgtaaatgacgtttattttgtcacactggagtcaggggagcttgtctgcccttcttcctgggctcctggttccttcaggctctacccaggaaaggtggctcttgggcttctgatcttttctcttcaaaatgatccggggattctagggatggagagggcagggcttccatctttagagaggtctagctccagaaatcttcatccagacttggggagaaagtgcaagagaagaaagccttgctactccttgtcgtgcattctccgaaaaaaatacattcaaaaatatctccaccagtctttcaaaatgcaaggccaattactaccccttttctgtctgcgttctaccatcctttgaatgagccacaggtgggggtgccctgggtgactgcatgtgggtggctcaaggacacagggaaatggagggggaagccctgactaacaggtccaaatgttaacttccatctggttctctgtgggctaagaggaggcacctagtgctaagaagctgccagcagaagatgccctggcagcctgaccacccacaagtcctgacactcggatggccgcagtccactcctcctgcaggagacaggacctactgtgttagagtctctggtggcaggtgctcgggagatgggcatcacctgtcgtgtaacaccctttgcaaagaccgggagacatggtgaggatggcctgaaagtcaagtcaacttctattccattttctcctggggacgtgcaatgtgctctaagggcagcctagtgggtaggctaccaatgttttggaagataattcaaactgaaaacgttatattgaagcacgatgtcattctgccatcttgtggcagtatcattctctggattctgtggtgattgtggtctgtggctgttagagatgtggacttaccctgatgaggacaagtgcttagccctgcatgatgtcttactaactaccattaggctttctatgaagaatggattatttaaataggaaatctatcattaagatgaatctttgaggtgtatgaaacttcaaatattcatttagcaaatatttatcttcctatatgcatggagcaatcctaggctctggtgaaaaatgtgtaattatagtctccgtcttcaatgagcttcaatgagctagagaataaggacagttttcacacatacctgtaatacaaggcaaaaagaaataaatgtgtgttatatgaggagctctggataaatggaaagaagttaacagcactggacactgggaagggtgatgaagaaagtggtgtttgagtccagggagtcactgaatatctttgagtaaaggagggacataagaaaatctgtgtggcaggaaggtcactgggctactagctactagagcagtgatccgcaaactttttgatcaagcacctctaacaaaccaaccaaccaaaccaactaagtgagcatgcaaccaaaccaaagcattttacttaagaatataaacatttatggatctagcatgtacaaattaagatgtatattaaaataaagagattaaagtgatttaaaaaaatagtagcccaagtattttcttcttgcatcctattggatgtccgggtcccctgactttgaagattgctgttgtagaccagtttgggcaggaaaatagggaaaagagaatcagaaagaccctcgcaggccatgatgatagtgatagcgcagacgagagatcacctggacccaggtaaggtggagatgcaggcaatgtaaggtaatggacagacactcagagacagaagtagagaattgccaggagcttagggagagggaactgttcaaggtcattctgggtttgaggttttgttttgttttaaagtcttacgctattggaaagatgaggattcattttagagagagtacaggggtaaaaggcaggtttgtgaagaagatggtgagtttgttttgtataaggtgaggtttttgcaccagtgaaatctgtttgtctgtccccagaaatctggagatttaggactggactcagaaaaggagtcccgaatggagcagtgtcatctgattcagatgtgatgtcaaacttcaggaatgtgtgaggacacccagggcaagagtacagagtgagaagaaaacagagccaaggacgaacccacaaggacactggcatctaagcgtgttgtagctcagggttccttgagaagtagactatgagatagaaacttatgagcaggaagtgtattggggagtgttccagaatcaacaaccgtaaggagggaggattgctggattgggtggagaaagaagtggaagtctgatgtggtttcaacagaggcctcagctgatctcgtgaggagctctgaaatgaggagggcccttcgagggatggctgtggtgcgctgaactgggtcccctggttcccaccagctggattcctgagtcagctgtgtggatctcctcccaactcctcattcagtgatgtcaggttgatcttgacattggcacagtgggaatatttacaccatgaaaattgcccaatattacaaaccagggcttcccccatccaccaggaacaacttgttaaatatgtaccagtatacacatttatgtccctaatgaagaggggaactaagtctctgcatcttttcataaactgatcattggatgcaggctgcccctgaggagaagatgttactttggatggggtagccgctttcagctgaggactgtacctagagaagaacatagctgtgaagcataaaacatttcctaaatctggagaaattagtgtctttgaatgtgaagggtgaatatgaacaacataccacagcatccactacagcctaccttttgcccaactgcttcatatagtgatttaatctcatctagaaacagctacttcaggatcttagttactctcttttcctgggtaaatttatgacagtaatattggttgctatggtttgaatgtccttctccaaactcatgttaaaatttaattgccgttatgacagtattaagaggtgggacctttaaggagctattaggtcatgagggctctgccctcataaatggatcaatgctgttattgcagaagtggttttgctattgcaggcattcagccctcttcctctttttctttacactcactcaccctcccactttctgccatggggtgacacagaaggccctcaccaaatgtgggccacttgaccttggacttcccagcttccagaactgtgagaaataaatctctgctccttataaattacctagtctgtggtattccattataccagcagaaaacaaaacaaaaagaaaattggtaccaggagtggggttgttgctgtaacaaatatctgaaaagtggaagtggctttggaactggataatgggtagaggctggaagaattgggaggagaaggctagaaaaagcctacaatgccattaatggcaaatctggtgagggcgcagaagaagaccccagaactacagacagcctaaatcttagagattacttaagtgattgtgatcagaatgttggtataaacaaggatagtaaaggccattctgatatctcagatggtattgggaactggagtaaaggccatccctgttatatggttgcaaagaactttgcaggattatgttcttgtcctaggactttatggaatacagaatgtaagagtaatgagctaagatatttggtagaagaaacttctaagcaacagagaatcaggctgctgtgtagctacttttaaacacatccagtgagatgtgagaggccagaaatgacttaaagacagacttttgtaatgaaaagaaaagaagaatggaaagatttcagaaatttgcagcctggctatgtgaagagtagaaaggtgtgtttgggagagcaaatcaagggtatggtcaagcaattgtttgcttaagagattagtatgaacaggaaggaagccaggtgctattcatcaatacaatgggagaaatacctcaaaggcatttcaaagatctttgaggttgtccctcccatcacaggcctagggcatctaggagggcagaatggtttcagaggacaggccagggcactgtccatgggttcactggccagggccacttcaggactctgctctctgcattccaatataatacccctcatctgtcccagctgtggctcaagcaggctcaggtgcagcttggactccacaaggtgcaagcagtaaaccttggtggcattcacatggtgttaagtctgcaggcttacagaagaaagagatatgggaacatagcaaccttcacttaggtttcaaagaatgttcagacaacatgggggcccaggcagaaacttgtttcaggggtagagctaccacagagatttcctactaaggcaatgcctagtgaagccattggaacaaggccagccctgagagtcctcacaagggtaatgcctgatgggaatggcatcaccattgagactccagaactgtagctaccagtgtgcgacaccagcctgggagagctgcagtcatgagactccaacctgagagagccgaagtgtagactgagcccagcaaagccatgtgggtgaggctgcctgaggccttaggggctcaatctctcacccagtgtgctctctgtcttgcatgctcattcaccctttcatcttctgctattaggtgatacagcaagaaggccttcaccagatgctgacaccttgatttgggattgccctaatgtagcattcccagcctcgagaactgtaagaaatgaatttcttttctttataaattacccagtctgtggtattctgttatagcagcataaaacagtccaagacattagtctcctttgctgcaggtgaggccacaatcactattcatcatctctctcctttagtagctattctagatctccctcccactcagccagcacctgtgctggtctggtaaccttacatgaccctggtagggtgatctaaaccctcatctctaggggttggaaatcttggtaatcatgcccttctcaggctgtggctgctgcatcatgtctaatcgctattagaattgggcaaagaaataccaagagacaccctcatgaactgccagtgtacaaatatgttcttccacgaccccgacgtgtgagggcagaccctgctgctggtctgatgaatcctttcctttgcagctgctctcttggcaccaagagacatgatggcagctgtggccccagtgaaagcgttccttttctgggagccagggcctctcaccccacaaatacagaatcctcctggagttcattcatccaaactttaggaagtgtgttccatgcacagtgctcttcaggctacgagaaaatgagcctgggttctgtttggcgggaggtgaaccattaggaaccattggactcagaacagaacccattgaaatatgccccaaagtgttgcctgtggtgagtggagattctcttctctcactaactaagaagactaagagaagagaagcctgaaaaatgtgatttcttctgtctcagcagggcctggtcgggagtcactgggccccctctagaattaacatcactgcatgtaaacattagggacagtattttttttttaaatcctgcctaggtataatgttttcttttccattagtaagtaaagcatattctcttaagtaagctatgccatggataatatggaatttttgttataagcctttcccattcatcatactccccaacactgttttagatcttccagtcctggttttcggataattccaggtgcactatctcagaggtataaaaattcccaaaatgaaattaattttaattcatttaaaatgccacaccacacagctattaaggatggagaagattagagaggaaagaggaaaattatctgcacaaaccagagaaagatgccatcattcccaaaatactgggaatgataacacactgctttgtagtccctaattgcaatttcccagggggtgctatttttaactctgtggctgaattgttgattctttaatgcttctcctgactttccatggtgtttaccacaactaaggaatggtaaggggctggcgaataacaaatgatgaatggaatcacttgattcttacctgagaaaaggtcacagagaacttcctatatgaacttgattttcagctctgtgatgaataggccacgatagattatcctacagtatgacccaatcttgatgttaggccatgtaacaaatgtctaatctaaaaatttcctcctggcatttatctctcatttctctctctgtgcttaggaaaagtggaaaataatcactcattggaaattatcttctcattcattgatttattaactatttcaatgaattcctcatacatgtattacgctaggcatttgcatataatctcgtgaatcaaacatataaataaacaagtaactataaagtgtgaaatgctataaacttaagaaaaaaaaaaagaatgttgagataaagaatgagatgtgcccagaataactatttaacccaattgcaactgacctcaccaaatctgagaaggagctggtatgggaaataccattttttctagaagaaactgtacacacataaaccccaaggtaggaaagagcttggcaagtgtgcctgtcaaaaaggagacccagtaggacaaaagcttggttagagatggagaggtggaaccagagtcttaaaggcctgaggccagagtttggattaatttacaaatgcaaaggaaacaattacaataattttagcaggagatcgacagtaacccacaaaagccataaattcccccatccacaaactcaggtgtgcagaaatgtgacttctctaaaactgaattcaacttagccaacaacttttttttcttctgatggaggagatctatgtcttgccatgcttcaattgtctccagtttactagagtttcttttgagaaaccactcagctaacccaagattctttccagcctctccccttcttcctttcatcccaggtggtgcctgggttcaggtgagatgactacaaagggacctgaaataagcctccagagatacccctcttttgccaacaattagggccttggtgccaacacaaacatgcctatgctcactcagcctcgccaggtgagcgggaatctctgtggagtctcctttcagattttgaatctccctgatttttggtttgagattcaaactttactcaactgacctgacttcacacctgacagggctggaactgaagttctgttttaaagctttaaggtgggagcttcgcttgttaatctctagaaattctgctgactgcgggtttgtgattttcacttttctctgaggttcaggtattgtgtgtcttactcattaaagtttacaaccttttctcttggtcaaagagaaaacagttttctctgaaaagagaaagtgatatccttgtggcttaagtgaaaaatttgtaatctgtaaaactggtgggattctgcgacttagtgcaattgacagatctaaaatttcttcttgagtgactgaaattcctcccactaggtctttttggtctttcaaaggaaaatctaaattatggacaattatactactaaaggagagatgtgcctttagaaatactgcctggatgcatgtgcaatactaataatacctcttcattcatatagtcacaaaaatggtctcacataacttatgaagaccccaagttacaatggccaaaatggggtatctttaaaatacctaaagtagtttatctgtgcactcaatcagaaaatgctgtttgaaataaaacaaaataacgtatagagctatcttcaatgtacttagaagcttctaggccaggtgtgatagctcacacctgtaatcccaggattttgggaggctgaggtggaaggatcacttaagcccaggagttcaagaccagcctgggcaacatagtgagactccatctctattttacaaagcttctaataaagtcttttatttgcaagaggaaaacatttgtctacaacaatttctgaattgaaaaaagactgccaaaattgattttcagttaggttctctttagggaacatgttttccttttggttccctcagctcccatccacctgacaggcagagacttttagaaattatacaacacacctatctctttctccccaaagggggacagttatcccgtgtggttgttaataaattgcatgccatttcccccattaatctgtttttgtgagttgatttttttcagcgaacattcagagggtgaggggaaagttttcccatggcccctgcagctttagcgctatgagcagagtacctaacctgctctgctctaagccacagtgaagggaacccaggacctgacaggccagcagaagggtaagaacgtcttaccagccagcctccctgtctttcattttgtggaatctggttgagcggacagtaaaaccatgtttgtctctttttcctctgcaaaatgttggctaatgagaggaaaggatttgtatgactagtcttgggtatagcaatcttggtgtacttcttggtacacatatgggatcgagttgctcttagaataagtacatcattaaaaattctaatcatcagtggtcacgagatggatcctttgaattataataacatatatatatatatatatatatatgtatatatgatctctcattctaaacaaattgcctatttgtacttatgggaagatcagattttttttttcttttgagactgaatcttgctctgccaccaggctgctggactgcaatggcatgatctcggctcactgcaacccccgcctcccaggttcaagcgatcctcctgcctcaaccccccaggtagctgggattacagccacctgccaccatgcctggctaatttttgtatttttagcagagacggggtttcaccatgttggccaggctggtctcaaactcctgacctcaggtgatccacctgccttggcctcccaaagtgttgggattacaggcgtgagccaatgtgcccagccgagatcagattttctaaaagacacataatggtatcatggccagctttagaaattctcttcacaaaagtaaagagcaaaaatttgaccaaaaacaaagttaaaatcctttgtaagctcaaggtgcctgcttcagatgccctgtgggattcacagtgaaagctgctccacctggaattctggaaggtgaaatcctgtaccttcactgccatggccttagtcagagaaccatccctttggtttggtattttggtgacttttggctttggggatacctgtttgttattgaccctgttccctttcatggacagcttttagtttctcgtctttccattggtgagacacagggggccttcgggccttcaggccttcatgtgtaggtgctcagctgcccacaaagccggacagaatgtgagttgtacgccatttgtggttagtgaaactatcctttcattgagctgtctttggggtggttctgaatcttgtgaggactgctttgcccctcttcggagacacctcatgagttcttgattaaattacaaccttggttaaggcttattggttttggtaattcacttgggagggtacttgggtgaaaaaaaaaaaaaagctcaaaagccaggaatctcatctgtttgtctcagcaataatctgataataagagatttttaaaagagtttttaaaaaggagctgtggccaggtgcagtggcttacacctgttgtcccagcactctgggaggctgaggtgagaggattgcttgaacccaggagtttgagaccagcctgggtaacacagtgagatctgtctcaaaaaaaaatttaaaaattagcctcgcgtggtggtgcgtgctagtggtcccacctactcaggaggctgagcgggaaggatcacttgagactgggagattgaagttgcagtgagctgattgtgtcactgcactccagcctgggtgacagagtgagaccctgtcaaacaaaacaaaacaaacaaaaaactccacggtcaaagttggctgaattaaaagctgattttcaagcccctgcttcttcttgctgtctttagtagcatatgaaggaatctagagaggaattctagtgactcaggcccctaaaaaaacacagaaaaaagtgccatccaccccctttctgggatcttctgtcttcccgtggagtctgaggagtcgtggacaggtagcttcctctcaggcctaaagctcggctttcttttgcattgcatgacctgatctctttggcttctagggtaccagggatcactttgtactgtgagagaaccacctttgtgtgttcgtattcagggcaacttgaagctatgctcctgggtgtccattctcaaccattgtgcttgaataaacttttaaaaccagattctgacctttttgattattttaggctgatacctctgaagacgtgcactgccctgcaagacatacattattattggggcaactttgttagtcctcttcatcccagtcgggagagccccttcgggaccactggcccccaagctactgtagccatgtccttgccgccctgatccccgcaccctgcgaagcttctctcaagcccatctaccagagcatgtacctcaggactgctgctacccaaccactcaggtgccctgtgggcctgggaattctctttcggttttgcagcttcaatggctaagcgctcttgagttttcctgaagtttctgtctggtgtttatgctcctcactcagccctggaaggtaaggggctggactccttccccgggaccttcctgtatccacactccgaatgtccctcaggatccctcatcacacttacaggatgcacgctgcctttcgggtggaaaatggctctgatctttatacacatttcccactctgaaggtggagtttccccattccccagggggatgtgtaactctctgcactttcctgctgggagttaaacactgcttctgtcgtttcccctcctcctgcccaaccttcttccccaggaagtttacttccacaagcaccttcatcttctgttctagggggattttggagcatttggggccctcgggtgatggattggaaagtcttgaggcacaggctgagtcaactaaaaccagtggattgtcagacaacaggccaggcatcctccccaacagcagctagaagtgggtctctgccagccggttccttcactcctttcaaacacggggctgcctgaccctggctctgcgctctctcaatcttttgctttcctctagaacagacctcttcctcccatcctcctcctgtaccagtgctaggagcagcaaacctgctctgtgaatctgcatctgaatcttcttacctggccttgaggcttgtggcttctgggccgaataccaagtatttgccaacactcaggggccctcgggttacaagtgaaggactttggggcagcgtgggattgaagagctgagcggggaaattcactgacaaaagctttgaaaacctgattctaaagcatccaaacactataaaatgtgcccggaggctgcagtgtaggtgcagcatagagaaaggcagaaggtcatcaggaggctggagctgatggggacctggcctgggggcggctttggagtctggaaagatcagaactataatgaattgttttggatgcggagactctggtgtcctgtgtgtgctctaagttaaggaccttattcatcatttcaaggacctcggagactagttctgcatatttgtgggatttataaatcctgtttcagtctgtacacctttttcgacctttcagggtcatcggcttttgtttttgttctgccaaggactagccaggccacagaaatcttgatgaatggcaacagcaaggcaaagaaagcagctgtcttctatcgacacacccaggatccaccttgtctcctgaacagtcatccccacggggagacccccagaaggggttccacttacaaatgattaaacagttaatgacacctgggagtgtgcatttgctattcatttgtaaaatgggtctgatttctctcctagcctaaagctggcaagttccagtgatgggaacccctgagcctgattcgccatggcagaggccacacaagctgccttcctcattcaccaaaaaggcgagatttgctggagggacgccaaggtcagtggggggacacactcccggtgccatgtgcctcccgccaagatttcctgtccctttgatggcaaatctgcccccgtcgtgtgaacaatcacaccatctgcatggagtctgtgggacagaaaatgtacagcaataatccatatataatgagtcccccttcactgcccccagcctttgcaacttccgtgaccacaattcctatagtacactcttgggaaacaggaaatccttgtaagagctgcacagtaatcacactggagctatttcacaaactcaagaactgaattgcttaacagcaaagcacagcttttttttttttaaggtgcaaaatcaaacgcagagcccaggggcagttagaaacagctgcctttcagggaccattttctggagtagcagcctgtaaccaaagacttttttttaacctaatgagattgatacttccatgagagtgtctataggcctggcatggtgggaagacgttgttcctgcttgtttggcaacagttattttttaggacagttggcaggaccgacttaaacagacctgtcagaaaaatgtatcataaaatcaaagggcaccctcttgctgctcaaatggttttctcacaaagataacgagggtggtggagtgacttatggatatggtgagatgatgtcaagtgatgctaagtgcaggtagccacagaagcatccaggtccgaggttcccaaaccttttggtttcagcaccactttgcactcttaaaatcaaagagattttttaaaatgtgagttgtatctgttgatatttaccatagtcaagattataatggagaaaatataaacacacaggaatactcaagcctgtgtgccattagcggagaggtgacatcattacacatcagattgcctctgggaaacaacactgctcacatacgtgcaaatgacagtgaagaaagcgaaaggtgtcttgcagtattataaaaatagctttgacctcacagatgctttgaaagggtcccatggcccctgagggtccccagagcacactttcctatgtcagtcagcatccagcactccaggctgggcaacatagtgaaatgccatctctgaaagaaaaaaaaaattagctgggcgtggtggcacacaactgtaatttcagctacttgggaggctgaggtgagaggataccttgagccaaggagtttgaggctgcagtgagctatgattgcaccacagccttccagcctgggtgacagactgagactctctctaaaaaataataatagtaacttttaaaaatatattttaaaaactcaaacatctagcacatgaatgttgttacatgcttggccttgtactaggtcctggggaagacacacaaaataatatgatgtagggaccaaaaagaatataaaatgtagcccctgcctttgagcacactgaaataaatgcaaaaaatggaaaactgcctagtgatgcaagctggtatacagtaagtgccaaatgagagtcagagctaaggtgtatccctggcatttggaatagcagtccctagggcctaagtggggcaagccaggtgtcttggagaaggacagttttgtgctgggcttgaaggaaagatagttggtttatgggaaagaatggaattggcatcagaaactaggattcccctgggtcccagttctgtcattaatcaaacgtgtgaactggagcccattatgacttccccgggtgcaaaagcagctgtgacatttccaggttgctgatcctagcttgagttcacccctctccctggcagacggcttgctgtctctttgctcactcatggtccaatgtgtacctccccagggccctgcatacctccccaagagtggcatgtcccacccttgaactcaatgccgcggccattagcactggataagcacaaactcctgacagatacacacttcccattgtttccacactgagtggtcctctctgtaaaggcctttgatgtcttgcggacctggatctcagtccaggcccctctacttccttgttctataaccttaggcaagttgcttagctgcttggaacctcaatttgtttatgtgtgaaattaagggaataataccttacagcgttgtggggagagttgattgtcaatctctcaatccaagacacagtccaaagtggggactttcaagttagagctgcaattcatcatccatctctggtaggctgtacatacaacatagttgcaagcaacacaagttatgaaatataatattggattaactgatttatttgtttcaaattttaaatcaccacagaactgggtcatcatggaaagataaaaaagaaatagaaaaacaaatactactgatcctactaaacctccccaagaagagaaaataagagaaagagaaaaagactatgagtgctgtaactttacaaggttttagacacttttcgattttcataagtaatcacaaatccttatttatacctttcttgatactgcggaatattacttatgaggactagtaatacccagtatgcaatgatttactcagaagcagaagttggaaagtcacagaagacctatttttgattccaggcccacattcctcgaaccgaactttaccaattgctattttccagaaaagaaacataaaaaggtaggaaggaagggagaatggaagcaaggaagaaaggaggaaggaagggaggaaaaaagaaaaaaaggaaggaaggaagaaagagaaagaaaagaaaaggagaaagttaggaagggagaaaggaaggaaagaaggatggaaaataaagagaagaaaaggagaaaggaaggaaagaaggaaggaaggaaagaaggaagaaaagagaggaggaaggaaggaaaaagggaaggaagaaaagagagaaggaaggaaggaaaaagggaaggaaggaaagagggaaggaaggaaggaaggaaagaagggagtgagtgagggagggagggaaggagggatggagggaaggaaggaaggaaagaaagaaaggaagagaaactgccctgtatggcccttcacctacccctgcaggggtcattaggatactgctacttcatcactttcacaggttaataattactgttgttttctttcccctgagttttatcttatgtgggttgggaaactctagctaagagaagtgatagtttgtgatcttttttgattattaaggaggatgaagcgttttcactttcaatggaatatgtgtatcaaaggcatgtgcatacatacagttaatttgactgagacccagggacgacttgggaggtagttggcgattatttcactattactgagttgtactggtagagttttataacttgcatgccatgatcacacaaatttttccatttagatctcataactacccttggaataaggttttcacttaggatgcctttagccaaaataacagatgacccaattcagagttaataaagagaagctggaaaattttttagcttacataagaattccagaggaagattcctctctgccattctcgccatcagatttgtcctaaggctggtagtatagagctagtcctagctgggcctatctgcttccttgtccaggcccagcttagagagaggccagctttgtgaagcagcattttcttaagagccaggacgctgatttcccagaagccaccagtaatcctctgctcatgtctcatgggcacagaatggcttaggcaggcctgtttctatactaatatggcccaggggatagacatcttgattggcttagactcattagttggggtaaatagatattgagcagtcagctacaatgtcctctacatatgtcattttctagatcagaggttggcaagttgtagcctttgcaccaaatctggccagctgcctgttttgtaaataaaattttattggaacacagccacattcatatgattatgtattgtttatacctgtttttgtgctaggatcacagattgactggttgtgacagagaccatatggttcacaaagcctaacatgtgtattatctgtccctctacagaaagtttgttgaccgttgttcgagatgaagaaagtggagttgaggttaaacaacctgtccagcgtcaaagagctggtaggcagaggctacagtctaagccagaggcccaaagctctctctgctaccagctccactgggagaatttcttgggataggcttgcatgttttgtgatgtgtgccaatgctgccttttacacagagcaacactgacgtaggcctgctgaaattaatatgtccatagtgacgaatttagttcttaggaactgaaattctacatgctaatgtggatagagggataaggaggggcatgagaaaatgaaaaggatattttataatttatcataaaacactggacgctccatttttaaaagacacacaaacatcaactggaataagatttaaaaattttaataagcactggcatgaaattacacattttctttctttctttcttttttttttttgaggcagagtcttactctgtcatccaggctggagtgcagtggtgcaatcttggctcaatgcaacctctgcctcccgggttcaagcgattctcctgcctcagcctcccagtaggtgggattacaggcacacaccaccatgcccggctaatttttgtctttttagtaggggtttcgctatgttgtccaggctggtcttgaactcctgacctcaggtgatctgcccacctcggcctcccaaagtgctgggattataggcataagccaccatgccctgctgaaattacagattttcaacagataacttcacatagattgaaatgttgattcatgtttactttgatgagtttaattcacagaaagtttttaaaatgaagaacatgaaatgaacatagtattcacaaaaaaggacacacctgtaatatctgtttttcctttattatgcagtcaatccctgctccccaagtgtacttcttcagcccctcacctacccctcatctttctgcagtagtttgtctccaaggtggcccaagtccctctagccttctagaattcatacccccatagagtttcctcctacatcatctaagagttggtctatgaccaatagaatatggctggcatgatggcgtgcaatgtcttaaaaggcatcacagagtctaccttggtttcctgacttgcttgctctggggaaattcagtcgccgtgctgtgagggtgctcaggcagccctgtggagagcccccttggagaggcaccaaggccccccaccagcagattcagtaacttgccagccatgtgactgagttcatgggaagcagtcccttcagccctagtcaagccttcagatgatggcaaccttggctcaccaaagatggtgtgagagataataagtgcttattgttatttttagtcgtcatgttttgggggtaatttgttatgctgccataggtaactaatactgacatgcttgcctcgtcacatgatactctttttctttcatttttggtcaaaagtgatggtggaagaaagaggcaggcaggtcagaaggaagttagggatgaaatgaaggacaaaaaaggaggctaaaaagatgtcaaatgaagggaaaagaaggggaaaaaaaagagtcccagatatttcagaatagcacatgttcaattcttctgataacagtaacaataggtagcttttattgagcacttactaggtgcttggcactgtggtggtatctataagcacattttctttaagggatcaagggttctatttttttactaaaaatatgcaccttagagggaggaagtaataaatatgagggataaaagctggacaatagagaacattgcaaataaggctatacagaaaaaaattacatggaactttaaaatttggtaaggaaaggggaaagaaaagatctatgtgtgtattatggatatgaaaaagatattcttcctcttttccttcttttagtcatttttcattcattcaataaatatttgttttaggtactaggatccagcattgagcaaaacacagtaatagagcttgcactctggggccatttcctctttttcagaggatggcatcaccaaatagtcatggtgccagaaacctgagagtcatcctaattcctctttctccccacctctaccatcatcaatgctggggtcctggcaagttcctcttgctgttctctgtcccattgctgctacctctccttcactgggcattcatcatttctccccagctgcacccatttcccacggctgctgcaacaatgtgccacgaactgggtggctttgaacaactgacatttattgtctcacaggtctagaggcggaagtccaaaatcaaggtctgagtagggccatgcttcctctgaaggggaagaatttgctccaggcctctctcctggatcccaggagttccttggcttgtgcaagcccaactccagtcttcacatggcactctccctgtgcacgtgcccgcctcattacgtgatgctctttttatagggacacctgttatgtgggattaaggaccctctctagaatcacctcatctgaactattacatgtgtaacaaccccatttccaaataaggtcacattctgggttactagagattaagacctcaacatcttggggggagtggtcacaattgaacccataccacctgggttatggcacagtctatcagcccacatatcttgaatccctacctctagtaatcccctcactactccccacatctgtccggcacatggtggtcagtgtgatctgcctaaaatgaaaactggatcatgtgattactcagctaaaaagcctctcaagtttcatttatctttagcaaagcacaaagttccttaaaacctgccctgtgcttccctcactagctccatctccctaactgtttcacttttacttgtattttagccacaaagaaccagacacatttcccagaatctgtcacaggccccattccaaggcaagcttcctctcattttcatgctgttttttttaaaactaagttccctaccccgcccccgacctttgccaaacactcccccttacaagactcagcttaaatcatttgctttgggaattcctctcagattcctccagactgagttagaattagaggtgttctctgtttcccttaattatcaacctactcatcacgctgagttataaataatctatttgtctctctttttaaaactgtcagtccctccagggagggattatgcatcccttgtctttgtattcctgtgccttcttgtctttgcatccctagtgccaagtatattattgtcttagtctgtttgtggagctataacagaatacccgagactgggtcatttataaagaacagaaatgtattagcttacagtcctggaggccgtgaagtccaagagcatggtgccagcatcgggtgagggccctcttactgcatcatcccacggcttaaggcagaaaagcaagagagagtgagcgcaaaagattaagaggccaaacttgcagcctctagcccttttataattggtgttattccattcatgagggtgacagcctcatgacctaaacacctctcattaggccccatctcccaacactatcgtattgtggtttaagtttccaacatatgaactttgggagagttcatatgttagcaacttaacatatgaacatagcatgtatcaattaaaaataagtattcagtatatgtttgttgaactcactttactgtcttctctttgaactgtgccttttgcagagtgcaagtagaagagagaaaggtggtggttcgataagccaccttgttcttgtagtttcgtgagagaacttaaactaaatctttcaaatacggatctaatgggttttatttattctgagctctttgactcggctggtatggaactttaaaaataaggaaactgaggcacacaacttgagttagataatggtttgtttaaaaggacaccgtacatttccctgtcttctcacttacacgaggcggtcttggctccccagctggagaacttaagtaatgaatgtctgtaattaatctggggacttttcttgtaaacaccaacctaaaagtgatatttttggtggtattgttcacatcactgccaccaccatcatttccacatgtgcttctcataactgagctccacacagtctccaaatggtaattcaccaaaactttctctttcctcttggctcctgtaaatccccttggttctctttctatgtctctgctccttttctagagaattttctcttaatcataactgtggtgctcttcaagtgtggcaagttgtgctttccaaagatagccacacctggatatttattctgtttcacatgttcttcttatgatgtgagtagccctcccccattgagagctagagtctaggtttcctctttttgaagctgggtagggcttggtgactgtcctgatcacaatggcaaaattggtgtcctgtgatccaagaatgagtcataagaaggatgtagcttccacctcgcttactcttccttctctctccttttgcttgacttggaacccagctaccacagctgaagaaactccggccacatgtggaggctatatgcaggcattccagctaaggtctcagctgacagccagcaccaaccatcaaatgtgcaagtgaaaatctttcagatgataccagtttccatccttcaagtcttaaagctgagggcccagaagtcttaaaacagaaatgagccattccgactggaccctgtctaaattcctgaccccattaattctcactagtgagaattaataaatgatggttgttgtgttacaccactggatttgagggtaatttattacacactgatagacagttaatactaagagcctattttctcttttgttctctccctggcaatttctttcactatgccaatgtcttgttatccttctcatcaccttcctcccaagtcaactctcccatctttgcaagtgcctccccataattacattcaatgcaggcttcctgcctgtgttcagtgttgcattaccagttgtctagtggtcacctctgaatacctagacttgctattgcacaaaaagatacttagcgtcttgctcctcagattcatttctcttctgttttctctgttctctggaaccaatctacctgtctacaagcgttgatcatcattgactctttctttcctgtctgtcctacccaacaggttgctaagtgctgcattgggtcagttggtatgattttggctgcaagaaatacaaaagttagctaatcatggtgtggcattttggggccaatcaggaggtagaaacaggggagtcttaatataaataattactaactatgatgaaggagtaactgtaagatgtaagaaaactctacatagtccctcaggctgacggagaggactcaaggaatgacaagccttcagatctgaaggcattcagatttcatgggaaaaggtttgtttccatttattggatagcagactggccaggctggagctggcctgcactagtatgcaagttggggagcaggtggtcagcacctcatggtatggatgtcctgggaacagcaggagaatctcttctgcagtttgcctccagtgtcctctgctcagaaagcttaatgtcatttagttgaaaggagaactgcttaaatggattcctttatcacagagcatatactagaagatgcattcaaagcagagaggcaatacattaataacacatgcacttggcttaggcatatttatttattctatcacaaaacaaaagatcggatacaagagttttggtgaagtggaccagtgtcattcaggatcctgatgtcttccgtcttgttcccactgtgttggccacattttccctcacagttatgaggggacagcagtttcatatagaaattactgcatccagacaacaaaaaaacacaaaaggggaagggatttctgttttgcaactctttttattggagagaaagcattttgcagaagatctcaggagacttcccatcgagttccatcatcaggactgggtcatacgcccttgctctggctgtaagaatgtctgggaagtgagaatctcacacccacagcctctggtggaggtgggctttgccagcaatcaagggcatgagatgcctgcaggaaggcagccaaccacacctgcctcatgcctctaaccctattcccctctaaattcccatgccaaagccttagggcattatctttgatagttacctggccaggtgttaactaactgggaactgggtgtttttgaaggacacaaggctttctgctgtcgaatttgtcaccttaattgtgatacttttaataaattagcttccagtctatcttaaaaccagatggattttcctgatgtgtcaccgtgaacatctctctttctccaaatctctcaatgaggaggcagttgatgagttaactgcatgggctttggtcccagatcatacagctcacatccaagcgctgtcacttaccaactgcatgaccttgggcaaggtatataatttctttatgactgaattgctcatcttttcaaggagggtaataaaattacctatttggtgggattggtattaacagtaaatgatataatacaggaatggtattgacagtgagccttcagtatgtattattgtatctgctgttattgttccctacttcatatccagccaaatctaagcttattagatgaccatttaagatcctctaggagctgggcacaataaaaattttcaaacttatataaaaattgactacgtcctaaactgcgagctccttgagggagggattatattttatgagcccaggatctagcacagtttttggccaaaagtagtttttctttattcccatgtgacttttgcttaagcaaaaggccttgtacagcaaatacagcttctgtattttaccatggccttgcacttgctgttctttgtgcctacaatgtcctttccctaaatttcccccattcttccagattcactcaaaagcaatctctttcatgatgagatctctttcccaattctcattttgaaaaatgtcaaacctatagaaaagttgaaagaatagtacaagagcactgatatattcttcactacatttgtgactgttaatatttttaacctctgcttgctattcatacatatattctttttttcccctgaaatcatttgaaagttgccaacatcatgacacttcactttcagcatgtatcacataagaacaagcacatcgtcctatgtaatcacagtagctttatcttatgaaatttaacattgattcaatattatttactgtacattttttcttggcagtttatgatcttagaaatcaagaagcctaaaatgaatcactgtgtgttttgagggtcttttggtagaatcatgttcctttctgggtgttctaaaaagttcctggatctttggggtgagattctgtttgagtttcagaacaatgtgtgcatgccatcagtttgatagctcatggtttgtgttccaaaggggcagctattagtgttacctgtccctgctattgctcttgacatcatgcagggacatcctcagtagctgctctttctgcccttggtctgtcatttgagcttgtgtttccaaagtcagatgcaggaagattgggtcctcacaacagggcggtggttggagcacctggatgccaagcctggatctgtcctatcatttgagggacatttgtgttcttggctatttgtgttcttaggctgccataacaaagtacctctgggtggcttaaaatgacagaaattgtctcacacagttctggaggccggaagtccaaaaccaaggcattggcagggtcacgctccctctgaaggctctaggggagaatctgttccatgcctttgtcccagcttctggtgttgctggcaatccttggtgttccttggcttgtagatgcatagcacctccattctcatatggctgccttctccttgtgtgtttcttgcccacttcttgaaagtacaccagtcatactggattaagaacccaccctactctagtataacctcatcataatttatccataaggaatgaccctattttcaaataaggtcacacttgaagtactgggggttatgagttcaacgtattcttttaggggacacaattcagcctataacagggggtcttaggctgatatctgtgagtctctgcttcctcaaaggtttttcagaaaatttaaatgaaatacaggagaattatgccctgcagtatttgactttacagcaggagtcccccaaccctccgggccatggacttgtactggtctgtggcctgttaggaacctggccgcacagcaggagaacgagggcattaccgctgagctccgcctcctgtcagataagtggtggtgcaaaccctattgtgcatgagaggggtctagggtggactgtccttgtgatgcctgatgaaacatcccccacaacagccctccaccatccatggaaaaattgtcttccacgaaattggtgcctggtgccaaaaggttggggactgctgctttaaagtcccttatataggatttacattaaaaattttccagtggtctccaaatgtcccttataccttcctatttttgggtctaggctccaagtaagaatcacgcattgcattttgtcatgcctttttagtctcctttaatttaggacaatggttctcaaacttccatgtgtatgagaatctcctggagagcttgctagagcaatctcctggtgccaaacttccacgtttatgagaatctcctggagagcttgctagagcaatctcctggtgccaaacttccacgtgtatgagaatctcctggagagcttgctagagcaatctcccggtgccaaacttccatgtgtatgagaatctcctggagagcttgctagagcaatctcctggtgcccatctccagagattttcattcaataggttgaggcaggacccatgaaatggcatttctaacaagctggtaggtgacacaaaagttgcttgtctaaggaccgcacttttgaaaaccactgatctagaacagaggttggcaagctttttctgcggagggccatatggtaaaatatgttagcattttcaggtcatacagtctctgttgcaacgactcaactgtgtcattgcaggcaaaagcagccctagataatacataaacacatgggtgtggccgtattcccacaaaactttatttacaaaacagctgccttaccacatttgacccacaggttattgcttgctacatggatttagagtagcacttccactttttttctctttttttttttggaggagagttgttttttcagcgcattaatattttgcaatagtccagttcagttttcttgtcatatgtttcacagtttgaatttgattgttttatctcaattagattaagttgaacttcttggcaagactacttgtgatagtgtgtacggtagggaataactgtgaaagactttgaaatggaccaaaaatattagtggtcaactgtaatggaatgctagctgtttagtacagtcttttgggttatctgattctatggggtcttgtgtctgccactgtctttgaggtattttacaactctgtaaattgtagactactgatggtaatatacacgatttttgtctttagaaatgcaaattgtgtctattgcgtacgcagctgttttttgacctatggttactgaccaattttccatctatagacaaccttatttcagcattcctaactgcttgaatatttgttggattctccttggattttcctttgaaccagctgtgacatgttaccggttctcacattaatgaatgagctaaggaatacctttgatacatgttcattctacatctgagtcatgattataccatcttttaaatattaccctttagcattttttattgcatcactttagaaagcagaaaatgctagttttttaaaaattggtgatactagttttaattacttgattaaggtggttctaccagatctttccattgtgaagaggtattttgtgttttttaaggaagtatactttgaaggtgatactttgagacaaagagaatattccgcttcacaataatttttcaccagatggttttagtatttactgatggtctttgcctgtatccattataacactggagttgcaaaacacaaaccctttttctttttttttttttttgagatggaatctcgctctgtttcccaggctggagtgcagtggcacgatctctgctcactgcaacctctgcctcctgggttcaagcgattctcctgcctcagcctcccgagtagctgggactacaggcgtgtgccaccacgcccggttaattttttgtatttttagtagagatgggatttcactgtgttagccaggatggtctcgatctcctgaccttgtgatccgcccgccttggcctcccaaagtgctgggtttacagtcgcgagccaccgcgcccggtcaccacaaaccctttttcgacgtccacagtttacacctgagctctccctttgacccactacaacactttcttttcttgggcaatatattaatagcacggtggttatgtcacaggcctgtgactggcttgggctcaaacccgggctttttcacttactagctgcaagactaactagttatttaatttctccattcctcactttccttatctgcaaaacggatgcaataaaggcaccccctcttacaggactgttaggattaaatgagctaaatcacagtgtccgaacacttcagtacttcgtacataattacttgctcaagaaatgttagctattattgggtcatgattatttatatgtgtttgaattccagctttgccacatcccagagtgtctttgagtaagtcactgagtatccttgtgcctcaattcctcatctataagtaggttcccatctcataggtttttaaagattcatgcttacatgcttagcagtgtctggtatggaataagcactaaaaaagatgagcttttatgatgatgatgattactattttcagtcatgattattttgtatatttactctaaaagaaagtgaatttttttagttcaagacttttagattcatcgttctactttcattgtggctagctcatggccatccacgtagtgaattaataaagctttgttgagtggcacttgcttgacagcgacacttttgtccactctttcaccttgctggatttgtgctgccttccttgctgtaggaagcccacgcttgggaaataacattcccacagaaggtctgagaggctctgacgggccaaggttgtaaacccccatgatttgactccacgggcagttaaagtgtgttcccaccccccacggatccgctgccactaggctgtgcgaaggcatttacctccctggcactttgatccaagttccctattttcccctactggtcgatcgaggttgggaacagttgctctaacctgggaagcacccgccacgatccagcagggcgcggtgggaggggaaactgaggcccggctaggcacccccgccgcgcccagcccgccgagaggctcaggccccgggaggcacctggagcctgcgccccgcccgcgccgcttcctgtcccgcgcgctgcgctcacgtgacccgggcctgggaggagccggggcgggcgggggtcacctgaacaagggagtcacgtgagcggggggcgggggtgggggggcggtgccgggcggctgtcacgtgacgcggttccggggccgccgctgccgctgtcgctgtcgccgagcccagtcgagccgcgctcacctcgggctcccgctccgtctccacctccgcctttgccctggcggcgcgaccccgtcccgggcgcggcccccagcagtcgcgcgccgttagcctcgcgcccgccgcgcagtccgggcccggcgcgatgggggccgccgccggccggagcccccacctggggcccgcgcccgcccgccgcccgcagcgctctctgctcctgctgcagctgctgctgctcgtcgctgccccggggtccacgcaggcccaggccgccccgttccccgagctgtgcaggtgggtggcccgcccggacgcaggctccgctcgcggtgcccggggtgagcggccggcgtggggggcggggagcgctcgaggagctcctggggtctccaagtcgcctccgttccgcgccggggtccgccccgttcccgagggaaagttgcctgcgtggtgtccgcgagtcccgccgggtcccgtgcgcaggcggggggcgcgggggcacacgcggtcgtggcggtcctggagccccgcgtccggccacttgtggctgtcgctgagtcgggggtggctttgtgcggagcggtcgccccggcccttggggtcggcgcctgccctcgcgcggccgggcgtccgggaaagttggaggcaggaactccagtttgctttgttcccgctgcgcgtttgcatcagagtttcgccagcggggcaccggtgaggcccctcggtgtggagaggctcaccggggcgttggagcccgcaggaatggtcctggagttgagtgtttgtggtttcatttgctgattgatttccccccgtgggctcattttctctttaaagaatatatatatatatatatttttagcaggcggtgacttttgtcttctttagattgggggcagggggtgtcgtccagtgtgagctttcaagacttgacccttcacttctctgagcccaacttcctgcctggttgctcacatgatgtcattgtctccggggcggattattctagtggatcttgctctgggaaccatgattgtataacccatcagtcccatcgagggctgttcacctcgcgcaactgctagcagtccagggcctggggaacttcgaatttcaggaattttctgaccatccttttctggactgtttaggatgatggaaaattcagcttttgtttatttttttaaactttggtaaaaaggaagcaggatgaaaagttttgaacagacaacagtttctccctgttactgttacttttacaagttacttttacaagttacttttcagagtgaaacaaagttgagcctactttgggctgaacttggagtttgtggtagggtttatggggggggttcttatttttcccatgcatcagagatagttttattagcacccctgtgttcagaacatgcagaaattagtctaaggagggtgaggctgatctcacgatagaaactctttggaaaggcccatattttttatgctcccttttttggaaggggaagggtggatggagggagagtttgtgacactagtttaaagaccagttagctaccctaagatacatagttactccagtaactagtatgatacagagaaatggtggcagcttaaacgaggtcaggctgagaacaacatttagaggaaggcattttggaataatggcttctgtgaccaaaaataagaaattaactcgcctgggcgcggtggctcatgcccggaatccagcactttggaaggccgaggtgggcgggtcacttgagtccaggagttggaggccagcttcagcaacatggcgaaaccccgtctctacaaaaaatatgaaaattagagccgggcgcggtggcacactcctgtcctcccagttaagggaggctgaggtggtaggataacgttagccccgcaggtcgaggttgcagtgagttgtgatcgagtcgagttgcactctagtctgggcgacagagcaaggccctgtctcaaaaataaataaataaatacaataagaaattaacccagctggcctagtgtggttgaagtcttggtcttgttaacaaattgaagtttgttttcttcacagttaagattaaggtggcttcaagggcagactgatactttggctgattgatgggacccttacttttgcattaggttagtcatggcagtgtcttgaacctgtgttcacgaacttcatctccaggtggaacacggcctcttggtctagtaggaatggcctttgtatctttacgtttttctggccactgtcacacgtgggcatacttagcaaatgctgaagaggtttctgaggttgatatgcattgtgaatataataagatctgccctttgtagtcttagaatatcttaaaagttgtgtttaatttttctgccagattttcttaggatgacaaatctgccaatcatttcagagacggattttcacccacctctttccctgttacttccctgtagttgcacatgcagacttctccagaaccacttgcaatctctactttaaacccaacatgtgccaagtgaacttcctgtctgttcctgttttataattttttgaggcagggtctcaccgcgttgcccaggcagaagtgcagtggtgcagtcatagctcactacagtcgtgaactcctgggctcaggcagtccttccacctcacccttctgtgtagctgggattacaggtgtgtgccaccccacttggcttattatatattttttaaaatttttaatagagatgacgtcttgctatgttgcccaggctggcctcaagctcctatcctcaagtaatcttcctgcgtcagcctcccaaagtgttgggattacaggcatgaggcaccatgctgggtttatgttcctgttttaaactgatacctctccttaaatactttttgaaaacttttcttggggcgggggaggttatcagtcatctgtacttttatgagataaaactggctaaaatttccgtaaatgtagcatgtagttgaggaataggaatgtaagttgattttttttttaatttgatacaaaaaattttatcgtgtcaccaaggtgtgacgtgttaagctccattttaattttgttcctgggcatcagtttgctgaaatgtaaataactcggccaggtctccactgtgagcatgaaaagtcgagtcctacaaatgtccccgtttgtttttgctgcttggtcacatggaggcagtcccaaatgtacagaaggatcacattccaaatgtttgtaaattggtaatttcatacgtggaatgtgtttttccattgatagtattcttgttcattgtatggcccccagaaagtcattatccttgcaaaggttttggagcacccagacaccatatggctttaacagaatcctagccgtaaattctcattgtctctaaaagatggagttggatttccaggaaaactacctctcctcccaagcccagctctctagaacctagagagaatatttttcatctgcagtcgcttagacccacaagagggacatgagggcctgcttcaggggtgcctgcgaggcaccttgtgggggcaaagcttcaaggtgacctttggctctgagcactcctgggatggggtgcggttcctggtgcagttagttattgggaggaacgaaggagacagcaccatttcagcagcagctttaactgtgtccgtgcacgtggaggggcctgccctctgagttgtgcattgaacagcaggcacgacaaaggctcatttcccaaagtgtatctggcttgaagcagcgctttaaataagtgcatggttttttttggagagactcagcaaagcatttttcaagtgtcaagtggattacttgccaggtggtcccagtgctgagttagaagttaatgattcttatgcaggtatttcttgggaggtgatattgctagtacaaagttagtagaaaacttgtttctgaggctagtgtgataggctgtgggactggcctgtagaaaagacctggggcaggaaggagtgttgaaggtcagtggagggcgggaatagtagagcaagaagagagggcattcaggaggagaggagcagaggccaggccatgcaaaaccaacaacagtgtctaaagtgatctcagcttgtcagtggctttacttattaccatatgctttaaactttgtaaaatgtcatattatatatgtaatatgcaagtttccaccctttagttaggtgttaacaagatgcttaatgggtgaggtcttagcagtgtgcattaatgataaaataatgctttgggatggttagatttaaggtagttaagagcttcaaaatttgtacaggacaagttttccccaaattgtttaggtataaatgctagaaagtttttattatattgaggacaagagaataatgaagccagctgggagttgaggttggtttagttactgtctctaaggagatttttttttccctgtaatttttccaaaggaacagtgcttatatgcctaatttgggccacatgttaaacctggatcacatccatttgtgtgtgtgcatttcaacagtaagtgtatgtggaagcctaaggttgttaattatggttacattagatctcatggattaattctcagaacagcatcctgacagattcccaggaaatgaatgcctgcgttgggcctcacgtcttttgtcagcatttcatagagagagggatttttaaaagatggggctgagagaaataattgagatgttcccttccctattttgatcttggtatataaactattgtattggggaaagaactgagcaggctctagaactgagcctagtggcagagagtagcttatcactttgcaggtgctgttctttttcttcctccttttcttctttggattgtcctagccacagagagctcttgctaatgttgtaactggtcatgaatggtgtatgaggaggtgggcgtagcagctgtttgacttcatgggacccaccagactgtaatgccgaattacaattttgcatttccaccagtgatgtatgagagttccagttctatatccttgtcaacacctgtcagtgttaggtttagccattcaagtggagttgtaatggtatctcagtgtggtttcagctttcatctctctgctgactcatgatgttgagcaagaaaggaacatcttttcttgtatttattggaatcctggatgatgttcaccattatcatgtgcttactgactgggtattttttgtagtgtcctttaaaaatcatattttgtcccttttaccccttaaaaattgtttttgggttcttctccttattgagctttaggagctcctcatgtcttctgggtacaagttctttcttagatatgtgtgaggtatgagtgttttctttcagtctttgccttgcctttaaattttctcagtgatatcctttgaagaacagatttaaaaaaatttgatggactataactttttatggtttgtgcttttggtagcttgagaaatcaaccttaaaactagtgacatttgacctgggtaattttttgtttggagggctatcctgggcattgtaggatgtcagccagcattcctggcctctactcactagatgctaagactatactctaccactccccctcccccagtggtaacaaataaaaatgtctccaggcatatcaaaggccctggaggggagggggcaaaatcacatccaattgagaaccactggcctaccccaaggtctcaaagattttctcctgtctctgcctctagaagttttttggttttaactttgattccttaactctaggatcaatttttgtggtttaatttttatatatgatgtttgaagaaaactcaaaccatatttttcctttgctctcattccatgaacagtcatcaacacagaagacctccgtaatcaaatgtgtggtcgtttttccccaggcaccaagcagtgacccctggccaattcaattcctgaccctgtctacctggagatagtgtcagatgccacaggtttggggctcagttcccgagaccgctccccaccccacaccagtcacaagtccgggcctctggaacttctgaccaactggcttcaatttggggttcccagagtgcctctttgggtctgattaatttgctagagtgacttacagaactcaggaaaacactgatgattagcagtttatgaggatattacaagggatacggatgaagagatgtttagggcgaggtattggggaaggggtgcggagcctctgtgacctccctggctcactaccctccaggaattgccgtgcattcaactatttggaagctcccccaacccagtttttatggaagcttcaggaggtcagcatttcttctcccgggtatagggtgggaccctcactggggaggatcttaagacccacagtccaaaagcagggaagatgagagtcctaccttggggcaggtggaaggaggggcaggtggagagattgtttcctgaggcctgacacacccaacattataacaaaagaccaatactaggactgtggaagttggcagccagaaaccagatgggaaaaaaaaacccatacatgtattatatatatttatatatatatatatataaagtatatgtattgtgtatatattatataagcatatttattatatatatattatagtgtatattatatatgtattatatataatatataatatatagttatatataatatatacacacgcacatatataaataacaccacaaaaagggtaaaagtttatttatttccatgaatatatctagttctgtttactaatactttatgaaatatgcttacagctctgtttttaagtgagattgggctacagtttttttgctctgctgttcttgatggattttgttattaataatatgtttgctttgtggaaggagctagttagcttttagtatttttgtatgtggtgaaacagtttgtatataagatggacattttctgtttcttaaagtttggtagaattcaccagtaaaactatctggccctggcaggctcttaggtggaatatcatcggggaggacttttgattatggttttttctagttttattttcagttttatctagtttatttttctattcagattttctactttttcttgggccaattttggtaatctctattttcctagaaaattgtcattttaattgtgtattcatatttaataagtagcatgctactctcatatttttgatactctatagctctaggtaaatttttaaaattcctgatgtttacttgtgtacttttttcttaattatatttactaaagacttatttacctttttaaagtctttccaaaagaactagtgttttgttttttcatcttttcaccttttatttgcaattttattaatttatccactcagtaacttctacatcatttttctgtttctcgtttgacttgaatgcttagctcttttattttaaatcattttgcataattaagaaatatatttaaagcttcatgtttctttcttcggagtaccataccactcatagattctgatacttttttttttctccatatttcaattttgtgtattccctttttggattcaaaagttctatctgtttcaacttcctggacccactaaatttttagatttttatttttttcaggtccatggactttgggggttttaaatttattttttccattgtgcgggtaaatgtggtggaacttactgacatttcccttgtggcctaacacctagtcaagttgggagggtattatgtgtttggaaaaaaagttctctgtttgggtcaaagttactcatggtgctgttcagcttttctttgccctaactcttcttcggtttgtctgttgcttttattatttgtatctggctgccgctgtggacaggcatgtagctggatgtcgtttgctgctgtcgcccagcttaccagttctcccatggttcagatgttcttctgcttccctgttgtcttttgttgcagaatctcagctgatgtgtagtcacagctgcctgttctttctgcgtggacgctgtagcttctgtcaaccctctgaagatctctcttaaagttctgctctgattgctctattaattatttttccttgggcccagtttctttggtttgagtttgtcaccatgattgcatggtgctggtgcccttgcagtgacaggtgactcctgaccgtgcactctgcagtgggtctccacccgaccttggctgcctccttgtgcagctgcgtggggtagggctgggagcagttgttggaatttggctgtaaattgttttcagggagactaggggatgggcaggatgtgcctctgtggctgttcttggcgctttaggtcctttccaccctcccaatgtcacccccaagcgctgttctgccaagacacagctgctaaacccctgttgattgctgctggcagcgtgtggcctgagacgggggatctggattgttgagttggctgtgtccaatcacttcttttctctggacctcattttcctcctcaagaggggtgggacttagttttctttctctctttcctatttgaaaacctctcattagggagttagttttggaagtcactttcctgggcttgaatccagactcctcccctcacaggccttgggcaagtcacagaacctctgaagtcttcctttccgtgtgtgtccagtcaggatgctaaccatgtttgtaggctaggcgtgggatgctaaccgtgttgtaggctaggcgtgggatgctaaccgtgttgtaggctaggcgtgggatgctaaccgtgttgtaggctaggcgtgggatgctaaccgtgttgtaggctaggtgtgggaattggaagacatttgaatgcctggcacgtcctcggtgttcattggtgctgtagtggtagcagttgctttatctgtaagttacagatgctgccttacatcagggatttatttttataacctgtttctcgccctcccagagctctccattagtgtcttggggtttctgcctcaaccagagagcatttcttcttcatctgtttcatgattggcactccacgtaagcttcctcatgagaaagaaaggtttccactgtttaaaaaagtttcaaagccactggactccgtgatttccgggtccattttgcatcccaaattctgcagttctgaggtttgcagccttgaggagtccttcctcactcagattcccccaaacaatgaggagcttgataattcgaggtgtggagtttggatgggggccgggggtcaccctcctgcatgtggtggcttggtcccaggctaggctgggagaaagggggctgtcgtggttccagggcaagaagagccgtcctccctgtttccctgtggtaggatcaggaagtctcagctaacttctgcacatggtcaagggggtcctgtcctcacttaggcctctccaggcctccctggagggtggaggaatgggtgctgttgtaggtgggaacagaagtgtccaggccagtggcttggatgtgaaagtgcttcataaattccaccttgctgtgcaacttaaaaaaaaaaagtacggtcgtttaggttttcgaggtgcccaaagcaatgcgtcataagcctatttttgtctccgtgttagccagggcagaggggcactttcctgtgactcctccagggtggggaaaatcccaggtgctctgtgaacctggccgttcagccagctgcagacctttggtaggagttttctttttccttttgtgtgcttttcgatcccctgggggcaaccattattcagtacatctggagggcaagttgtccaggaagaggaagcagatcctaggagtgtcgtccttcactgggagaggtgtaggaagtgagggggatggtggaagtactggcccgagctctgttttcaggagtgtgtgacagcaaaaactggcctttgcagttgagttgcctgtgggctatggcctagagggaaggccaggagggtcttgctgttagggctgccaccttcttcatgcctgctgtgtgctgggaggagagagctccttcagagcggacccaccattggattttgagtgtgtgcaaaattaacttgttgctatctgcatggttatctgtactccagaatcagttatacattttaaaacagctgtttagtactgaaaaaactcccccaacactccctgcgccccaccctggcctgcaaatagagtgccaagccaccagaatagaagtgctaaagtagtgagtttcctagaagtggcaagcctgagactccagtgagtcaccctcattgttcccctgaggcaccctgcctccacctgctctctgctctcgaagcgtcagttataccagcacttctctcttctcttttgtctctttttacagtcacccctttagagtgacaggcagcgtgagctcatggccttgactttgctggacatgcggagggagaggagagctggtggcagagtcgggggttgggccctgaggatggggctgttttattggagagtccgctgtcaccaggcctttctgtaaaaggctggaagtgagcgagtgaaccaggcaccctggtggggggcctgcatgtcagacccagcgggaagcatgtctgacttggttgagaggcagctaagggcccagtgtgtctgggtgggctgagccattgggagaatggagggaggggccagagagcacggaggattagctgtggccagatcacagaggctgtgggactttgggctccctctgggtaaaagccagagcccttgaggacttcagtagattggtggattgaaaggcacatgggccggtgctgtggctcatgcctgtaatcccagcactttgggaggccgaggcgggtggatcacgaggtcaggagatcgagaccacggtgaaaccctgtctctactaaaaatacaaaaaatcttagatgggcgcggtggcgggcgcctgtagtcccagctactcgggaggctgtggcaggagaatggtgtgaacccgggaggcggagcttgcagtgagctgagatcgcaccgctgcactccagcctgggcaacacagtgagactccgtctcaaaaaagaaagaaagaaagaaagaaagaaagaaagaaagaaagaaagaaagaaagaaaggtacatggaagattcgattgcttggattgccttagggaactatgagatccctaggtgagggttgcagttgagcatggtagctgcttttcctcttcaggttgcctttaggctgcgatggagatagcatgagctctggagcaggacaggcttctttctaacatgggcttggccactttgtgaatttgtgatcagagacaaggtcacggacctcactgggacctccctaggctgtccattctgagtctgtaagaaggtggagaggggcagccccagctgggtgttaggctttgcggagcctctgctgtctgatgtttggctccagcatcttcaaagcaggggcttttctcctctgtccacctgattggcctttgtgaggaaccaccacctggcggtggcctcattagcatcatgggccagccagctgagctgacagcccgcaggttttctagaaaggcccaccttcccttgtagtttgcacactccaggaagggccctgggtctgggagggttttctgggaccttggtgacagggagagtagggggctgaacattaaggtctgaattctgcgctgggggctggattgtccttaaaggcggttggcctcagacatccacatggcaaagcagggagtttagcccatctacaactcttctttatacatgaggagcaaagtatgagaccgcccaggtaattgctctgattggaagaaaatcatcacggagcagggtttagggttgaaatactggcctgcatcctgtactgttgagttgatctgagccaaggatagcagagaggaccagccatttttgtggtagctttctgttgtggagggcacttgcccacctcctgggaacgccacaccctggtgtgtttgcccttgttctgtttcccctgctgctcttctgctggaagctctggactcacctgtctctgttgtggatggtgcagggcgggcaggccagagtggcatccttgtcctgagaggtcccaggaggcagttgagtgtgtatgtgtgcgtgagtgcgtgtgtgagtgcacgagtgtgtgagtgcaagtgtgtgtgtctgagtgtctgtgagtgcaagtgtgtgtgtctgagtgtgtgtgtgtgagtgtgtttgtctgagtgcgtgtgtctctgtcttcatcagctcctaggagatgcctccggacaggggcctgcccgtctctccctccagttccttgccagtgtcatgtgacactcctttcagagggcaccccccgcccccagccaactcacctttttttgtaaacttagtttttaagcagtccaactctctctctggattcaaatgaaagctttagatcatagtctgtttcgatagctctgtgttcctggtggtggttttctcctcacaatgaccttgtaggctagctgagttttgtcgaggaagttgagctgggagagactggctcacacagcttgttagtcagcgctggggcaggaatctggcccaggcccttcatggcacctttcttagggtagcgtgccccctctctattccaggtgacctctgttacgcagtccccattgcctgccctggttccctgggctctgacatcaacttagatgtcgtgtttgacttagggcttccagccggatccctctccatacaccgggcttccttccagaccctgcatacctctcagggaaaaccaaaggctgacgtttggcatttccctgcttctatttatttgtatttgtcggccctgtatctttgtccacagctttgtgggtttgttagaataggaagtgaagtacttcctatataagctctggccatgctgtgtcaaactcacgtgcttccccagccttcagctcggggtaggagtcttcatgcaaatcagattgtttctcttttagtgtaggcaacagcaagttgttgacgacagtggttaccttaggctcttgacattctgctcccaaggtccagtgtgggaaccctgcctccttgctcctcttccttgctgttttttccctttctccttagttaaggagactggtctggatttctgaaggtgactgtgctggatatgtatgagctgaaacactgtctgatactgttgagggacagtagtgagccaggtgatttcttgaatactctgttagaggacttgcgtgcatgtcgaaagtaggagaatcttttttggatgttcaggttggaaacacttcacattctctttgtctccaacatgttagatttgttgcttgctgtagactcagagaaacatttctctagctagtgaccatgtatcttgttatgtgaatttcacttatgtgtcaccaactgggtttctgtcttttaaggaaaccaaattacagattcacacgtgcctacttttattattactgatcccatcctgcctttatcttgctttattaattgcaggccagtagtaaaatgtttaatagttacatgaccattagcataaccccaagattcacagggactgaggaaactaagatatattttaaaagagtttggatatatggcaataaatgaggaagggacagagtgatacttcatggagatgttttgtgttgaagggaaggaacccagttttctaagatttattttctttaagagattgagcataccatatattttgatcatagaattttacatactttagatgctagctgtttttaaaaggaaagaactccaaattacatcttgcaagctattgtggttttgcaagcattgagtgatggcatatatgaaaactctgagaggtgtcatattaagataccaatgtcagtttaaagatattctatatctgtatccctatgacattgtattttgaattttttatttttcatttttggacagacatttagaactcactcagtggagatggctctgcatctctgttttaagctttttgaactctaggcagctgtgtcggcctggggctacattgacttcttcattgcagcccctcgattggtttcgtctggaccagggtgggtttcgattgcggcccttgctggaacagtagcaggaaagtagaaacaccttcctgtctctgggttaaccagctgacagtctgttacttgtgtgcttccttctaattggtaatctgccaacacctttcaggatattatgaaatttcaagcaaatgaggttaaaatggaacctctgtacttctgaacaggcgtggactgactgcagttctccaggatagtttcagcagaagcagtgagattacagtcaggagcaaaacagtatctgagctttctttatgggaaagattccgactgtgtgcttggtttatatggttaaattaattgcccttgttaaattaaaaaaatagggtatgtttctgccacagactttgctttaaaagcagagatcttctaaagtcatttgccttgtatttgacttctgctgctccccgtttcctgctgggcctgatggtttgattgtagaatgtttctgagttgtgtcactgttggactctgctgagctgagtagtctcattaaaggagagtgtgcatctgagttgaggaagacaatatagatgtggaccttgtttgtagagttcacaagctgcttacatagaaatagcaaggacagtgcagccagtgggaaggagccggctgagggacttgatattatttccatggaaaccagttgggtatgggaagagaggttgtggaaggcaatgctctggtgtttggcaattcacactgtgcagaagagaaagcagaactggactgggagtatagagtagcagaagtttaagcttggggaagaagttgagcaaggaaaagcatatgatctgttgatcagcatgatgtgatgtggtctgaatcttcagacagttcacagctttttcatagaggctgtcctcagatgggttcaaccattctgagaattctgcctttacgatataagtagtatccatgacattaaaaacgagaagagaagcgttttggccaatgacggactgcataaactacagtctgcataaatgaccttggtcctagaagattaggatgaagctgaacaattcttatcacctagtgatgctgtagccattgtaatgtcgtagcacaatgcattagtcacatgtttgtggtaatactgctgtaaacgaacccactgcgctaccagtcttatgaaagcgtccagtcaggtcctaggcctttaggtccactcactcactgactcacccagagccgcttccagtcctgcaggctccattcattataagtgccctaggcaagtgtgccattttaatcctttataccatatctttgctgcaccttttctacgtttagatatgtgtcacatgttacagttgcctggggtattcagtgcagcgtcatgctgtgtgggtttgtagcctgggaacaataggacataccatatagcctaggtttgtagtaggcgacaccatctatgtgtgtgcagatacactcgatgatgtttgagcagtgacagaattgcctcatgacacatttctgatgacgtatcgccattaagtgagtgactataaaccagtccccccatcagcagttacacttcctgaggtttcagttacccatggtcacttgcagtctgaaaatatgaagatattttgagagagagatgccacattcacataccttttattacagttataattgtgctattttattattagttgttaatcttttacaactaatttataaattaaacttaatcatgggtatgtatgtaaaggaaaaaccatatccgaaaccgtattcctggttccaggcctctactgggggtcttgtatctgtgattacaaggtgctgcgaagggataactgtaatttttctatatgactagcattttattgaatcaagttgtgtagatggttggcaatataataggaactcagagatctttatgccatacagagtctgtccttttaatggcatttattgtgacaagatttaaactaaagttttgtggaatgttttgccagtttttgtgttgtaactgaaactaaatgttttctgaaaagttaaaaccatttctttaaatggaaaataaatgaagccgtttacctaattggttaaggactcacccgtgggcctcacaccgcctaggttaattcttcactttataattccgtgatgttgggcaagttcctcattctgagccttgggatatttggcttcaaagctgaggaacttgggagggttggataatggcatcacgttctgtggggagatttggctcacatgttagctgtgtgggtgagagccgtgctgtcatgcgttcttagccactggccagtttccttctcaagccatcagtagagatgctgatcctgcatctgccagtcattgctccaggagggaagacattactgtcccagagtgacggtgtcattggggataacagacacttcagaaaatgccaccactgagctgtatgaagtgccatggcagctagtgctggagctgtggattcagccggggagcactgtctggaggagctgctgcagcacatgtgtgtctctccagctgtcaggctggcctttggagtgcatttggattttttgagaatgagagagggaccattggctaactgttttacgctctgaaaaatgacatagaatagcaaagattttacttatttttgctgattttctagaacattttctgtcccagagtgatggttttgaagaaccagcgttcttggaaagatggttttgcatccagaagagtgattttaactaaaatcaggctgcctcccttgaggatggtcactgaattttgtacaactgggacaacggacagggatcctgggttgtttccagtggacaagccgcttctgtgggggcctttgcagttctccccgctcctctcctgtgtcccgctggtttccttcagttgagatggaatacagcatagagtcagtgacttttagaagacttgacagagtttcaggaaaatgctcactgggctttcttacctatcctgctgcagaactttttttttttttttttgagatggagtctcactctgtcacccagtctggagtgcagtggtgcgatctcggctcactgcaacctccacctcctggattcaagctattctcgtgcctcagcctcccgagtagttgggactataagcgtgcgcgaccatgcctggctaatttttgtgtgtgtgtgtgtgtgtgtgtgtgtgttttttttttttttttaagtagattcagggtttcaccatgttggccaggctggtctcgaactcctgacctcaagtgatcctcccaccttggcctcccaaagtgctgtgattacaggcatgtgccactgcgcatggcctgaagttctttctttcagaaaatgtattcaacacattcttttgtgtgtgtttgagtgaagacggtgtttccacacagcttgcagatactttcttccagaagcttgtttgttgctaacatttaacatcttactgttacagcttagttttctctttgattgaatatattgatctctttttttttttttctgttggcttttttcttaagtctttacttgtgtaagctcagataacttagtctagaatgtaggctttttctgggaatctcagctgaatggtttcatttgcttggctgttaaatgaaccatactgtttggaatagtttcctaattctggctgtacatgttcacttcaggtagagaattttctaacagacaaactttcagacaaaaaatttattattcctcaaagatatcattacattttatttagtctgtaataattttattgcttctgaaaccattttctagttctataatgtgatcatggtgcttttaaactttaatatcaagttaattttaagaatgattttagcttaggccattctaggggcttggcctttaatctgaaaagaaatttagaatcctttagtttcaaacatgtgatttcttaaaacttgttgtcagttatttatacgattttcaagtttattatgaaatagtctttaaaaaatatttactttagtggaaacatatctagtgatagtttaaccagggtgcataccagagtacataatagtttttggaatattcttcataaattttcagagagattatttaaaccacatgactgtttctgagctcctgttgatactaggggctaggcatattcgttttttctttttgagacagagtctcgctgtgttgcccaggctggagtgcagtggcacaatctcagctcactgcaacctctacctcccaggttcaagcgatactcctgcctcagcctccctagtagctgggactataggcgtgcaccaccacgcccggctaatttttgtatttttagtagagacggagtttcaccatactggtcaggctgatcttgatctcctgacctcgtgatctgcatgcctcagcctcccaaagtgctgggattacaggcatgaggcaccacgccctgccattagtttgttttaaaggagacataatgtccgttgaaacatcagaatgttttaagtactgacagcttgcaggtgtctttggagtgaagtttagaaacctgctgtgaccattcttcattttaaagctgtgactaagaactctgagatattggtgccttcgcctcaagtgctgctgatgggtttgaatggcattgaggttgccaggcctggaggagggctgccttgtgctgagtggttaaatcacccccctgaaaaaagtcagtgtttcaagtattttaataggctcctcctttcctactcccataaccacttacatttgataaatcttgacaaaacaagtatgaaatccaagtagagaaaataatataattgaatagagcaacacttttctttctagcaaccctgatttccagattatcaggacaatatccctcattttattcttttttaaatcttgattctgctccccaagcaaacacactctttaccttatttagatatcccctttgcaagaatggtggatttcttttaagaaaagcatagcaggccgggcgcggtggctcacgcctgtaatcccagcactttgggaagctgaggcaggcggatcacgagatcaggagattaagaccatcctggctaacatggtgaaaccctatctctactaaaaatacaaaacattagctgggtgtggtggtgggtgcctgtagtgccagctacgggaggctgaggcaggagaatggcgtgaacccgggaggtggagcttgcaatgagcggagattgcgccactgcactccagcctgggcgacagagtgagactccgtctcaaaaaaaaaaaaaaaaaaaaaaaagaaaagcatagcattttaggtacgtgtggatctctttagcgttgattcctaccagttaactcattttaaatgacaccctcatgcaccaatatcatatacttaggattgtgaaatagtttaatgatgccactgccgctacttgaagtttgtctctgttatcctggagaaactagtcatggctcctgaataagagattagcatttttcctgagtagtagccaagtctttgtttacttgtttatcttgtatcctgcaacctggaatatacactccgagagggcagggcgtctttgttttgttcattgctgtactctcctgtgcctcccgcagtaagtacttaagaaatacttgtgaaacacatgaataaaggttaacgaagggcaaaggaaacaagcctttattgatgatttttctctgtgcccagtaatacttgggttattttctcatgtccttgagtcatcttgactctaggagacacctcttaacatgttcctgctgaaaaagctgagctgaggagtcataccccgagggtatcaccctaagattgggcacctgagtaccccagcctgctcttcaggtctgtagctgcttagtggctatcagaccttccaagtctccatgcttttgaaggcctatgtgtgcggtttggtttcttggcaggggggtttgatgggttcccagacctaggagttcttggcgcctcgtcttccagtgaccccaccagggctgctctttctcctccattgctgaaactagttcagggttggggaggagggcacgtgggggggcctggtggttggttttgtgctgagtcattgccttggtgcactgtggaaggaagctctgggaggtggacggctccttctgtgagggagtgcttctgtcgtcaagggagtactgcatagggtgaataacacagttatgtagatatatatggtggtcttacccccagggcctccacaactcctggatgggcctagcctaagcaattctgatttaacttattgcccctccttttagcaatactgttgagttaaataacagtttttgcattgaaaataaaaaaattttatttttgtagagatgggatcttggtatgttgcccaggctggcctgaaactgctggcttcaagtgatcctctggccttcgcctcccaaagtgctgggatacaggcacgagccactggccaggtctttattttttgcattttgcaaggacattttaagtcactttcttccttttctgtttttactcctgctgaggagatgatccccattttacaaaatggacaaaacattctccccagggaagggaagagtagacatttgagaataattgttttcacagaaccgggaaaccacctattttgtcccaagtatactgattgatgcattagcaataactcactatctgctttgccagaggtttgaacaatgagtgttaatgcttggtgtagtgaattttgtgtgatttcgaatctgatagctgactcattgcacagctctgtcttgcgagttcagatctgaactgtagctctaagaggtaaaagcagaagtggagctgcctttcatgccatagctagttttttaataaaatagagttaaaaaatcctttggcttttcagcattttggtgtgattggaaaggctattactatcttatattcagcatgagtcttgagcaattactgattaatatgatttggctgtgtctccacccaaatctcagcttgtagttcccataatccccatgtgttgtgggagggacctggtgggaggcaattgaatcatgggggcggttacccttatgctgttctcgtggtcatgagtgagttctcacgagatctgatggttttataaggggctttttccccttttgctccgcacttctccttgctgaaaaagaatgtgtttgcttccccttctgtcacgattgtaagtttcttgaggcctccctagccatgcttaactatgagtcaattaaacctctttcctttataaattacccagtcttgagtatgtctttattagcagtgtgagaacagactaatacactgatctgagttgatattcttaaattaatggtaagatatttcttttttttttttctttggagacagagtctcgcactgttgaccgagctggagtgcagtggcacgatctcggctcactgcaacctccgtctcccaggttgaagcagttctcctgcctcaccctcctaggtagctgtaattataggcgtgtgccaccacgcccagctaatttttgtatttttagtagagatggggtttcattatgttggccaggctggtcttgaacgcctgacctcgtgatccacccacctcggcctcccaaagtgctgggattacagacgtgagccaccatgcccagccagatacttctattttgataatctttgagtcctgaggtagcttcagaatggattgaaccacagacagatggtgttagtagtttctgccctggcttctttgcaacttaacatacttgactttttagtgtttttggctaaggaaagtgtattttctagtttgtggcagttttaagcaaatgtggcttgaataaaactagagagaagtttaatttttgataaatcagtgacattgacaagttgtttttcttcctttccagttatacatgggaagctgttgataccaaaaataatgtactttataaaatcaacatctgtggaagtgtggatattgtccagtgcgggccatcaagtgctgtttgtatgcacgacttgaagacacgcacttatcattcagtgggtaagtagaactacctgaaattactggattggcaatatgattccccaattttgcaaaaatgactgtgtatagctatacgtatatagcgatacaaaaattttgaatgtttagaaatcataagtgtttataatacataatacacatttgttagtagttaaaaatgctaacggtttgaatgtctagtatgagctaaaactaggttggttctgtctagtggatactatacagacagctgttatgaagaattatgtagatgtgtatttgatattgaaagctgtctcctagatggctctcccttctcacccacacttttcttaaaccctgtttttacattctcccccagcccacatttccttttagtgctcccccgactcccattcctttgtaccttccagctttggctgtagttcccagacagtgtttctgctgtcaaagatggtcactggagttaggcttacattaaaggttaaataaatagtcctgaggattggcagtctcagagaaagaggtgcagccccttctttcctagggttcgtttcattccccaaatgtatgccttttgggtcaggatcgctatccttctgtgaagaatatgaatccaagtggattaatatatcagcaccaggttacatagagtggagtcagggcagatgcctgaaggaagggaggcagggcagacagaaaagcagaatgcattgcccttggatttggcaacatggatgtccgtggtgacctttcactaaggcagttagaataatgaggtttgaccacaat

SEQ ID NO: 329 - DNA, 26148 bp, Homo sapiens
tgcaaatgtatgcattttctttccaccaaaaaaaaccctgtctttgtacatcaattatgtgtcatataatcaaggaaacacgatagatcattttatagagatgtaagaaaatcatcaatatgatttgcttcccacttcattcacttccctttatattccctggcattggccaaggttttaaaataaagacaattcagtatttcctaatccctggccagctggccacctggccacctgccaccccaggcacttgggcactggaactaactttaatataaatcaaaacagcaagaggatgtgtgtaagcccctgctctagaaattccaaggggaaatgggaaggagagaaactaatgcttaatgagcatctgctatgtgccagcctcgtgcggtggaattggaggagtgaggagggcttctgtctccagactgtaaaggagaggatgtttcaccattctgaagtcagagggagaaacgtttccaactgaattaagagagaagagcccaacttgcagtgttccctggcccctggtaattaattaatcaaagtaaggttttcttttcaaaaagtgtctttaaattgaccatctcttgtaaagctggttattttcagatgtgccatgttcctgtaggcaccagcttcacctcacactgcctcggtctgagattgtgcgcctggaattgtattgagtcagaatcacctggtgggcttgtgaaactgcagctggctgggccccacccccagagattctgattcagcagatctaaggtggggtctgagattttgcatttctaacaagctaccagtgatgccgatgccactggtgcactttcggatcacctgaggagctttttttcaaaaagactggtgcctggctcacacccccaggatctgatttcactggcctgggtgcagcctggcgttaggaatgccatggctccacaggtgattcttgtgtgctgcccagcctaagggccactgggtttaccgaaagaagccagcagacatgatgagcatttcctgagcctatgagattccttggatttcagggacaacctcctaagtcttcccagatcagggcctgccaggcagagagtctctgagggatggagggaagctgtcctatatgagccgtacttccacacctgtatctttcataccaagtcaactggttgctaatgctagtggggaaaaccatgtgaactgattagtaagatttctggcttctctggccaagcttctggaccacatggctgttgccagtgctccctcagatggcacacacttgctagcttgccacagtccccatcaccccctagtgtgttaccctccttggcctgagactcactgatttgagctacgtggcgccattgattgtccgtcttcctgtttgtggttgggtgtgaatggacaggtgctttaggaacgggaactcagatcagtactttcaaaggaagacaggagacacgggaaaaggaccctgtgtgtgctttgaggatgatggtgacctcaggccctgctcttagcctagaaggggtgggggatgttagactgaaacccaagagacttgtaatctcaccccagctctgtcgctaatttgcagagtgactttaggtaactaacaccgtctctctatgcctcagtttcctcatctgcaaagtgattgagggtaagacatgctgagcacccatgtccttcctattctaggagctggagagaaaagagtccaagtcttataactaagagttgggaggagggggaccctgaagcctagggagggagacagctgggccccaggatgtgggctgggaaggaggcacggctcgtatccagtttaaccacaggcccagccatccccagctcctcaaagctggactctgcgcccccacccatgtgtgcaggtgaagcctaattcttataccaactctgatgcgaggcgttgtgggtagtggttgaaccctggactctggagtcgatgtggcccagtcctgtggctctgccacttcctggctgtgtggtctcaggcaggttaccaacccctctggagtctcagtatctcacatgtagcatgggctagtaatgggtagctgtggggatcaaatgagctgtgcccggaaagcatttagctctgtgtgtggcagatgctcaggggtcacaatcatcatcattaagaggaggcactcaagttgtgcctggggcctcgtttatgccccagaatctcagccccaaccccaagatgtgtctcttttttttttttgagacagagtctggctctgttgcccatgctgaagtacagtggcacgatctcactgcaacctctacctcctggtttcatacaattctcctgtctcagcctcccgagtagctgggattacaggtgtgtgccaccattcctggctaatttttgtatttttagtggagacagggtttcaccatgttggccaggctggtctcgaactcctgacctcaggtgatccaccagcctcgccctcccagagtgctaggattacaggcgtgagccaccgcacccagccccaagatgtgggtcttgataatagggatcccactgccctcctaaattcctatgattgagcccagcttccccgaaatgggggtctggcccagcccaagttcactgaatggctctcagactccctacagacctgagctcttgcaatcaggtcaccctctgcccctgccctagtttcctctgccagctgccacactcaggtgccctgaggcatccgggacatgcagtcaggcagtataatctcccctagctgtgtaaccttgggcaggttacttaatctctctgggtttttgtaaaaggggaatgataacctccactagatcctaagctcctcgagggaagggatggtgtttgctttatccaccagtgtatacccagcatctagtccagtgcctggcacatagtaagtgctcaaaaaatatttgttggatcaatgaatgggtggcctaaggactaaattgaataatatatgtgaagcacagtgccaggcacacagtagcccctaaattaatgtttcttggaactgaacctatctgattccctgaacttctgtgttttcctttgtgctttcttgtggcctacatgttgggacacattccaggaacttggaccatgaatcgttaagaccttggtcatcacacttggcccctacaaatacctctcaatttcagcagtagagccagccccagggcctgtcccacaaccctggcccactttatctatcctaacgaactcaacaaccacgtctgtgtgtacatccatccacccatccactcactcattcattcattcaacacattttaaggagtgtctactgtctccatacttcctccccaggctcccccaaagctatggattcctacataccatgggttacttgatgtctccacctgggcctgccatgatgttgtaaaaggccaaaccagaccctccttttctcatacccacttttcctccagggctctctaagctgatggtgccactgccagcctggtcacccaaaaggggagcccaagagttgcccataatacccccagatgggcacccaggcctgactatttatttcctatgttcttctcagatatcgtccctcccaaacttttctgctccattagcctggggatctccaagctctttttcctgagattctctctcctcactgctctatccccatttctctctccctcctgtctatcctctcaatgctgctcccaggaggctccatttcgtgcccccaccttcaagcctcccaattgctttctgtccaaactgttggcctgttctgaagattctcacaatctgggggccctgcgacctgctcagcctcatctcctgctctctgtctcatatgtcataaagagtcccctgaccagtatcattctatgtcttacctccagggcttactccttctgcctgaaatgtctttctttcctcagctcacccctttacttggccaacccttactcaccattcaaagccagttcaatgtcacctgctccaagaaaacttttcagaccgcacccagcctagattacagactcttcagctctgctcccatctgacccatgcctgactccatcgttgtagttaccacattatttcataattatctgcttatgtgtctggcttctgcatgcttattcattgttctacccctctgtgcacagtgcctggcacagagtaactccctttgcagatactatcgctcggtaacaaatcaccccataatttagtggcttaaaagtgctatttaatcttgctcatggttttgtgggtgtagaatttgggaaggtctcagccaggcagttctcatttgggttctgccatggactggatcacccaaagtctcaagggggtgcatgcaaatgggcttgggttctgccatggctgcattggatgctggcaattggctgggagttggccaggctttccactgaggtgttacatgtggcctctcgagcacggcaatctcagggtagtcagacttcccccggaacccgcgtcccaagaaagccagaaggaagatgcacaggcttatctaatctaaccttgaaaatcaggcagtattgcttccaccacgttctatgtgttacaagtgagtggctaaggtcagcccagattcgaggcaaggggacagaagccctgcctttcgatgggaagagtgttaaaaaaatttacagacatgcttcaaaaccaccagaaccctcaacacatgtttgttgcatggatggttgaagagatggatgccaagttgcttcccacctatccctatcctgccccatgaatacctagttctgcttttttttttttttttttgagacggagtctcgctctgttgcccaggctggagtgcagtggtgccttcttggctcactgcaacttccacctcccgggctcaagacgaggtctcattatattgcctaggctggtctggaactcctgggctcaagcaattctcccaccttggcctaccaaagtgctgcgattacagacgtgagccactgcatccggccaatatttagttcttttcttcctgcctctttctcctgcaccaccgtgactccagcacatttgagggttggcagagtggcctggtggtagaagaacacaggctagcaacctatagcttctgcctccatgtgcctgctgccagctggtgtgagatgctaagacaagtccctctcctgtcctaggcttcagtttccctacccagataatgaagtgctgggccagatattctctaagatcctccccacctcccaccttctgctctaactttaggcatctctataattcctacttgctttctgaaaaggcagctggaagcccaggccagctccatgctgcaaagctgcccccagccatcatgtctttgggagttcgcatcttaatgacacaagcacacacagtacactgtggtgtgagaaactcaaatactacagaagtatgcagagtaaaacgtgaaattccccacgaccttcctttacgccctgcctccctccgaaggggactgcctccatagttcagcgattgccccagcagccttttatacacctactgtccggcaacgtgcagctttctcagaaggagaaagctttgctggggatatgtggttcgttttatcttttaacaaataaaatcatactgttcatatttctgcaactttctctttttcatgtaattctatgtctaggacatcatctttccaccacgtcccccagccttttctttttctttttctttttttttttttgagatggagtctcactctgtccccaggctggagtgaagtggcacaatcacggctcactgcaacctctgcctcccgggttcaagcgattctcctgcctcagcctccagagtagctgcgattacaggcattcgccaccacgcctggctgatttttgtatttttagtagagacggggtttcgccatattggccaggctggtctcgaactcctgagctcaggtgatctgcctgccttggcctcccaaagtgctgggattacaggcgtgagccaccgctcccagccttttaaaaaagatgctctataatttgagatggtatggttgctgcaaagtttatgagactattctccacattgtcaaatattttggtaacttccaattttagttattttatacaatcttgcaaagggccgtgttcagcgctccacggaattgcagggctgggggacactccattcctgcgtcctagagagcctctttcaagcaagctctttcaagcaagcaaggagtgcaaatcctcctgcctgcaaattgcgggctgtgaggcctgagccaacgcactggagctctctgagaacggctgtgacgagccgagctaacaatagccctgcttagcagccccgcggcggctgacttggtgaggcccgcaggcccgcctcagcccgccctccctccgccgtccgggcaggaggtgcaggggcagcagggcccgcctggctcgctgcggccgcttatcagagccggctgtggcgccggttacgtaaccgggcggctaatgctgttttacttgtcgatgaaacccaaattaaaagaggaaattattgtcctgatgctcaactcgcctaatccccatctgtctcctctctggtcccccgcgctgccgagcgctcgcatctaaaggtcttgaacgcgttccaggtttctaatttcgtttgcttatgcaaccaaaaatattatggccgcgtttcctgggggtgatgaagtctatattctgggctacaggcacactaaaaacggcagcgccagggcccagcgccgctcgcgcgtgcaccacgcgccggctttttttggttcctccgaggcgcgggcagctctgcagccgcgggggccgcaggaggtgggggctggacccgcccggagctcgggagggcccgggatggccccggggagcgcaggtcccggcaggggccgagcgaacaagggccggcctggggcgcccagagacgcgggggaccgttctggtcgcagctgcctgggtgacctcttggaacctcagcttcctccttgttttttttctgattctgactctgattcctgtgtgctgaatccaggctgtagtgagctgtgatcacaccactacattccagcctgggtggcaaaaggaagatgagagagagacagagagagagagagagagagagagagagagagagagaagagagagaaataagggagacatcaacaccctggaatattgtgtagatgagttttaaaaaaaaaacaaggtagatcaagatgtattaacatgtatcagattgttaaatttctttaagaaataaagtcattgaaaaatagaaaaatacagaatatggttcaacttgagtttttaaaaatccatgggctggtgagaagcaaaacagacttcagtgtttttaccccacttctgtattgtctgaatcatctgaagagacgctgttcatgtatttcttgcataattttaagtatctgattttaatggtatgagggacgggatagcaggggccttcctgaccctgtaattctctggaagcagtggtcagatcaggagtgggactggctgcaaggcttctgcccccgatccccgaccccaggctggggcttcaggatgcccgaccacagtgttctgagggcctctgaccatcaggaggccactggaagtcttagggctgagggaggcatgggtactgggcctgggagggcagacgctgagggcagagcaagggccctggagtcagaacccaggcttctagtccctggagcattggctcaaatggcagagtctcccttgttcctgcggccactctgggtcttgagactggtggcatcctctgccctgacagccaggccaggaccagtgcgaggaggagccaatggaccctggctggctccgaggctgcggggctgggtgtgaggcctcaccttagccagttctggagatgtgccccttgacgtggcttctctgggcgaggccaggctccctgtgggccccagatgcagagagccaggattgattctcaagccacgaggtaccccccatccctgagataggcccagcctatgtgcgtggccctcatcagccagacacttggaaatatccgcacagttgctggagaagcagagaagaggccgcttgaacacagggagccatctcccacagcacaccacagacttccccgggtgcgcgccgaggagcacggattctgacaaggcgttataccttcaaatcaggttctaatagccaagaattgcaggaacccctgtgatgaactaacttaagcaggtttctttactttaggacttctcaggacctttcctatgctggggtacatgatgagtctccatgaaggtgtaatgagtgcaacttttactagaaacccacggactcaggagccctttccttccagagcatctcacagggctagagggctccaaaaacactgagccaatgaaggtgggaaacaagcactgagggtgcaggaccatcgcagacagagtttgggaaaacttaagaggaggatgaggcctggtgcagtggctcacacctgtaatcccagcactttgggaagccgaggcgggtggatcacgaggtcagaagttcgagaccagcatggccaacatggtgaaatcccatctctactaaaaatacaaaaattagctggacgtggtggtgggtgcctgtaatcccagctactcaggaggctgaggcaggagaatcgcttgaatccgggaggtggaggttgcagtgagccaagattgcacaactgcactccagcctgggtgacacagcaagactctatcttggaaaaaaaaaaaagaggaggatgagtaagcactgtcctgcatcactcaacaagggggatatgtcctgagaaatgtgtcctcaggcaatttcgtcattgtatgaacatcatagagtgcacttacacaaacccagatggtagtatggactaccacacacccaggctactgctcccaggctacacactcagagagcttgttactgtactgaatactgtaggcaattgtggcacaatagtaagtatttgtgtatctaaacatatctatacatagaaaaggtagagttaaaatacagtattataatcttgtggggctgggcacagtggctcatgcctatactcccagcactttgggaggctgaggcaggtggatcacttgaggtcaggagttcaagaccagcctgaataacatggtgaaaccctgtctctactaaaaatacaaaaaattagctgggtatggttgcgggtgcctgtaatcccagctactcaggaggctgaggcaggagaatagcttgaacccaggaggcagaggttgcagtgagccgaggttgtgccagggcactccagcctgggcgacacaagcaagactctgtttcaaaaataataataataataataatcgtatgggcccaccactttagctgcagtctgtagttgactgaaacgttatgaggtgcatgactgtataagaaggtgtgagaaaagtggaggccacctcacctgtgagagatttgtttaaagaccagtcctgctaatagaatgcaggtgggtagggggtggggaaagcccatcaacagagcaggtgtgggactaacattcatctcttttctcggagtttgacacctgggctcatgcacatatgtgcacctacctaggcacatacccaaaggtacacatacaaaaagctcacatacaagcatgtgctcacatgaaacacacacaagcacacatggaagaacatatctcctcatgggcacactcgcatacagcaaagcacacacccatgcacacccccaggtgtgtgcccacacagacccacctgccaaggcaaacccatacaaaacacatggaaacacagatggaggcacgcatatccacacacatgagccggagcacacacagacatgcactcagcgcatcacacatcaacactcgcgtacacgcactggggtgtgcatgcggaagacaggtgcaggcgcatgctcagagcacgcacctgcatccacacactacgcattcacaagcacagcgtgtctaaggccataacagcttccctgcctctttgcggaggtggggccagtgggggtgggagtgacactgtgttttagagggaagctgaaggactcccaagcacgttgagtaaagcagttcacagaaggcatatgtcctttgagtatttttatctttagcactcatatgtctagcagagtctgggtggctccatattgctaccaggaaggaggacaagtggctggatttgaaagcagatggcccctgggtgcagaggaaggataccccttgctccctcccccgccacaccacagcgtttcctacctcaacatatggggtcccccaaaggcctgtgcaagccacctgcttcccactgtgaaaacagctggcagagcagattcctcagcccctagctgggtgcctggagagaggttctgacagcccccagcctccaaccaacccccgtctcgggagctcaggtctccagagcactttgggccaggaccatcagtcttgggcctgggctgtgacccactgtgggcggctctctgcagctgcctcgaatgtgtgcatggatggtgttttcccctatccctgagctggcaggaggtctgggcacgtgccctggccctctggctggtcaaggacaagccgatggatttcgaaagctatttaatccctgggttctgacgcacccggttcaccaccaagcgggatctagtgcccacaatctgatgtcagagggcgggagtggccttggccaggccttggcatgactccatcccctgcccacatggcactgtggtggagccggcagggagcaagaggcgcccagagccttcgcctcttgaatcacaaccatttgttaggctcgcaaacaccagcatggcctagaaaatgaggtaaaacaataacaaggaaaaataatcaggtgctattaagtgaaaagagcagataagcaaaacattataatcgtgtttatttgagaacagtaataaatatatttaggcagagggaaaaaactggaaaaaccaacagtgactatctttagaaatgtaccattcaacaaatatttactgagtacctgctattggtcagattgttttaggtgctgggcatacagtagtgaagagacaaaaccctttaagaagcttatattctagagagttaacaggcaataaacaaaatatacgagttcaatatatagtcaattagccaggcgcagtggctcagacctgtaatcccagcactttgagaggccgagatgggcagattgcttgagtccaggagttggagaccagcttgagcaacacaatgaaatgccatttctgctaaaaatacaaaaattagccgagtgtggtggttcatgcttgtagtcccagctacttggggggctgaggtgagagagttactcgatcctgggagttaaaggctgccgtgagccgagatcgagccactgcactccagcctgggtgacagagtgagaccttgtctcaaaaaaaaaaaaaaaagttaaatggtgtaaattgtgttaagtataaatggtgttaagtacaatgggaaaaggctggtttgggtttgagaattgtgggttgggggctgtaatttttaatagattcaattttttaagctcagttccagttttacagaaaaattaagaagacaatatgtcacagatgggaactgaacaatgagaacacatggacacaggaaggggaacatcacactctggggactgttgtggggtggggggaggggggagggatagcattaggagaaatacctagtgctaaatgatgagttaatgggtgcagcacaccagtatggcacatgtatacatatgtaactaaccggcacattgtgcacatgtaccctaaaacttaaagtataataataaaaaaaaagattacacaacaaaaaaataaataaaataaattcttgaagagctattaaaaaaaaaaaaaaaagaagacaacatagttacccccaaatcctccctcctcctgcatgcagtttctctcatcagtgacaacttacattagtatggtacatttgttgcaatgaatgaaccaatattgatacattattattattattattattattattattagagacagagtcttgctctgtctatgtggtggtgcggtaatggctcactgcaaactcgaccttctaggctcaagccatcctcctgcctcagcctccagagtagctgggaccacaggtatgcaccaccacacctggctaatttttgtattttttgtagagatagggttttgtagagataggagttgcccaggctggtctagaattcctgggctcaagcaatcctctcgccttggcctcccagagtgctgggattatagacatgagccactgcaccaggccttgatacactattatttaccaaagtctatagtttatttagattttctgggtttacctaatgtcctttttctgttccaggatcccatccaggatctcacattctacgtcgttgtcattgtcttgcctcctgaggctcctcttggctgtgaccacttctcggacttttattttgatgaaaatattttgatgaccctgacagttttgagaagtcctggtttggtgtcttggaggatactgctatactggaatttgtttcgtgttgttctcatgtttagacaggggttatgggtttttgggtgtctgatcacaaagccgaggtgccgttttcatcatgtatcctatcagaggtcctatcaactggagttacaaagatgctgactttatcacgggtatccgctgggtttctgcaccgcagaatgagcccccttctcccgttccacactgtactctttgggaggaagtcactaagtgcagccacacataaggcctgggacttatgctttcagccccaactcatttagggtgaaatagtgacataaattggcctggtgcagtggctcatgcctgtaatcccagcactttgggaggtcgaggcgagcggatcacctgaggtcaagagatggagaccctcctggccaacatggtgaaaccttgtgtctaccaaaaatacaaaaattagctgggcgtggtggtgggcgcctgtaatcccagctacttgggagactgaggcaggagaatcgcttgaacccaggaggtggaggttgcagtgagctgagattgtgccactgcactccagtccggcaacagagtgagatcccatctcaaaaaaaaaaaaaaaacgacataaattatttgaaattcttctgcgtgggtttttttgtgtgtgtcttctcccccatttattaattaatccaagcgcttatttataatggactcatggatatttattttacacttgggttatactactacttcattttactgctcaattgttgcagcgtttggttgttggcagctctttcagtcggctccttcatccctttgatacccctctctccagcaccaatgtggttcttttctttttgagcccttccttactctctgacactacacgatgctcctgtcccagtcctggaatcagccatctctcccaggagccccggatcctttcactgaagaatggtattagaaaccaaggtactaggtgtgatctttttgttgttgttttgagacagagttttgctcttgttgcccaggctggagtccaacggtgcgatctcagctcactgcaacctcggcctcccgggttcaagcgattctcctgcctcagcctcctgagtagctgggattataggcgcccgccaccacgcctggctaatttttgggggttttttttttgtatttttagtagaaacggggttttgccatgttggccaggctggtctcgaactcctgacctcaggtgatccgcccacctcggtctcccaaagtgctgggattacaggcgtgagccactgtgcccagcctgatctttactttttaacatggtggttagtgaaggctcttctgagaagataacacgtgaatgaagatgtaaagaaggtgagggacaaactgtggggagcttcaaggaggggacttcaggaagaagggataccccttgctccctcccctgccaccccacagccttccctcctccaacatactgggtaccccagaggcctgcccaagccacctgcttcccaccagaaaaatagccagcagggcagcaggtgcaaaggccccaaggccgacatgtgcactgcgtagtcaaggaacagaggccagtgaggctggagcaaatgggccgtggaaagagatggtgttggagaggtggggcaggagcagatgacagaggggccgcccgacaggacctcggcgttgccttagactgcagaggaagcagacaagtgacactatcaactcactttttaataaaaccactttggctaccatgctggggatagcatgaaggggcaagggccgatgctattttaagaatctaatgagtgaggatgttggcttagactggatgatagcaatggaggttgggtgaggggctcagtttctgaaggcagagccaacagcattttctgacagcttggatgctgggtgagagggggtggggggtgctaaggttttgcctgatcatctggaaggaggcagttgggattagtcacactgggggaagactggaggagctcacatggtggacacattaagtttgagatgcccatcatccatccaagcagagacgctgagtttgtggccgtgtaggtctggagttcaggggagagggtgggctggagggataacatgagaacaggctcccagctcagccctgttccccgacacaggtgtctccaggcaatggatgtacacctgtgggcttaggctgaatccaacacaggatcttgaccaaggagccagcctgtaactacatggggagagggggcagctttgagaaaacctggccccaagtcccggcaggtggagcagacgctgcatgcggctcttggtcagcttcccaaggaccccccgccttgctctgcatgggggtgccccgcaagcacccagggctcagggcatggagaggccccaggatggggactgggctttccctccatctgagctgctccccaggccagaacttgggggccacacctactttttcttccgctcccagcctctgggtcctggccacagtcatcaaaactgctgagtgaaaaaaggcacaaggccatatccagagggcagcctctctgacctttgggaagtgacagcaccaggtcactggactcccgaaacaggaggaatggacaggagaggaggagggggagaagggggtgagggaagagaggccaggggacaggacagaagacaaggagagggaggaggaggggagagtccagaggtgaggggaggtaggaagaggctggtgtcctgagctgtgtcctggtcccacagcctggtgaaggggcagctgacagcaggggtccttcttgccacctatctgtctctcacatgccacatctagtccaccagcccatgctgtgtccaccagccatgccgggggctccccctcttccctcgctgatgcctccaccctcgtcgaggccacccctctctctgacctgtgcctctggaagggcctcctcccacttccgtcctctacagtctgttctcagagcagccagaatgacccttctcaaacaaaacccagatgaggccatcgcttcagaaaccctctcccttccctagagtgaaaggccccctctcgggccaccgagtctgccctctggtctgcagtcctcccttcagtcctcccacagcggcctccctgccgctcctccagcagcccaagcaggctcacagctgccacagggcctctgcacttgctgtgccctccgcccggcctgctctgcccagcaggtgccttgctcctttgcttctttcaggtcagtgctgaagtctcttcagagaggctgccctgcccacccaatctgaaacagactcctcccaccactgccactgttcccttccccagcttactttttcttaagacttacaccactttatatatacatatatatatatacacatacacacacacacacacacacacacacacatatatatatatatttagataaggtctccctctgttgcccaggctggagtgcagtggtgcgatcttagctcactgtatcctccacctcccaggttcaagcaattcttatgcctcagcctcctgagtagctgggactacaggtatgtgccaccacgcccggctaatttttgtatttttagtagagacggggctttgccatattggctaggcttatataagtattaacgcttccccactggagtagaagctccctgaggaccaggcatttgttttgtccaccaacgcatcccggcacctggaacaagctccagcaggtgtggactccatggatacctttgaatgaatgcatggccatgcctcaccttctacagttccctagggctggctgagggaaattggttgggcctggctgtcctcctcaggcccaaacaatttggctctcagaagttctgagaccaaagtggaacctatcacacgaaagatgggaaggacaccgggcgcagtggcccacgcctgtaatcttagcactttgggaggccaaggtgggcggatcacttgaggccaggagttcgagaccagcctggccaacatggtgaaaccctgtctgtacttaaaatacaaaaaattagctaagcgtggtaacgtgcacctgtaatcccagctactcgggaggctgaggcaggacaatcacttgaacccgggaggcagaggttgcagtgagccgagatcgtgccattgcactccagcctcagtgacagagtgagactctgtcttaaaaaagaaaaaaaaaagaaacatgggaacatgggaaggaaattcaccaaaacctctgcgagcgaatgactcctttctcccaaatctgtaattttaccatgtcttccccaatccattcctcacaccttcctgatgcctcctcttcccccattccccagagcctgctatgccccaggtccttccaggacacctcttttatttttattttttaatttttgagatagagtgttggtctgttgccaggctggagtgcaatggcatgatctcggctcactgcaacatccatctcccaggttcaagcgattctcatgcctcagactcccaagtagctgggattacaggtgcccaccaccacactcagctaatttttgtattttagtagagatgaggttttgccatatcggccaggctggtcttgaactcctggcctcaaatgttccacctgcctcggcctcccaaagtgctgggattacaggcgtgagccaccgcacccaacccaggacacctcttaaacatctctcctctctccggcccactgccttggtgcttatcagctcagggaccccagtggtctcagggtttgctctcatcaccacaaggcagtttccacagagatccagaatgatcttgctaaaaaagcacgtctgatctgctcactcccaggcttaacccccttcattggccctcaggattaggtccagagtccagagccatctgcccctaccctgtctccacgctcctgctccctcctgggctcctcctgctgagcctcctgtctgactcagccacatacctgccgccagccccttgtgcccacagcacctgctcctcctctctcagccctcttcttacttgattgtgatgcattgtgttactgccatccagactgcccatttcgagttcccgtgtgcagcctgcctggacggaggccttagcctctgccctgagtcccggttgcatgggaagtcctctgggtctcagtttggatgtttgtgggtgaggagcagctgcggtgggtaaggggtggctgatgaggatcacggggtgtgctgagactccctggtccttccctcagtgacgcccctgctgtcgccacttgtccccaggctctagaagaactgggtctctctcttgtccagtatctgccagggaagaggctcttaggctcttatctgttgaatggttgaatgggtcactctaaacagcagctgtaaataatgtccatcttttttttttttttttggagacagggggcaaactttgtcacccaggctggagtgcagtggtgcaatggctgacttcaacctcaacctcccagcttcaagtgatcctcctacctcagcctcaaagtagctgagaccacagattgcatcaccacacctggctaatttttctttctttctttctttcttttttgatatagagtctcgctctatcccccaggctggagagcaatggcgtgatcttggcttactgcaacctctacctcccaggttcaagcgattctcgtgcctcggcctcccaagtagctgggattacaggtgcccaccatatccggccaatttttgtatttttgtggagagagggtttcaccatgttggtcaggctggtcttgaactcctggcttcaagtgatccgcccacctcggcctcccgaagtgctgcgattacaggcatgagccactatcattttttgtttttaaatagaatggaaaacaaaaacttaccttgaaaaatcattcttactgaaatgattaaaaagtaacattcctgtatcttccaaagctgagcagacacacagccgggccccgtcatccctgccctgggtattcacccaacagaaatgcattcatatgttcacaatacacaggaactagaatgttcatagtggcactattcaccatagccaggaactggaacctccccaaatgtccattagcagtaacatgggtgaatacattttaacagagccacacaatggcaagccaccagcaatgggtacgaacagcccttgactgcctgtgagagtactgacaaacctcacaaacataatatgcagcaaaagaaaccagacgcaaaacggcacccactgtatggctccatctacacacagttcagaagcaggccagagcgcctgcgggctgagtcaggagagaggctggactcgggaacagtaggtggaaggggtctcgaggggcttctgggtgccggtgaggtgctgttttttaatttgggtgctggttgcacaggtatgcaaagcatgtgcaaattctttcagttgtacactttgatttgtgcagtgttctgtgtgtgtgcttaacttcaattttaaaaagtcttaaaaataaaagtcatgtctcctggagcaggttaaatccacctcccttttctatccaagggcaagtggagagcaggtggctggcctccctggggcacaaccacgtgtcccctcatgggtgctaccagagtccctccccagcctgagactcctgaagccccagactcagggattttctttccactaagctctggtaagtcccaccatcacagaccaggcctgtgtcggccccagaagcaggatcagtgttagctgcagcctggccctcactggctgggttactccgggcctcccttgccatcggccacccccaggcttggcgcggaggcgcaggccgcctgggtcctcgggttgtgtccgctggcctccctccaccttcttgcccctggtgggagatgggagtggggcttggaggtggggaggtggggctgtcggtgctccagggtccccgcagagggcagggaagccctggacctggtctgaccttgcgcgctagccccagaggtcgccgtgctctgctgtcggcgttcaggtgcccgcggtcgggccggggagggcagtaatcaagccggcccggcggctggcgaggggcgcgggtccagcgcgctgccctcggccgccgccctgagcggttatttataaccgcgggtcgcgttacctcctgaccttaagctggggcgggcgatccgcagcgattagcatctatctcctccccgccgcccgctgcgaacaaacacccctctgtgcgccctcccccgcccgccccgcgggaggccctgcaggaagcaggatgttgacccggagcctccctgcgctcctgcggcggccccgccacatgtgagtggcgggcggtggagtgcgggtgggggggaagcggggagcaggagctactcgtgtttgatggcttcccgagttgccaatgtcctggtctattctgagtgaccgccttatttacaatatagggctccccagcccgtgtctgcccaaaggggtgccctctcccaagccagtgggggccagccagccctggttggggcagcacctgcacaggtggtcccagaatcacaggctgcaaaccgcatcctccaacagccaggccgtcgttgctcgatggcagctgaaggccataggggaaggtggttgcgtcggggtcccacagccatccacggcagaccccggctcctgcctgatggtttttcccaacggctcccagaactcttgattctggtctggagaagcctcatgaaaggaggctggggtcgcaagattggcccattcattcaacacatttttattttatgtatttatttttgagacagggtcttgctctgtcaacccaggctggagtgcagtggtgggatcaaagctcactgcagcctcaaactcccaggctcaagtgagcctcctgcctcagcctgagtagctaggactgcaggtatgtgccaccatgcccagctaattgtaaacatttttgtagaggtcttgctatgttgcccaagctggtcttgaacttctggcctcaagcgatcctcctgccttggcctcccaaaatgttgggattacaggcatgagccactgcacgccaggaccattcaaaacttttttttttttttgagtcggagtcttgctctgtcgcccagactggagtgcagtggtgtgatctcagctcactgcaacctccgcctcctgggttcaagcaattctgctgcctcagcctcctgagtagctgggactacaggtgcccaccaccatgcctggctaatttttgtatttttagtagagatggggtttcaccatattggccaggctggtctcgaactcctgaccttgtgatccatccaccttggcctcccaaagtgctaggattacaggcataagccacgttgcccagcctcaacagcttttttttaaggcacctactaggtgccaggcacctttccaggcaaaaatccttatcctgtggagctgacagtccaagggaaagagagtccttccctggagcctagggccccatgatggagccacagtctaggcagttgctgagggccctgatgggtgagtcttagggagggagactgaggcagggagtgggagggccaggcttgtagtgcattgtgggactgcagcctgcgctgggtatttgctgagcaaggccaaggctatgtgagacactaacatcctgagcctgtgaaggctgaggcccaacagtgggtgtgccccctgcctagcttcaaatgaccttgcacccagggcagagggtgaaaagctcacccagtcttgggcgtcatcctggaagaactcatggaagaggacccactgagtcaggacatttgaggagcgcattgagggcggagggagcctgggctgcccgcctttctgccacgctctcagacacttggaggcgcttgggaggagtttgcctgtgtgacgtgaccagcccctgaccactccttgccttctctgggcctcagtttccacaaatgagcagtgaaggggttggctgagatgaggcgtttcaagtctggccgcctgtgcctctgatctagagaccccccccaggccagagaccctcccaccagagcctggctcaggccaggtgcatctgcctgatgcagcccaagaggctgggccatggtggaccaggagtagctgtggccgtgggtagctggtggtgcccaacagctcacaccagcgtatgagggagtggcacatacacatatgtgtgggagtctggtgtgctgggtgtgcctcagtaggtaggtggctgcccaggggagtgtgtgcttggcatgtgtttacgaggggtgtaaggagtgtctgcagcaagtgtgtagggggtgggccacatgtgtgtaggtcaggtatgtatagttggggtgtgggcggatattggaggagtgtcttagtggtcagggggaggcttgaggcaggggaggaaggcctggaggggccactccctcactctgcaaacccccctctggccacatggtcagcctgtggccgatgcgccctgaccagtcaatgaactcagggtctggaagagtcagcggcttttccaacctctttgccaaatgggatgtcagcatgggggcaggggtggtgggggtgcaggctggggaaggtggcaatgacttcatgaccagactactgagcaggtggggagagggggcagggcgctggaggccggctgggtgggggatccactctgggtggggaggcagcccaggctcatgcttcctcaggaccgctggattccctttgtggggaggacctcctggagggtctgcagggggctcccttggactgaaaaccctccagggactgttgcatggggtcccaataagctaacaacagccctggaaggtaaggcctcttgtccctatttgacagatgaggaaactgaggctgggagaggcagccacacagctagagtgaatggtgaactggactaggaacatgggtgggcgtgtttcccacactgccccacagtgacacagcgggggcggggacagcccttaaaatccgatcctccgcgaacaccttgaatcctcaaacctccatccatccaaaaggggctccgccttggggaggcccttcgcacacttctctacaatttgaggggccgtcggctgcaataaccacatagtggggccactacaagtcaacagaagcagaccctctctccaaaaacacagcagaccctgtctccaacacagactaggcctagttccgacttccagaatgccgtggtccagccctggcattgctgactcatggggtcaggctggcgttgctcctctgtggggctggaggggccccagatcacagacctgggggtgggtgtgagcactgtcttcgtacccagaggctgaggtcagcttttgggctgctctttcttcagccatttactagtttcccatcgtaataataactacccctacctaagctttatagctcagcaaggactttcacaaacattctgtcactcacaccacccttgcaccagccctgtgatgaggagttaatatgcccattttatagaacaagaagctgaagctcaaggaaggaggttctgggactcatctcagatcccatggccaggaagcggtggccactctggaattcttgaccctgcccagaccagcaccttccacagcagagaccccctccaaggagcgggcgacgtgtgacttccccatgggtggactctgggctgcagtgatcggctagcggtgccatctttagtctgggagctgtgtgaagcctgctccccaccttccccctcctgcaaatattgggggaggggcatggaggacaggaagatagaagcaaaagtggcagtgaccggtgcatgagagattgggagatacgtgctggggaggggttccccggagcagagctggctgcccttggcactgggcccaggcggaggagtggcaagaccaacagttcctggagcacaagtccctcagccggtgcccagtgccagccatcgccatgttctcatctgccagcagcaaaatgagaaaaataaggacaatatagtgaggttttactaaagctaggtttactcaatccaaaagactgtccttttatctgagctttgtattttcaatcgtgtgtgtgtctgtgtgtgtgtgtctgtgtctgtgtgtgtctgtgtgtgtgagcacaaaaggacctttcctttgacatttccttttaatgacctcaaactcagcaaaataaaaaaactggtgactagctggtgtggtggctcatgcctgaaatcccagcactttgggaggccgaggtggacagatcgcttaaggccagtagtctgagaccagcctggccaacatggtgaaaccccatctctactaaaaatacagaaattagctgggtatggtggcggacgcctgtaattccagctactcgagaagctgaggcacaggagtcgcttaaacctaggaggcgggggttgcagtgagctgagatggcaccactgcgctccagcctgggtgacacagcgaggctctgtcgcaaaaacaaaactggtgacgacgtcagatcctaaatttttttatttttttgaaatgttagtgatgtgagaaatccgaaaggctgagacccactgggctagcttgtacgtggctctgggtgaaacctggcacaggggggcaatgttttttaattgagggatgaatctaaacagctggaagcttctcccggggggaggaggggctgggttcttgcccagactcagcccctgaggccccagcctaggcatccccaggaaacctgagcagaaggaacattcacgtaactgtactgggaattctgagaagggcctaggggccagttccccatgccacacaccctctgctcatccctgaccgggagccgcgaggcaatcttcccttaaaccccacctcggcctcccccagcacccccaaggctggttccaaaatagtccaggcccttggaggagacatcatgggtcgggctggctgcctgtcccgagaggacatggcaataacgctgtggccgaatatagagggacagtagacgctgacaggggccctggggcctgggagcctcgcaggttccacggtgcctgctccacccccatcccttctgagccctgcaccccctaacctggacagctgggaggctggcgcccctctcctggcccagcccggcccacctggggacaggtccgaacaagcccaggtagaacaggaggccggcctaggagggcccagggcctgggctgggcatgagcttggggccacctctctctagggactcaaagcattttataagcttaacttcccacaggacatcccgagatcaggagaccaagaggaaccggggtgtctgctgcagagccactcctgctctctgttctcagcttccgaaggagaacagggccataaagctggggtgtgggaggctgagaggagagcaggaagccagtccaaaccccaataaactgctggttgaatcgaatcacaaataattagtcccgatggccaagactgcctccaccctcctctcctgggaattaaaagtcaaagggcagagctgctgacgcagatgccaggggagacatgaggcttggaacagctgggactcagctcccaggctccactgccccaggtcgcaggccctggttgccccggttgccccggacacgatgtcccccaggcaggcccctagagcttcattgccaactcagggaagggggctctgctccctcacccttcccctggtgctacgtcaacagaactagattcaaggttaatcaggctgccctgaaaactgttgccagatgacagcctggaagaagcagttgccagcctctctccctcccacccctgtaagaggaggaagagatctctgcctccctgtcgagggggagcctggctccctgaaacccactgcgccccttcccctaggtcggccttgccgcaggcaccccctggacggctgcaccaggtctgcgcgccagcggtgacccccagtggtcagtgcaggacttgaacctgagccgtgggcatggctgctgcagactcatcactgcagcctcagcccacagccagtgacttgggaagccttgccgtgtgagtggtttggggatttgatcttggtaaggctgttgctggcgtttagaggtacttcgtaggtgctgatttttcctaattgaactgtggctggatcttggcctaaaggtcccactgtcagcaaatccgtgtccacatgcctaagaatgaattcatcatcttctagccctaaaccggctcctcctcctgacttccctatttctattaatagcaccgccaccctccaaacctccgagtcatcttcagccgctccccacactgggcggggtgcctgatcttgcccctcctccctccgcaggtcaccc

SEQ ID NO: 330 - DNA, 20320 bp, Homo sapiens
ataataacattgaaatgtatttttattgatcgataagttatgtaacattagtatgatacaaagcaagtttgatatgacaatggcaaacacataattataatattgtttattttccttagatgttatatttaacatatttacataaaagaccaagatgtaggcaaaagcttcagtaatttgacttcattgagtgctttcagtaaacaataggtttctccagcaaacatcttattgccttaattgaacctccttgaaaaagaaaaccacacactttgtaatgtaaatgttaattgtagtagacaatggttctaggtaaatagcacccctggacatgaagtaaatgaaaggaatacaggcacttaacaatgaaaggttgtttgcacaaacagtgcttcaaatgtaaataaacaagggtcttctcaacggtcactacagtagtaaaactctggcacgtgtacagcagccaaattgagaatttatgtataaagtctctcagactttctaactgaaactaacagtggtttaacaggcttctccagtctgaagtcatataaggaattgaagctacaaaggaaattgtactacttttaaagaaaaattgtatatttgggattgtcaataatctaggccacgtggaagataacaggctattttggatattttctaattgcaatggttatatttctgtgtaaatgcctatacaaatgtttgcttggtgacatatggaaaacttaaggacttttatgaaaaggcgacaatggggacctccaaagcgccaaagtttctgctaggcatagtgttatttttagattacattaaaatggctatttagacccatctagctgagactattccaaaacaaactttttatcatattgttatcataatcaactttctacaggctaatgactttatagttttacttctagtgtatatctactagcacaattagaccaagttcctagatgtatcatgttaagaggtaaaaagcctcatgaaattataataacgactgttatatagagatatgtattttatctctatacacatttgcccacccaaaacaaaagcaaaaatgtggtcacaaggccataatctcatggactgagattttgacattaggggcaggcagtcatgggactttcttggaattgctttctactagcttgccttgaattctgaaaatctcaaacaacgaagaaagccaaacttaattatggccagattaaacagtggttaaaaaattaacagaagcagactatgtagcagctacagaccagttggtgctgccatttgggaagctgcagatggctgtgggtgggaaatgcctttactttcttaagcgatggagatgagtatggtgtgtgcacttgatgtttttttcatacccccaccccccaacagggctgtctgtcataggctgcccggccccgctttatcacttgcccccgagcgtgggaatcggagcgtcctgccgttcacatctcctgcattccgtttagcggaatcaattaggcaagacagaccctcagattccccaccccctttccatttttgtcaggtctatatacgtcctaattatttcagtttgggatgccagagctgtttcctggatagacctgatcatccttaaacaaaaagagaggaggcgcacacgtgggttgtggcgtaaatgtcactttcatttccaatgctaggcgcagagtaagacagaacatttttttaacactttgacaagaggggaggcgatctcgtctccatcatgtctttctgcttcagtagcttcctcaaggaaaccctcttggaacagagaagcatctgtccttgtattttgaatagaagaataaaaatcagcccttgcttttttttttttttttttcattttgcctgctagctctaagtcctcagtagatacaaattattaaccttccagtataaacttttctgaaagtctaatttcgtacaaattgacatacagcccaaatacatgtaaagtaatttccaagcacaatcttcaaattttgagagggaggtgcctcccaaaggaactgcccaagtctacatattatggaatcatttttaaactaggtaccagacatctctgcaacacctttctaagaaaaaaatccctgatataacttttgccttaaaatagaacaaactgcacatgcatctttactcattatcactatacacttctcctttgcagctgcaacaacccctctcaagacatatctggaaccttgatattttagcatgtgtgtgtcatttaattttctctcatcccacctttaatcataaggaaaaaaacaaaacaaaaacaaagttagattcaataagtattcctgacctttctggtttttactgtctctcggctgtagtctttcattctcacacgctccccggcgatcttgaaggagtttttactttcggttatctagctttatgaagaccaatacactcatacagctagataaccaaagataacaactcgcttcccacacaggcctctgtcttcctcttgccagactccaggtcctgatcctttctggcagtaccgaagagtggtcgtccaggatacttgccgcgcttaagattcctccttttatgtaaatatgacctggtttctgtttgtgtgtgtgcgcggctaaaacatccaaacgagatctgttgccttcagagtttattccgaacttttctttttcctttcagcaagtaatctccggcagcgttagccaacaattcatctattaatatcagaaaataaaaccagctattaaggtgcagcaagctgttacgagtgagcagcagcatccgtcccttcacaggcctctatttgcattgtaaattgcttctttctcacgcaagactctttagcctctctctatagagatgtataaagccaacggcaatttccagcgcaggttaaggaggaaggaaaaaaaaatcccattctatagaagtgacagctgattcaaggatctgttcctgatcctttttggttaggcaccatggctttttaccaagcggtggcagcttgattgcacatatcttgtgtgtatgtgttttagggggaagatcctcgatttcacagggcttctaggctgggaaggagaagatgccgtcttgctggcctgctgctgcccccggtctgaaagaaggagaaaagggccatcattggaggggctttcactgccaaattgtggaccagcccggcaaggtcaaaggttcgagaccgcgggagaccaaggtaatgatgatgtcatgagaaatctcaagtacatggttattgatatgcatcagtgatcagccaactgccccacgcctgctgcccgagcagcggcagcgacagcagcagtagcggcagcattgcaacaatccctattttctcaatcaacatctcttccgctagcactaccgactgctcctggaaaagcaacccgcggccttttacctcctccgtgctagtgtagatcgttctagtatccaaagactggaagaaatctctctctaaggacagataaaagcatttcagatctggggaacgtctttgcctgcatttttcttctggcagattgcataggcagacagatggaaggcactttgctattgcttaaagcagggcctcgttttctggggctgggaatcagatctgtattacgcagtgagtcgatgtgtgattacattgacaatttgctctggtggtgtgtttttaatggcttcacagctcagtcatgttttgtatctatgtaccatggcgatagggcagcatattttgttctgtaagttcgaactgaatgctctaagcaagcggacttcatcgtggtttttaaaaaatgactacatatgtagggtgtgtgcgttagaatgcagcacaggtaaaccttgcagcaatagtttctaatgctgtacacaactctgctgtaatgaaaatcctgagcctttgtctattgttttaaacatcaattttcatacaaaaggataatgtaatagtcttgcttctgaaactatgaaaaaaaacgttgttacctcgtgaagaacacatataaaacacctggatgttaagagcataactctgccctaccttccccttctccaacccccacctttcttctatctagaggggaatgttgttttattaattaattagcctcattccttttcttagaacttttcaaagtgtgaatatgatcacttcaaagagtccttttcttcttctctctccttagtaatgagtaatctatgtctaactcatctataatacatgcagttgtaatattcaaatgtccctcaacagaacatctaagatagtctacattaaattcatatttaccaagggtgaaccttatgaactgcttttcaaaatttcaagttatgtttggtcatattgctattctttaaaatatatgctattagagtaatcttaatattcattgcacacatgactactttatcacaatactctcaattctatagattattttccccaacaactaaaacacttttggaattaacatacactctttcattaattcagtgacttattcatttatgacatgaatgtgaacatgcttactgaattatatacagagcacatatatgtaaaccctataaaaaagactagcaagaaaatcagaatagttaggaaaagcttataatcaagagtttaaactacaatattacaccaattaaagatatgatttagtaacatagatgccaacttttccctagattttttatttatttactttttttggtgaacattccagtactgattatttagaaaagactaagctgttgaaattgttcatctatttttcttaccaaattatggtacaagaggtacaatcagaaatggctgcattgggttatacataaaatgcacaagcaaaccaaaaactaactcagagaaacacacctccatgaagttactgttccttctcgaactagctggtcacaacatacactactaaataaaaatgtaacacatcactgaggcacattccaccttagacattacataaaacactaatgagctctgccgccttggaagagtgagagtattgtggccttgctttccaagacacagatgcagaatcattagtgatttggcatgtattacataaagcaagcatgtggtcagatgacaggtatttttagaatatctttttgctttatatatacttgggtgggggctggtggaagcaaagagatgtcatgcatttgtctgtgcatgtttatcacccccatatctgtgtgaatttgcaaagtaacatggctatatttccacacttagcaactaaatgcatttttagaaccaaagtatccatcatgaaagccaagacactgaacatttgagatgcttttacaattaaaagctatagaagatactgtcttaaaacagcatcttctagggcaatgccacatagtcatatcaactggactccgggcctggtccccatgtctggcatatataacatagactcatcatgggagtcccaataagtgaaaggaaccaacattaggattatgagcagtctgttcattagccagatagccaactaaatattttactctccaccatctctcaggatatgcagaaataaaaactacacagtaaggcttaacacagagcatctgattattttgaatattgccaaggtttatatgatggtttatacatatttcaaagactgtattattatataggatgtgagacaagttgaaacaattgtgtagccctaaagattcctagcaatgtctgtcacatattaagagcaactattaacacctacatgttatatcagatatttttgctttcaaatagctattaagctgagcagaataccagttttgaaatctgcattctgaaggatatactgaatttaaatggtttgcctgctcattcactaataaattcccattaatggccagtagattaggacgtgattgtcatgcttgttttctaatctttttatagatctccagatggctgaaacatgaattgaaacattctggtttacctgggagtagacaatctctatttcagttaaaagtgaaaagttacgttttccacattatttggatcagaattatgctatttcataaattcaaatacattaggtttgtcaccatatttagaacacctctgaatcctattcagattactgcaaagcacatgaagaactggcctatcactgaaatccccttttaatatttggtttgtatgattcaaatgcatgtaaaccacagtgcactagtacagtcaagactaccattttctacataaaagccatttaatttacagtgatttgtatagttcaggcaaggtacctgactggcttactttctaacaaaagtattctattatttactctgtatcttgaatttcttttttataggcagttacaggttatatttgtattatgcttgatatataatatacaaaggctccctgtagaggagaaggctgcacatatagaaacttagagcatgaattaggagatatgcaacccactgcatgcctaccgcctagtaaataatactctattttgtacatcacttggattttatcaaatgtaaattttaaaattacctttggttggttggattgtctattcattttatgcttctttgcagtctcatctgaaaaatagtcaagaaaacaaatgatcacagtttatatatatgtatacatatgaagtcatatagatattgcttcatttaaaatattgctattaacatgattccttaaaatgccagagattccataaaaccccagtacaatgtatcctaggtctcagcacccacggggttaaatatgctaatttgcattcaaatggagacatgcatgataatgtgaatgcaaaatatgcagaatctggaggggtttgagaaattaatttttctttcttcttttcttttatttttagcttggaaggaagagggactcttaaaaaaacattagggacttgaaccttgtaacctgccatacaaaagaggagagtccttccatgtaaggattttaagtctggaacaaagtcttattttctaaatgtttaaggaactgaatttccaggcctttcgaacaatggcaatccctggataaatatctactccattagaaagatgcaaatagtttactgtaaggccacagcaccgtgagatgtgcattcatatctatggctcctgattggctctttcctccagtaaatcaatgaataatgtaaaacctgattgctgtaaagtggtggatttttgaaaatttcccttcccccattccctctcgatccaacattcaggaattcaatactccccaaaataggttgtttttcttttatgattttttaatgcttattgttattttggactggaggggtggggctattggttttgcaaaatgaaagtattgccctggtttaattatgctgactgtgggagctcgcttcctgagacagcgccctaattaccggtgccaaggtggagaaaggagggtggtagacagaggtggacaccaagaaagggaggaaacggaacccgactctgcggtgctgggcccaaggcagccacagctccaaaggggcccccggccgtggccgtgacttgacagagcctccggtctaacttctgatcaattccactgctctcctgacccctcaagacagtcccccattcaagcaccgcgggtacatttgcaagataaaacgccgcagacactaatgcaaatacattgcccgagttcccatcaccctgggttcctgcagataattccaggccacagaaaggagttcttgccttcctcagccgggtctagactctaagcaaaccgcaaagacctagctccgtttggataccagaagcgtcttaagctgaaccgctccaagtaccaataactaaccatgatggttgcatcttgatgaatctgaacttgggataaccctgtaaagcggcctctcacctcccaaaattcaaaaggcaaagagaaaagggaagtggaaagccaccagatctacttagctactgtactaagttttccaccaaaatctaatcagaccctcgcttccttgccaggtaattgcaactttggggcggttaaagggaggcgaattcttcaaaatgcgaattcgaatacagaagtgcaaaatacaagtgcattttgctctaggtttaaaagggaaaagcccccccaaacacaccaccaccaccaccaccacaaaattacatacaaaaattcccttttccaacgcgaagatttcctggcatctctctgcgattgggggtcaagccgctggataattaacagtactggctaagaaaactcacgagatcaacaggtttaacatccgaggcacacaatcaattagctgaagcaaagccccggactggccctcggagcggcccgcagcgggactctgcgggcaccggctagcgggcgaggtgaggagtgcgggcgcggggccgcggcgggcactgctggcctcgcgccgcgggcgagctgcagcctgagggccgccacgatactcacttgatctccctgcgccaggcaatgctgccccccaaatccagctgggcaggaaccgaggcgccggctgaaagacaagatccaaagtcacagcacggccgcagcacacaaacaggcttctttcggcgtctccaaaaaaaaaaaaaaaaatgtttttctcatcattcctctcccctgctcaacacatttaaaactgccgctcaattccacatggtgattcttggttgattgcgtctaaaatagtttaaatgggtcttcccttctggggagagggagaagggcgcaaaagaccaaggagtaaaaaaaaagccaacttttaccccccatgccaggcacttgctccctgagcctcggagtggagagtgaagtggtgtgtgcgaggcttggcaagtttttgggggggctgtccaaggtctagtccagccccctctgccgaggaggacgtgctctgaaactcaaccaatttccccactgcttttgttactgatgaactgaagccctattgttcatccattgccacggtctttttcagtccccacactacgttctgcgttgccagagataatgaatttgcacccaaacctctcatagtcccctcctgacagacggaacaaattagaaatgtctcgtctgaaggaaggcaatggctacattttcctattgtaggatgcaaagcacacatttctttggaaacttcttttgcttttttcttttttttaaaatccttttcttctctttttcttttttcctccagtttttttttctctctcttggtttcttaagattcttcttttttttttattacagaatctccctgtcgtttttccaatgcactgttttatgtaacttgtgagtcttcctaaccttcttccccttctttcctctcctttcttaaggactccctttgcaattttatttacaaacttggagaatgaccttttgactcgcagacttttttttttttaaaggtcttttggttcaagtcccccttcttcactcctccccgtttgtgtcgtggttgttaaatgtgtttagctaaagacaagcaatgcattctaaagaattttattctctaaactctagaggtattctaaatgtaccagggacgcgccataggggtcatctatttgaggaggaagaaaaagcgggtgtgtgtgtgtgtgtgtgtgtgtgtgtgtgtgcgcgcgcgcgcgcgcgtctgccttccacggaaagagagacggagagatgtgggagggtgggggtggaagtatgcagacagagaagggtgggggcttcgaggggaaggtgggcttcctgcaacacaagcggagaggctgtcaggggtgtgggcacgggggtgcggggaggcggtgcaggaatccgtcccgccgagtgccgtcggcccctgtgggcctgtttgcgcgcctggggctggccgcattctgggcgcgggtgtctgcgtgccggggtggtagttccgagcctgcgcgcgtgcgaccgggtacgggagggggaagagtgccgtaaaaattcagacgagtggcccgtatgtaaatgcagcccgcggggagcagggaggcggtaatgacagccgctggcgctcagccccgccggcggcccctagctttcccgccaagtgcagccggaggacagacagccatgcgtgtccttggcgggagagcccccacccgccgcgcgcgcccgacccccgcgcacacgcacacactcccctcgcaggcgtggggcccaatggccacgaacatgtcaggaaaacaaagctggggctgcgaggtggaacgatgaaacggcacacttggcggccgagggcagagcggagaagtcgccaccacagccaccggcgcccctttcttgcctgctcgtagatctgccctccggcccagaagaggccgaggaccatttcttagctgccccagaggagggggcgagcagaggagggggcggatgtgcacagggaggtgccagcggtccggtgcgcgggcacgcacacgccggcgcgcagggctgccgcgggcggaaggaggggaatgacaaggcctcggccgcgtctcggagaggcactacctccgcgctgaggccgctgagtttcaagtgcaaaacaccaggccaaatccggcaaggcggcggctacagaatggctcacacttcaagcctccttcctcaaacaatccgatgggaaggacctggctgttcaggggaagcctttgctggcctctctttttacatggggtgaagtcgaaccccaatctaggagccctggcctagatggctccgcagatgagtcccagacgtggccatggaaagactgatctctctctgctcagagcgcctgcctcggtgctcactagcgcaagcacctcccaacacacatacatacatacacacacacacacaacacagcactcccatcacattaaaacgcgcgctcatgatcctgccgttaatgaagccgaggcgcataatgagtgcacaggtaaataggtaccgaaaccagaagacttcaccagtcggctgggcgatttacctctccctacagggagcacttgtagttatcgtgttttaggagtgatttgctgttgtctgtggtctctcgctcctcttcttgtggagagaagccaaaaaatatatatgttccgtggtcagagtcttctttctgataagctacccgagcattggtctaaaacatctgttttatctgttgattttggtttgttgttttggggagtgttgcttttctgagggaagcaaaagaacgtgtgtgtggtggggctggaagctcagggcaagagtctgcgtgtgcggccggaaggctggcgagtctgagagccgcgcggtgcagaaagaaggcggcggcttgtcctcccccggggccggcactggtcccttggcaccccggcctgggctcggctactgccgccgccgcccgcgctctcgggctccgccggctgccgctccgtgttttcccccatcccggcttcacgttcaaggtttagctgcgaggtcacgtccattgacgtcagctccctgtctccctctacgtccggctacatttacatacatcaaggaaattagggcattaaaaaaatatgcaaatcctgcgcgaagaggagcgggtgcattcctggcgcgatcgccttttattgaagcttttaattaaaggggccagttggcgagcccctgaaacaaccgccaaaaccccccaaaagagaaaaataaacgctgtagccttcgagaacggttgtttcggctcctgttctgtgggcggctgaggaccgccggctgcccggctcggagaagaacaggttagaggaggcagctccagcccatgcataatcagggctccgcggcgcctccattctttcctcctcctcctcctcctcctcctcctcctcctcctcctcctcctcctcctcctcctcctcctcctcttccacctctcctcctcctcctccttctcctccacctcctcctcctcttcttgctctcgctcctgttggttccagcgtgtattatttttaatactgatgcatatgtaaaggtatatttgcattttttaatttgcgagaatttcagattttgtcattttattggttccctttccctctttttttttttggaggatttttattgttgttattttattatgtctatgtgtctctcttgtccctttctgtcttttttggcgagtgtctgctgctgtctcttgctagataatatacacagttacctccctgcttctgtttatttaaggttacaaatatgcacatctgtcatgtatgcaatgccagctgtataacctcctggtttggtcataaaggaaaatacacatttttttttctttcttgacataccttgatgggctgtagtgcccatcgctcaaggctcaaagtttgattgtctaattaacttcatattagcagaaacacagttcggggccagtgctttcgagataatgtatgtataagtgaagtgattccaaagatttctaaataatttttgtgctgattgcctgagaggtgcggcattccccgccctattgctttctagcatttcttattgaaaaaaatatatatattttaaaatgggtagacacagcaatggacagccttctgcaaggaagacattttcaaccatgttgtatgttgtaccttattggctgcattcaaaatttactgagtttcatttttatcttaatatggctggaaacaaggcacattatcttgactgaaaagcatccttgattcctgactttgaaatgaaagcaaatacacaaataaaacaattggctatattaaaccagttgatgtggcttaaaatatacaggccttgagttagatttcaagcaatggtaatcttgtttataggatcggattctctttcttggcaatatagctatgcagcacgatggcttttttccaccttttaattcccccaagctatcatttaaaaaagactcaatctataattgcaaaccctgaaagaacagcaagtatgcacacatgcagcttattcaattaaacaagtccaagtacatgcacaggtaattagttttcttatgaatgacttacctgcacagatactcaggccaagactcagccctccccaatggccttcatgtataaatattcacatgtatttccccctatttcaaacctaaagcggtatgccatctttcatgctggactatccagcatccattttcagcacccttaactcttatggaatttccagccttacctctggctgtagtttttccaagcctacaccaaagtgctcatatgatatgtcacccaataaaaagtggtcagatggctacacgtatgacattaaaaagcagaaacacattcatccttcaggttcgcctttaccttgccatatatagcaagattacgtttcctaaaatacattttcagcacattttatgaataattgcaggattccacaactgattgcagaatagccggtttctggggggcacctggctgagtgaaacaattcggcaggctcaaggtctctttgagtttggctgcagttaaattgcgcgtggctgtttgttcctgcctggactctcccacatacctgcctactttatgtaggatcaggacaaacacaccggccacgttgcagggcatagagtgtcggtgcatatatttagatggcagtagcaaggaacgcgtgcgtgtacggctgagcatgcatgtgtgtacagatgcgtgtgtatgtgcgcgcgcgcgctatgtgacaaggaacacagagaggtacacctcttatctctgatctctctgtaatctccttttctgtttctaatctcccttattggcgcatggtagtaacccaaagcgtgtgaaccgtcaccgtcgctgccgtgtgcgcgctgtggcttaccccgagggccggtggctcggtgactcgctggctaggtgggtgttggggaagagggtgggtagcgtcgctgccgctgccgccgcgggtccgggtgctctgtcccagcccggcagccgagcgcgcagtgtcggagccccctcccaccccgccctcacccccatcctcccctcccctcccttctgcgcctcccccaaccccccgccccgcattaccatatggaggccgagtccctgcgaatcacagcagcagcgggaggtatttgaataagccccgcaaccccgcgcagaccccaactcctccgagagcagcatgccctgcaccaagagccaccactctggccggtaacctggcagcgacagacaactccccaaagtgccctgcgcgcggtggagagagggtctgctgagggtactgggtctcccacttgctacttttatattaacttgacatagaatcagacaataaatgagaggagagagaagagaagaggaaagaagagacagaaaaagggagaggcgctgtaaaggggagagagaaaacagaagcgagaatgggagagaaaaaggagaaagagaacccaaagggttgagttaaagagagagtaaaatggggaccgggtggggaaacggtgggagggggagaaatacccaaatatctgaatttggacttctcaagctaaaaataccacctcactgaacttcacaacctccaatgagacacgtgtttctcccctcaccaccacgtcaccgaatgattaatttgccgtctcaatcagaaataattatttagaattgtataacagatataggacttagcagaaagaagctcattttatgaaacatagcgaaaaatatatgacatttaaagatgatgttggctacctcacggtaaaaattaaggcttgccttaacgactcggcagttgtccaaccatgtcctctgaaatggtgagatggcggcccagggccagcaacaagaggtgttccgaaatattttggactttaagtgaaaattttttttcttcctgtctcaaattttattgttacgtttttcttcttcacgaatttattccttttacctaaattttacagataatatgtgaatcttttaaaaaattttactgcaaaatgtcacattttgactgaagatatgattttagacgttaatttaaacacatagccagttccattttgcaaactaactctgaatagcacctgattctgaatttagccaattcaactcactctccctctccctatcctcaaatcagagcagtgatttccctgtacaaaacaatcagaatcatactaaaatctccagtcacctagaggatgtacccattgtaaatgtccctttaggtattcataagccaaacgcccttcttttgaaacacatacaaaaagaacgcctctgattaataatctctttcgcggcacactgaggccgaaggcagggagccgcaggacgccagagaagggcgcagaattctcaatacctagcatttcaatgcagattccaaagattcgctaactgctaggttttccaagaggaaataatatttggcaagcaacgcttttgggaaagacaaccacattccaaatactggctccttcctgggcctggggaggggactgcgatcgcggttacccggcacttctgtgttcatgtgtgtacaaggtggtatgtagcccacgcatgtagccaggcctaggtttctttcttttctttttcttcttctttttcttttttctttttcttttttttttttttttttttttttgaggcaagaatattgaaaccaatccactctttctgtagctagctcccacgaagctgggattttcaacctcttgtttattcgtaaagcccatatggaaccccggttgaatctcccctcttcggattttaccaggaggccctcagtgccccaccgccgcccatggcacgtgaagagaaaggagggagagttgggagccacgagagaagccggctcggagccgcttccgtcggggcccatgtttcgccccaacagacccgtctctcctttctctccccgaaggtacttccttaggccggcagtgtcgctacggtggtagccaggtgagcacgggcacagtcccggggcgggggcgggtagagcggccctctctcgggagctccggtgggtctgcgaacctgccgggagcggaaggctgagtggcgctgggggcccgcgcggggctcctggctcccgccggcaggggaacagcgacacctactggccgcatgggtaccgcgcccgggccgtcagggctgccctgggacggggtgccgggctccgtggacttgggaggccgcgggaaacttcaccgaaggctctgcggactgctctaggactcgtccgccctggagaagacaaagccacgctttctggagacccctgggaggactgtaggatggaactgaacacacaggcacacacgcatgcccattttttctggggaaccggataaaccctcagatgcagttgcccaccgtcccttggttttatgagagagacccaagcagaggtcggagccttgacctcctcaggttcatgacccaggcctcttcaccgcctttcccagttcagcactgactaaagaagatatctttacaaattaggaaaagaaaagagttcattatcctccctgaagcggggaaatgagtgagtcaaagacacagactcacaggcagcggttggcgccgggcacacgaaccggccgagccctcctgctagccagcttcgggcacctttagtgcgccctgagactgccgccagggagtgaaatttggtagctcttctttaagaattacaatcttcttaattactcctgaaataaaggcaaatttgggctactggtgatatttttgagaactacaggtatatatgcatatataaatatatatatttaaagcatatataccaaagcaaatatatacataaagtatatgcatatgtgtgtgtacatatatactcacacacatacacatgtgtgcatacatttacatatatatcttctgcgacatggcttcggttgttggcttatgttggggaaggtaagaggttgtgaaggcatggcaggtctgatgaaagctcagcaaggttggggatggcaaaaaagcaattcatgtattccagattcactttctcttatctagtcttttctgtaatagcatatagccatttcatatgggaaggagatgtgatgttggtcccagcagcgggtagaggaggggggaacctcagcttccattatgccccaagatgccttctttttccccttttcaggttctgaggctcacttgggcctaagaaacctggctgagtgtgattcttatactaacctgctcaaaagtaaaacatattccctttcctcgaaacactggggtatcggagctaatttcattccttaagatttctatgtaaaatattgcttattaacaaacctcagaactaaaggcagtttttttccattcaaatttcaagagttcattttggaaattatttttcttagctttacataccggttagaactagggtctaaaagattttgcctggaaggtgggagagcttattaggactaaatttttgtcttcgttctctacagtcacaaaagtttgctaattctgttttatttaaatacaattggaagcttttagtgtctctaaagccaggagttttaggtcaggtccccctctctctccctcttaaaaagaaatcactaaaaggcccaggaaacctgtatttcaactctgttctgcaagtattttttttctttttaaattttcttacaagtggatttgactgtgtcctgataatacaggaattcacatcgaagaagagactcttagcagtttgtatgatatacaaataaacctatattattaataataaaattgggctttatcctactggcattttttcttggcaaatcctgtttcccactgcatttcaaagtcagctttctccttataaaaatggaaacattcatagcacaggaaaatatttattaaaaaattacactgggcacacaacaagcacccatcaacaaaacccagttcagaggtgtctttgggtatttaaagcaccttgataaatgcaggggttgatttttttttcctttccttttggctttttaggatgtagctttatttgtgactccaaaatcttagctagaaaggactctcattgtttgatattctttggttttactaactaaaaaatgttgatttgacattaaagaagatagaaaaatagaatttctgtttcaaaaattgtggaatttctcttcatgctagtcatccccaaagcattagtgtattaaactctagtagaaggaatgtttactgttcagtacagaaaattaggccagcaaaataattttttatttcacattaaatgtgaataagcatattcataaaggtaatttgtatatgggtgttatcgtgatgactgtgtgaagtaagggaggagacaaggcttacaaggctttctgtttaggtctccctcaatatatttttcttttcattcctcttatttaacaagaaagtcaaggaatagaagacaggctaaattgtcattagactgtgtctgtgttctttgtcacgcctgcctttcctctggactgcctgggaggatgtgtgtgctcctttcttgcttcttgagtagcagggaggaaggaatggatgcaaggatgtgaagattgatcagaaaggcacattattgcacgtgaaaatgagatggatacatttgacacctggctaaatttcagccaggtggttgtcttgcgagaggggcttgtgtgtggaagctagcaggccgactgaaaaaagtggggggagacaagaggcttccttcatctggaaatccgcaggatcttactgacatttggcttcagggagtagagctccaaggacacctgtgtgcatctgcctggagataggtgtgtgtgtgttgtgtgtgtgtgtgtgtgtgtgtgtgtagggagaagtaggcatttcatcaaaaatacatttgaaaaatgttggttctaaaattcagtcgttatcaattcgggccaggtaccaaagtcactaacgtgtccaggttaactcctggaaggcagcaacattcttgcttttgatggtacgaatatggcttctttcatttctttggctctttatggtacttcttttgagtggggcgaggctctagctttcccctcctcctttcttgatctcggcaaacaaaaccattctaccacttgagccatctgccgcaggtgtaatggatggcagggggccgacctaaccacactccagtctcttctaggtcgtcaccgctctgcaccaaacaaatgagtcctgtttcaccactagggtgccgaggtggatggtggatgctggcccccgcccctggcagcgctcagcccttagaaaccagagccagctgacaacacgcgaaacacacaggcacagcgaaaacgccgagccgacgctcattccctctgccccctccctctgctctctgtaacaaggaggacacgtacacagcctttacacacttaaaagcccttgcgactccctctgaattcttagttacttatgacggccttcctcactgcacatagcccctggggtgtgtgtgtgtgtgtgtgtgtgtgtgtgtgtgtatgcgcgcgtgtgtgtgtgtacgcgcgcgcgcgcacgcgtgaatgtgcatgtgtgtttaaaacgcttattggtaggtcatcagcagctgatcagacatggtaatccaataatttttttgaatacacacaatttttcgttgaagttaatttttttaaagaaaaatggaaaactattaattttctgcgcaagtctagggttcccagtttaggttccagagaacagcagatctgcgcagcccccgccttaccaaactttccttttctagggtttgaaagaggctcacattctcacttcatgacagagcagcggctcatttgcacgcgggtgtgtaaaggagggagctgtcgaacgcgcgacttaggaagggaaatcggatagctggagccccacgcagtcgctcggaaccttggctggaggcacaaggtgcccaggggcaagagcccggggtccaagcttccaggcgcacatcatcctctgggccccgggccctccggctggagcactccctcacccgcatcccatccccgttccattttgatcattatttgaatagcccaggtaagggtgcccatctctcggctatgggcgggggctggaccctgacaggtacggactccgcgggaccccagtgtgcttacctcgagcgaggccctggcaaatggtggcccagaagcatcaagtttcctctcccagccgttgtgccagatttcccctcctgccttctgctcctctccgccagctc

SEQ ID NO: 331 - DNA, 13202 bp, Homo sapiens
catatgtgcattttaacagggccttcaacgcctccctcctggtaaagaagtgactcaaaaggtcaaattcccaggccttgacaggctatggagcgtttgacattttcataccaggagggcccttccacagaatgacctgggtgtgttaatgagggcaaggttaggagtggaaggagggggatgaccttgtagacaaattcaaatgccaagactctactccccatgacccgtgaggctccttcaggaaagattctagcaggtttggccaaaactaactctagggcaacttccaccttctatttaccagttatggggtccaacttccacttgaagttatggaggactttgaaaagctagtccctgcatgggtaagaagagggagtactaggggctcctcttttatatgaggtgagttcacagccctgactaataaaatttagcaagctcttttcctagtgagaacatcacagaactattattattattattattattattattattattatcattatactttaagttctgggatacatgtgcgtaacgtgaaggtttgttacataggtatacatgtgtcatggtggttttctgcacccatcaacccatcatctacattaggtatttctcctaatgctatccctcccctagacccccatcccctgacaggccccagcttgtgatgtttcccttcctgtgtccatgtgttctcattgttcaactcccacttatgagtgagaacatgtgtttggttttctgttcctgtgttaatttgctgagaatgatgatttccagcttcatctatgtccctgcaaaggacatgaactcatccttttttatggctgcatagtattctatggtgtatatgtgcaacattttctttatccagtctatcattgatgggcatttgggttggttccaagtctttgctattgtgaatagtgctgcagtaaacatatgtgtacatgtgtctttatagtagaaagatttataatcctttgggtatacatccagtaatgggattgctggatcaaatggtatttctggctctagatccttgaggaatcaccactctgtcttccaaaatggttgaactaatttacactcccatcaatagtgtaaaagcattcctatttctccacatcctctccagcatttattgtttcctgactttttaatgatcgtcattctaactggcatgagatggtatctcattgtggttttgatttgcaattatctaatgaccagtgatgatgagccttttttcatttgtttgttggctgcataaatgtcttcttttgagaagtgtctattcatatccttcacctactttttgatggcgttgtttatttttttcttctaaatttgtttaagttccttgtagattctagatattagccctttgtcagatgggtagattgcaaaaattttctcccattctgtaggttgcctgttcactatgatgatagtttcttttgctgtgcagaagctctttagtttaatcagatcccatttgtctattttgccttttgttgccattgcttttggtgttttagtcatgaagtctttgcccatgcctatgtcctgaatggtactgcctaggttttcttctagggtttttatggttttaggtctaacgtttaagtctttaatccatcttgaattaatttttgtataagttgtaaggaagggatccagtttcagctttctacataagactagccagttttcccatcaccatttattaaacagggaatcctttccccattgcttgtttttgtcaggtttgtcaaagatcagatggttgtagatgtgtggtgttttttctgaggcctctgttctgttccattggtctataagtctgttttggtaccagtaccatgcagttttggttactgtagccttgtagtatagtttgaagtcaggtagtgtgatgcctccagctttgttctttttgcttaggattgacttgacaatacgggctcttttttggttccatatgaattttaaagtagttttttccaattttgtgaagaaagtcattggtagcttgatggggatagcattgaatctataaattaccttggggagtacggccattttcacaatattgattcttcctatccatgagcatggaatatttttccatttgtttgtgtcctcttttatttcgttgagcagtggtttgtagttctccttgaagaggtccttcacatcccttgtaagttggtttcctaggtattttattctctttgtagcaattgtgaatgggagttcacccatgatttggctctctgtctgttattggtatataggaatgcttgtgatttttccacattgattttgtatcttgagactttgctgaagttgcttatcagcttaaggagattttgggctgagacaatggggttttctaaatatacaatcatgtcatctgcaaatagggacattttgacttcctcttttcctaagtgaataccctttatttctttctcttgcctgattgacctggccagaacttccaacactatgttgaataggagtggtgagagacggcatccctgtcttgtgccagttttcaaaaggaatgcttcccgtttttgcccattcagtatgatattggctgtgggtttgtcataaatagctctcattattttgagatacattccatcaatacatagtttattgagagtttttagcatgaagggctgttgaattttgtcaaaggccttttctgcatctattgagataatcatgtggtttttgtcgatggttctgtttatgtgatggattacgtttattgatttgcatatgttgaaccagccttgcatcccagggatgaagctgacttgatcgtggtggataagctttttgatttgctgctggactcggtttgccagtattttattgaggactttcacatcgatgttcatcagggatattggtctaaaaattctctttttttgttttgtctctgtcaggctttggtatcaggatgatgttggcctcataaaatgagttggggaggattccctctttttctattgactggaatagtttcagaaggaatggtaccagctcctctttgtacctctggtagaatttggctgtgaatccgtatggtcctggactttttttcttggtaggctattaattactgcctcaatttcagagcctgttatcagtctattcagattcaatttcttcctggtttagtcttgacagggtgtatgtgtccaggaatttatccattttttctagatcttctagtttatttgcgcagaggtgtttatggtattctctgatggtagtttgtatttctgtgggatcagtggtgatattccctttatcattttttattgcgtctatttgattcttctctcttttcttctttgttactcttgctagcagtctatcaattttgttgatcttttcaaaaaaccagctcctggattcattgattatttgaagggttttttgtgtctctatctccttcagttctgctctaatcttagttatttcttgtcttctgctagttttgaatttgtttgctcttgcttgtctagttcttttcattgtgatgttagggtgttgattttagatctttcttgccttctcttgtgggcatttagtgctataaattttccctctacacactgctttaagtgtgtcccagagattcaggcaccttgtgtctttgttttcattggtttcaaagaacatctttatttctgccttcatttcgttatgtacccagtagtcattcaggagcaggatgttcagtttccatgtagttgtgcagttttgagtgagtttcttaatcctgaattctaatttgattgcactgtggtctgagagacagtttgttataatttctgctcttttacatttgctgaggagtgctttccttccaactatgtggtcagttttggaataagtgcgatgtggtgctaagaagaatgtctattctgttgatttggggtggagagttctgtagatgtctattaggtctgcttggtgcagagctgagttcaagtcctggatatccttgttaaacttctgtctccttgatctgtctaatattgacagtggggtgttaaagtctcccattattattgtgtaggagtctaagtctctttgtaggtctctaaggccttgctttttgaatctgggtgctcctgtatttggtgcatctatatttaggatagttagctcttcctgttgaattgatccctttaccattatgtaatggccttctttgtctcttttgatctttgttgatttgaagtctgttttatcagagactagaattgcaacccctccattttttgctttccatttgcttggtacatcttcctccatccctttattttgagcctatgtgtgtctctgcacgtgagatgggtctactgaatacagcatagtgatggatcttgactcttcatccaatttgccagtctgtgtcttttaattggggtatttagcccatttacgtttaaggttaatattgctatgtgtgaatttgatcccgtcattatgatgttagctggttattttgcccattagctgatgcagtttcttcctagcatcgatggtctttacaatttggcatgtttttgcagtggctggtaccggttgttcctttttatgtttagtgcttccttcaggcactgttgtaaggcaggcctggtggtgacaaaaatctctcaccatttgcttgtctgtaaaggattttatttctccttcacttatgaagcttagtttggctggatatgaaattctgggttgaaaatccttttctttaagaatgctgaatattggcccttactctcttctggcttgtagagtttctgctgagagatccactgttagtctgatgggcttcctttgtgggtaacctgaactttctgactgcccttaacattttttccttcatttcaaccttggtaaatctgacaattatgtgtcttgggcttgctcttctcaaggagtatctttgtggtgttctctgtattttgtgaatttgaatgttggcctgccttgctcggttggggaagttctcctggataatatcctgcagaatattttccaacttggttccattctccccatcactttcaggtacaccaatcaaacatagttttggtcttttcacatagtcccatatgtcttggaggctttgttcatttctttttactcttttctctaaacttctcttctcactttatttcattaatttgatcttcaaccactgataccctttcttccactagattgaatcggctactgaagcttgtgaattcttcacgtagttcttgtgccttggttttcagctccatcaggtcatttaaggtcttctcttcactgtttattctagttcgccattcgtctaatcttttttcaaggtttttagcttccttgcaatgggttcaaacatcctcctttagcttggagaagtttgttattaccgaccttctgaagcctacttctgtcagctcgtcaaagtcattctccatcccgctttgttccattgctggcaaggagttgcgatcctttggaggagaagaggtgctccagtttttagaattttcagcttttctgctctggtttctccccacctttgtggttttatctacctttggtctttgttggtggtgacctacagatggggttttggtgtggatgtcctttttgttgatgttgatgctattcctttctgtttgttagttttccgtctcacagtcaggtctctcagctgcaggtctgttggagtttgctggaggtccactccagaccctgtttgcctgggtatcaccagcggaggctgtagaacagcaaatattgctgctagatccttcctctggaagcttcgtcccaaaggggcgcccgcctgtatgaggtgtcagttggcccctactgggaggtgtctcccagtgaagctacatgggggtcagggacccacttgaggaggcagtctgtctgttctcagagctcaaacatcatgctgggagaaccagtactctcttcagagctgtcagacagggacgtttaagtctgcagaagtatctgctgccttttgttcagctatgccctgcccccagaggtggaatctacagaggcaacaggccttgctgagctgtggtggactccacccagttcgagcttccacggccactttgtttacctactcaagcctcagcaatggcggatgcccctccccctgccaggctgctgcctcacaggttgatctcagactgctgcactagcagtgagcaatgctccatgggcatgggacctgccgagccaggcgcatataatttcctggtgtgccatttcctaagaccattggaaaagcacagtatttgggcagaagtgtcctgattttccaggtacagtctgtcccggcttcccttggctaggaaagggaaaacccccaaccccttgcacttcctgggtgaggcgataccctgccctgtttcggcttgccctccatgggctgcacccactttccaaccagtcccaatgagatgaaccaggtacctcagttggaaatgcagaaatcacctgtcttctgcatcgatcatgctgggagctgcagactggagctgttcctattcggccatcttggaacagactcctaaactggttattctagttagcaattcctctaaccttttttagaggttcttggcttccttgcattgggttagaacatgctcctttagctcagaggagtttgttatcatccatcttctgaagcctacttctgtcaatttgtcaaactcattctctgcccagttttgttcccttgctggtgaggaactgtgatcctttggaggagaagaagcgttctggttttgggaattttcagcctttttgtgctggtttttcctcatcttcatggatttatctacttttggtctctgatgttggtgaccatcacatggggtttttgtgtggatgtgctttttgttgatgttgatgctattcctttctgtttgttagttttccttctaacagtcagccccctctgcttcaggtctgctggagtttgctggaggtccactccagaccctgttttcctgggtatcaccagtggaggctgcagaacagcaaagattgctgcctgttccttcctctggaagcttcatctcagaggggcaccagcctgatgccagccagagctctcccatatgaggtgtctgtcaacccctcctgggaggtgtctcccagtcaggagacatggcggtcagggacccacttgaggcagtctgtcctttagcagagcttgagcgctgtgctgggagatccactgctctcttcagagccggcaggcaggaatgtttaagtctgctgaagctgcacccacaaccgccccttctcccaggtgctctgtcccagggagatgggagttttatctataagtccctgactggggctgctgcctttctttcagagatgccctgcccagaaaggaggaatctagagaggcagtttggctacagtggctttgctgtgggctctgcccagtttgaactttctggtggctttgtttacactgtgaggggaaaactgcctacccaaacctccataatggcggacgtccctccccccaccaaactccaacaacccacgtcgacttcagactgctgtgctggcggcaggaatttcaagccagtggatcttagcttgctgggctccgtggaagtgggatccagtgagctagaccacttggctccctggcttcagccccctttccaggggagtggcagttgtctctcactggcattccaggtgccacaggggtataagaaaaaaactcctgcagctagcttggtgtctgcccaaatggccacccagttttgtgcttaaaacccagggtcctggttgtgtaggcacccaagggaatctcctggtctgcgggttgtggagaccatgggaaaagcgtagtatctgggccagaatgcactgttcctcacagcacagtccctcacagcttcccttggctaggggagagaattatctgaccccttgtgcttcctgggtgaggcaacaccccaccctgcttcagcttgccctctgtgctgcacccactgtctaaccagtcccaatgagatgagccaggtacctcagctggaaatgcagaaatcacccaccttctgtgttgatctcactgggagctgcagactggagctgttcctattcagccgtcttgctagccacccaacatcacagaatttctaataatctggatgtgggggtctacatgaaactcttccttttgtgtgtcttaaaccctttccaggaaattaagcccatagctgtcatcaattctgaaacggatttacaaaccaaaaacgtttaacaacaaatgactgtttgaaaagatattaaggagtagaaaagaaagaaaaatgcagatagctgggacttcctgtcctccccaaatttccttgcatcgatagcaacaagaaggggcttaacattagcctgctgagccaggaagctggaaaggggtcctcttcaccaaaggaccaccccaatctgatgctccaagattatgaatgcccaaatggtattcctggggccaccagtctcagtcacaaatcttccaggatcttgaggggagggagagaaggtggagtctacttttcagagcaaattctgagattgccactatgtctgcctcacagtttgtgcgagaacacatcatccatatgcctcaagaggattacatcagctggctgcagagccggatcaacatacccattgggccctacagcgccctgaggtaggctgggcctgggttgaccagctgtctcagtggaggagtgtttgcctatatcatgttcctgtatcctgcctgtgttcctgcctcctgactaccctcatggatgctctttatggatgaccctttacagtagggtcatctggagactgacttccagcaacatttttagagggggatggccccggtggccctcccctcaattccacaccccagacccaacctaccagtctctgttcttcaatgatccagcctgactctacctacttcctcttcagattccttcaccctatttaccttcctcaagtactggagaataaaattgaactgaatgtttgatgtctgtctgggaaagagctggggccatggaattcaggtgtggtatttagatcctaataacaatagttactatttattgagtttctattatgcaatagatccagtgctgagtgctttacctagataatgttatttcaatctcatgataacttggttaagtaggcactgatattaacttaatttcacaccgattaagctacagcatatttatcaatattatatatatattgctttggatggatggttgggtgggtgggtgggtggacggatgggcagatgggtggatgggtgggtgggtagatgtatgtatggatggatggatggatggatggatggatggatggtttgcatagttgcatggttggatggttgcatggttggatgaatggatggatggatgaatgaatggatggtggatggatggatggatggatggatagatggatggatgaatgatggatggatgaatggacagatggcacattccccaacaaggcaatggtatgcaaaaaaattttagccttgaatcctcgtatattttctgtgggtcttagttatagaaagaagcttatcttcctgtcatctcaaaatgtgtgtagactctcataacctcttctctcatattggtcttatgctcacctacattctcactaagttataggaactgtaggcattttaactcccttagtgatggccacactgaattaaaaattggacaactggacttgatttgctcttgtgcctggattatcagagcatttatgtagactaggcttgaatctctccctctggcaatctaaaagtaggaaggagagttaaatttgaattattctttagtctaagcaatcttacactcatccattcacctattcagtcatttattcatttaatgaatatttattaagagcccaatatgcaccaaccaagttctaggtgttaaggatacagcaatgaacaaggcagacaaggtctctgttctcatggagtttgccattttttaaaatttcttcttttttgacacatggtccaagatgagatcatggagttcacataaaaacagagaagtcaataaaatgcgacagggaggtcagaggcattatgtaacatcccatgtccctccacagagataccctatgtttaacagtaaaccttgaaaagctatttggggtgcaaaggtaagatacactccacagagaaactacaaaattaagagaccctacaggtctctgtattaaataggaattcgagtgagggaggagcagagaagtaagagggagctgccaataaagaagaagaaaaaggacaaaggaggtagaggaggaaaagggagctgagtaacaggagcgtgagaagggacttcaggagaaaaccaatcagggggataaaacagggcagggctggctggtggatccctaagaactacaatgcaaaccaaccctcttcatccctctggacctttagtagtttctgttacatacccaactgtcttctgtgagccatgttttgaagaaataaagaaaaggcgctgtgttctacatctgggctgcttgggggcaaaaaaaagagcttgaggtactcagaccctcaacacaataaagagttcagggcctggcaaggtggctcaggcctgtaatgccagtgttttgggaggccaaggtgaaagaatcctttgaggccaggaattcaacaccagcctgggcaacatagtgagaccccatttctacagaatataattgttcttaaaattagctggtggagttcgagaccagcctggccaatatggtgaaaccctgtctctactaaaaatataaataaatagccaggcatggtggcacgcccccgtagtctcagctactcaggaggctgaggcaggagaatcgcttgaacccggaggctgaggttgcagtgagccaagatcgcaccactgtactccggcttgggcgacaaaattaaactccgtctcaaaaaaaaaaaaaaaaaaaaaaaaaaaaaaaaaaagctggtggcaccatctgtagtcccagctactcggaaggctgaggcaggaggatcccttgagcccaggaggtcaagactgcagtgagccatgatcatgccactgtaccccagcctgagcaacagagcgagatcctgtctcaaaaatgaaagagtacagtaggaacaggaagtcaaagttagagagactactattacatgagctctctaggtttatagaaatcttaaacggacatttggcttctcactagacatgggacaggaacccagccaaattgatgtatatctcaaatgtcaggtgaccatcacagctgacatttaattacacaagataatcagtgcaatggtgccaaattaaagcaagcacaaaaaggtcccagtggacatgagggaggggaggactaactcatacctgagacgtcaggaaaggcttttgagaagaggtgattgatacctgtaagttgagctagagttagccagagagagatgggtaggcagataaggagggaagaaagaatgttccaggcagaaggaacagcatgtgcaaaggccgagaggaaaaaaagcttaatttgtcatttgaggacctaaacgtaagtccagctgggccatatttcgaattgggagtgcaagacagagaaagggaggaggggggttggggagggaagtagaagccagatctttcagatgccttataagccatgttaggaagtttgggctttatctgcctggaaataggaatccatggaaggattttgaggaagggaataattgcatttgctttcaagggagaaaaatggcactcacaaggaacaaggagctaagatgaggctatggcaatgattgtggggagaacagcggtggtggagaaggggtgaagacattcattggaaagatatctaaacagaagaatcaacagaacttggtgtgatggattataagtaaggggtgggagggcaggaatatcaggaatcacgagtggaaggtgatgccttaaatgtaccaggagaacaggaagaaaagaaattcataatgagaaggtgaggagttatgttttaagcatattgagttggagatgcctgagggacagtcaggtggggggatgcataactcaggaaaggaggttgcactggagacggaaacatagcagcaacatcccacaggtcaagacggtcaaaggaagaaatgggaagagaggcaagaagaggagaggagagaggggtcttgaggacagaataacgaaaagcatcaagaagcctactcagaaaataacatttactgactggacgcagtggctcaagcttgtgatcccagcattttgggaggccaaggtgggcggatcacctgatgtcaggagttcaagaccagcgtgaccaacatggtgaaacccagtctctattaaaaatacaaaaattagccaggtgtggtggtgcatgcctgtaatctcaggtactcaggaggctgaggcaggagaatcacttgaacccgggaggtagaggttacagtgagccaaaatcatggcattgcactccagcctgggtgacagcgtgagactctgtctcaaaagaaattaaaaaaaaattttaaataacatttactgaagggctgcttagttccagacctcatgcaaaatgcttggcatatatgatctcattccatcttcacaagcctgcaaagaagggctcttatatcctcctgttttgcagatgatggaatagagactctgagaaatgttttgtacgcatgtccagctgactatgaaccccctccccatccctaccctccgacctccagccccctctgctatgaaacaaggaggtcacgagagttattgcgcttttggaattgagctcatctaatgaggaggctttcatgaattgtattagctcacatttgtactgtattccactgtttccagagtgccttctccagtattatcttattcgatgctcacagcatccctctgaggtgggcattattataatccccattttgcaaagaaggatatcgagacttaagattgtccaatagtcacatagcaggtaagtgggagagccaagtctaaattgaagtctgtctgtcc
